(12) United States Patent
Schott et al.

(10) Patent No.: US 12,016,891 B2
(45) Date of Patent: Jun. 25, 2024

(54) IMMUNOMODULATORY COMPOSITIONS COMPRISING MICROBIAL ENTITIES

(71) Applicant: Solarea Bio, Inc., Cambridge, MA (US)

(72) Inventors: Eric Michael Schott, West Roxbury, MA (US); Gerardo V. Toledo, Hopkinton, MA (US); Maria Juliana Soto-Giron, Cambridge, MA (US); Alicia Eve Ballok, Natick, MA (US); Ryan Green, Somerville, MA (US); Mark Charbonneau, Medford, MA (US)

(73) Assignee: SOLAREA BIO, INC., Cambridge, MA (US)

( * ) Notice: Subject to any disclaimer, the term of this patent is extended or adjusted under 35 U.S.C. 154(b) by 0 days.

(21) Appl. No.: 18/304,264

(22) Filed: Apr. 20, 2023

(65) Prior Publication Data

US 2023/0256035 A1     Aug. 17, 2023

Related U.S. Application Data

(63) Continuation of application No. PCT/US2022/053684, filed on Dec. 21, 2022.
(Continued)

(51) Int. Cl.
*A61K 35/744*     (2015.01)
*A23L 33/105*     (2016.01)
(Continued)

(52) U.S. Cl.
CPC .......... *A61K 35/747* (2013.01); *A23L 33/105* (2016.08); *A23L 33/135* (2016.08);
(Continued)

(58) Field of Classification Search
CPC .................................................... A61K 35/744
See application file for complete search history.

(56) References Cited

U.S. PATENT DOCUMENTS 3,048,526 A    8/1962    Bloswell
3,108,046 A    10/1963   Harbit
(Continued)

FOREIGN PATENT DOCUMENTS

WO    2015/172191 A1    11/2015
WO    2019/118984 A2    6/2019

OTHER PUBLICATIONS

Giri, et al., "Role of Bacillus licheniformis VS16-Derived Biosurfactant in Mediating Immune Responses in Carp Rohu and its Application to the Food Industry", Frontiers in Microbiology, Mar. 2017, vol. 8, Article 514: pp. 1-13.
(Continued)

*Primary Examiner* — Rosanne Kosson
(74) *Attorney, Agent, or Firm* — Goodwin Procter LLP

(57) ABSTRACT

This disclosure provides for compositions (e.g., pharmaceutical compositions, dietary supplements, medical foods and food stuff), comprising combinations of live microbe populations for the treatment and/or prevention of immune system disorders and conditions related to inflammation, including both pathogen assisted conditions and conditions that are independent of pathogens. Included with the present disclosure are methods for use of the compositions, and methods for selecting microbial entities to formulate the compositions of the disclosure.

16 Claims, 43 Drawing Sheets

Specification includes a Sequence Listing.

Related U.S. Application Data

(60) Provisional application No. 63/348,854, filed on Jun. 3, 2022, provisional application No. 63/292,362, filed on Dec. 21, 2021.

(51) Int. Cl.
*A23L 33/135* (2016.01)
*A23L 33/15* (2016.01)
*A61K 31/525* (2006.01)
*A61K 35/742* (2015.01)
*A61K 35/747* (2015.01)
*A61K 45/06* (2006.01)
*A61P 29/00* (2006.01)

(52) U.S. Cl.
CPC ............ *A23L 33/15* (2016.08); *A61K 31/525* (2013.01); *A61K 35/742* (2013.01); *A61K 45/06* (2013.01); *A61P 29/00* (2018.01)

(56) References Cited

U.S. PATENT DOCUMENTS

| | | |
|---|---|---|
| 3,536,809 A | 10/1970 | Applezweig |
| 3,598,123 A | 8/1971 | Zaffaroni |
| 3,845,770 A | 11/1974 | Theeuwes et al. |
| 3,916,899 A | 11/1975 | Theeuwes et al. |
| 4,008,719 A | 2/1977 | Theeuwes et al. |
| 4,478,822 A | 10/1984 | Haslam et al. |
| 4,532,126 A | 7/1985 | Ebert et al. |
| 4,625,494 A | 12/1986 | Iwatschenko |
| 4,671,953 A | 6/1987 | Stanley et al. |
| 4,786,505 A | 11/1988 | Lovgren et al. |
| 4,800,083 A | 1/1989 | Hom et al. |
| 4,904,479 A | 2/1990 | Illum |
| 4,919,939 A | 4/1990 | Baker |
| 4,935,243 A | 6/1990 | Borkan et al. |
| 4,950,484 A | 8/1990 | Olthoff et al. |
| 5,013,726 A | 5/1991 | Ivy et al. |
| 5,059,595 A | 10/1991 | Grazie |
| 5,073,543 A | 12/1991 | Marshall et al. |
| 5,120,548 A | 6/1992 | McClelland et al. |
| 5,225,202 A | 7/1993 | Hodges et al. |
| 5,354,556 A | 10/1994 | Sparks et al. |
| 5,591,767 A | 1/1997 | Mohr et al. |
| 5,610,184 A | 3/1997 | Shahinian, Jr. |
| 5,639,476 A | 6/1997 | Oshlack et al. |
| 5,674,533 A | 10/1997 | Santus et al. |
| 5,733,556 A | 3/1998 | Schrier et al. |
| 5,733,575 A | 3/1998 | Mehra et al. |
| 5,837,284 A | 11/1998 | Mehta |
| 5,871,776 A | 2/1999 | Mehta |
| 5,902,632 A | 5/1999 | Mehta |
| 6,139,875 A | 10/2000 | Adams et al. |
| 6,258,380 B1 | 7/2001 | Overholt |
| 6,420,473 B1 | 7/2002 | Chittamuru et al. |
| 6,455,052 B1 | 9/2002 | Marcussen et al. |
| 6,482,435 B1 | 11/2002 | Stratton et al. |
| 6,544,510 B2 | 4/2003 | Olshenitsk et al. |
| 6,569,457 B2 | 5/2003 | Ullah et al. |
| 6,572,871 B1 | 6/2003 | Church et al. |
| 6,750,331 B1 | 6/2004 | Takaichi et al. |
| 7,214,370 B2 | 5/2007 | Naidu et al. |
| 8,318,151 B2 | 11/2012 | Darimont-Nicolau et al. |
| 8,460,726 B2 | 6/2013 | Harel et al. |
| 8,802,158 B2 | 8/2014 | Boileau et al. |
| 8,871,266 B2 | 10/2014 | Sanguansri et al. |
| 8,877,178 B2 | 11/2014 | Boileau et al. |
| 9,040,101 B2 | 5/2015 | Heiman et al. |
| 9,095,604 B2 | 8/2015 | Ikegami et al. |
| 9,173,910 B2 | 11/2015 | Kaplan et al. |
| 9,301,983 B2 | 4/2016 | Huang et al. |
| 9,371,510 B2 | 6/2016 | Moore |
| 9,386,793 B2 | 7/2016 | Blaser et al. |
| 9,487,764 B2 | 11/2016 | Falb et al. |
| 9,549,955 B2 | 1/2017 | Rittmann et al. |
| 9,636,367 B2 | 5/2017 | Garcia-Rodenas et al. |
| 9,937,211 B2 | 4/2018 | Kelly et al. |
| 10,064,895 B2 | 9/2018 | Vincent |
| 2004/0213828 A1 | 10/2004 | Smith |
| 2005/0147710 A1 | 7/2005 | Teckoe et al. |
| 2010/0172874 A1 | 7/2010 | Turnbaugh et al. |
| 2011/0111094 A1 | 5/2011 | Lavermicocca et al. |
| 2011/0177567 A1 | 7/2011 | Bakker et al. |
| 2011/0177976 A1 | 7/2011 | Gordon et al. |
| 2012/0015075 A1 | 1/2012 | Davis et al. |
| 2012/0040387 A1 | 2/2012 | Matsuoka |
| 2014/0044858 A1 | 2/2014 | Quevedo |
| 2014/0065209 A1 | 3/2014 | Putaala et al. |
| 2014/0147425 A1 | 5/2014 | Henn et al. |
| 2014/0179726 A1 | 6/2014 | Bajaj et al. |
| 2014/0314719 A1 | 10/2014 | Smith et al. |
| 2015/0126463 A1 | 5/2015 | Hsiao et al. |
| 2015/0259728 A1 | 9/2015 | Cutcliffe et al. |
| 2015/0366941 A1 | 12/2015 | Menear et al. |
| 2016/0067289 A1 | 3/2016 | Berggren et al. |
| 2016/0081309 A1 | 3/2016 | Newton et al. |
| 2016/0143961 A1 | 5/2016 | Berry et al. |
| 2016/0199424 A1 | 7/2016 | Berry et al. |
| 2016/0206666 A1 | 7/2016 | Falb et al. |
| 2016/0235792 A1 | 8/2016 | Berry et al. |
| 2016/0263166 A1 | 9/2016 | Elinav et al. |
| 2016/0271189 A1 | 9/2016 | Cutcliffe et al. |
| 2016/0302464 A1 | 10/2016 | Egli et al. |
| 2016/0354417 A1 | 12/2016 | Smittle et al. |
| 2017/0326190 A1 | 11/2017 | Ansell et al. |
| 2018/0303934 A1* | 10/2018 | Clube .................... A61K 35/15 |
| 2020/0164002 A1 | 5/2020 | Toledo et al. |
| 2022/0354907 A1 | 11/2022 | Toledo et al. |

OTHER PUBLICATIONS

Glowacki, et al., "Prevention of inflammation-mediated bone loss in murine and canine periodontal disease via recruitment of regulatory lymphyocytes", Nov. 2013, Nov. 2013, vol. 110, No. 46: pp. 18525-18530 (7 pages). Epub Oct. 2013.

Griffiths, et al., "Psoriasis and Atopic Dermatitis", Dermatol Ther (Heidelb), Epub: Feb. 2017, vol. 7 (Suppl 1): pp. S31-S41.

Grootaert, et al., "Adherence and viability of intestinal bacteria to differentiated Caco-2 cells quantified by flow cytometry", Journal of Microbiological Methods, Epub: Apr. 2011, vol. 86, No. 1: pp. 33-41.

Guo, et al., "Clostridium species as probiotics: potentials and challenges", Journal of Animal Science and Biotechnology, Feb. 2020, vol. 11, No. 24: pp. 1-10.

Gusmao-Silva, et al., "Hsp65-Producing Lactococcocus lactis Prevents Antigen-Induced Arthritis in Mice", Frontiers in Immunology, Sep. 2020, vol. 11, Article: 562905: pp. 1-15.

Guttman-Yassky, et al., "Contrasting pathogenesis of atopic dermatitis and psoriasis—Part I: Clinical and pathologic concepts", J Allergy Clin Immunol., Epub Mar. 2011, vol. 127, No. 5: pp. 1110-1118.

Han, et al., "Probiotic Gastrointestinal Transit and Colonization After Oral Administration: A Long Journey", Frontiers in Cellular and Infection Microbiology, Mar. 2021, vol. 11, Article 609722: pp. 1-12.

Hang, et al., "Bile acid metabolites control Th17 and Treg cell differentiation", Nature, Dec. 2019, vol. 576 (7785): pp. 143-148 (34 pages). Epub Nov. 2019. Author Manuscript.

Heinken, et al., "Systematic assessment of secondary bile acid metabolism in gut microbes reveals distinct metabolic capabilities in inflammatory bowel disease", Microbiome, May 2019, vol. 7, No. 1: pp. 1-18.

Higgins, et al., "Toll-Like Receptor 4-Mediated Innate IL-10 Activates Antigen-Specific Regulatory T Cells and Confers Resistance to Bordetella pertussis by Inhibiting Inflammatory Pathology", The Journal of Immunology, Sep. 2003, vol. 171, No. 6: pp. 3119-3127.

Hofer, et al., "Caloric Restriction Mimetics in Nutrition and Clinical Trials", Frontiers in Nutrition, Sep. 2021, vol. 8, Article 717343: pp. 1-20.

(56) References Cited

OTHER PUBLICATIONS

Holden, et al., "Enteropathic arthritis", Rheumatic Disease Clinics of North America, Aug. 2003, vol. 29, No. 3: pp. 513-530.
Holers, et al., "Rheumatoid arthritis and the mucosal origins hypothesis: protection turns to destruction", Nature Reviews Rheumatology, Sep. 2018, vol. 14, No. 9: pp. 542-557 (16 pages).
Holmdahl, et al., "The molecular pathogenesis of collagen-induced arthritis in mice—a model for rheumatoid arthritis", Ageing Research Reviews, Feb. 2002, vol. 1, No. 1: pp. 135-147.
Huang, et al., "Bacteriocins: Potential for Human Health", Oxidative Medicine and Cellular Longevity, Apr. 2021, vol. 2021, Article 5518825: pp. 1-17.
Hug, et al., "Toll-Like Receptors: Regulators of the Immune Response in the Human Gut ", Nutrients, Feb. 2018, vol. 10(2):203: pp. 1-16.
Hunter, et al., "Prevalence of rheumatoid arthritis in the United States adult population in healthcare claims databases, 2004-2014", Rheumatology International, Sep. 2017, vol. 37, No. 9: pp. 1551-1557. Epub Apr. 2017.
Jang, et al., "IL-6 and IL-10 Induction from Dendritic Cells in Response to Mycobacterium tuberculosis Is Predominantly Dependent on TLR2-Mediated Recognition", The Journal of Immunology, Sep. 2004, vol. 173, No. 5: pp. 3392-3397.
Jenab, et al., "Bacterial Natural Compounds with Anti-Inflammatory and Immunomodulatory Properties (Mini Review)", Drug Design, Development and Therapy, Sep. 2020, vol. 14: pp. 3787-3801.
Jhun, et al., "Lactobacillus sakei suppresses collagen-induced arthritis and modulates the differentiation of T helper 17 cells and regulatory B cells", Journal of Translational Medicine, Month 2020, vol. 18(1):317: pp. 1-11.
Jia, et al., "Common methods of biological age estimation", Clinical Interventions in Aging, May 2017, vol. 12: pp. 759-772 (15 pages).
Jin, et al., "Isolation and characterization of high exopolysaccharide-producing Weissella confuse VP30 from young children's feces", Microbial Cell Factories, Jun. 2019, vol. 18(1):110: pp. 1-13.
Jin, et al., "Localization and Function of GABA Transporters GAT-1 and GAT-3 in the Basal Ganglia", Frontiers in Systems Neuroscience, Jul. 2011, vol. 5, Article 63: pp. 1-10.
Jubair, et al., "Modulation of inflammatory arthritis by gut microbiota through mucosal inflammation and autoantibody generation ", Arthritis Rheumatol, Aug. 2018, vol. 70, No. 8: pp. 1220-1233 (21 pages). Author manuscript. Epub Jul. 2018.
Justice, et al., "A framework for selection of blood-based biomarkers for geroscience-guided clinical trials: report from the TAME Biomarkers Workgroup", GeroScience, Dec. 2018, vol. 40, No. 5-6: pp. 419-436 (18 pages). Epub Aug. 2018.
Justice, et al., "Frameworks for Proof-of-Concept Clinical Trials of Interventions That Target Fundamental Aging Processes", J Gerontol A Biol Sci Med Sci, Nov. 2016, vol. 71, No. 11: pp. 1415-1423. Epub Aug. 2016.
Kang, et al., "Modulation of Inflammatory Cytokines by Omega-3 Fatty Acids", Subcell Biochem., 2008, vol. 49: pp. 133-143.
Kinane, et al., "Periodontal diseases", Nature Reviews Disease Primers, Jun. 2017, vol. 3, Article 17038: pp. 1-14.
Kindt, et al., "The G Protein-Coupled Bile Acid Receptor TGR5 (Gpbar1) Modulates Endothelin-1 Signaling in Liver", Cells, Nov. 2019, vol. 8(11):1467: pp. 1-21.
Klemera, et al., "A new approach to the concept and computation of biological age", Mechanisms of Ageing and Development, Mar. 2006, vol. 127, No. 3: pp. 240-248. Epub Nov. 2005.
Kobayashi, et al., "Oral administration of Lactobacillus gasseri SBT2055 is effective in preventing Porphyromonas gingivalis-accelerated periodontal disease", Scientific Reports, Apr. 2017, vol. 7, No. 1, Article 545: pp. 1-10.
Kolmogorov, et al., "Assembly of long, error-prone reads using repeat graphs", Nature Biotechnology, May 2019, vol. 37, No. 5: pp. 540-546. Epub Apr. 2019.
Komura, et al., "Caenorhabditis elegans as an alternative model host for legionella pneumophila, and protective effects of Bifidobacterium infantis", Applied and Environmental Microbiology, Jun. 2010, vol. 76, No. 12: pp. 4105-4108. Epub Apr. 2010.
Komura, et al., "Mechanism underlying prolongevity induced by bifidobacteria in Caenorhabditis elegans", Biogerontology, Feb. 2013, vol. 14, No. 1: pp. 73-87. Epub Jan. 2013.
Ku, et al., "Anti-inflammatory effects of 27 selected terpenoid compounds tested through modulating Th1/Th2 cytokine secretion profiles using murine primary splenocytes", Food Chemistry, Nov. 2013, vol. 141, No. 2: pp. 1104-1113. Epub Apr. 2013.
Kulkami, et al., "Benefits of Metformin in Attenuating the Hallmarks of Aging", Cell Metabolism, Jul. 2020, vol. 32, No. 1: pp. 15-30. Epub Apr. 2020.
Kumar, et al., " A Potential Probiotic Lactobacillus plantarum JBC5 Improves Longevity and Healthy Aging by Modulating Antioxidative, Innate Immunity and Serotonin-Signaling Pathways in Caenorhabditis elegans", Antioxidants (Basel), Jan. 2022, vol. 11, No. 2, Article 268: pp. 1-25.
Kumari, et al., "Mechanisms of Cellular Senescence: Cell Cycle Arrest and Senescence Associated Secretory Phenotype", Frontiers in Cell and Developmental Biology, Mar. 2021, vol. 9, Article 645593: pp. 1-24.
Kushkevych, et al., "Sulfate-Reducing Bacteria of the Oral Cavity and Their Relation with Periodontitis—Recent Advances", Journal of Clinical Medicine, Jul. 2020, vol. 9, No. 8, Article 2347: pp. 1-20.
Oliviero, et al., "Benefits of Probiotics in Rheumatic Diseases", Frontiers in Nutrition, Sep. 2020, vol. 7, Article 157, pp. 1-6.
Ozogul, et al., "The Function of Lactic Acid Bacteria on Biogenic Amines Production by Food-Borne Pathogens in Arginine Decarboxylase Broth", Food Sci. Technol. Res., 18 (6), 795-804, 2012.
Pahor, et al., "Effect of Losartan and Fish Oil on Plasma IL-6 and Mobility in Older Persons. The ENRGISE Pilot Randomized Clinical Trial.", J Gerontol A Biol Sci Med Sci, 2019, vol. 74, No. 10, 1612-1619.
Paine, et al., "Dysregulation of bile acids, lipids, and nucleotides in psoriatic arthritis revealed by unbiased profiling of serum metabolites", American College of Rheumatology , Jul. 11, 2022. https://doi: 10.1002/art.42288.
Pan, et al., "Key proteins and pathways that regulate lifespan", J. Biol. Chem. (2017) 292(16) 6452-6460.
Pan, et al., "Predominant gut Lactobacillus murinus strain mediates anti-inflammaging effects in calorie-restricted mice", Microbiome, vol. 6, Iss 1, pp. 1-17 (2018).
Park, et al., "Probiotic Lactobacillus fermentum strain JDFM216 stimulates the longevity and immune response of Caenorhabditis elegans through a nuclear hormone receptor", Scientific Reports, 2018, pp. 1-10.
Park, et al., "Short communication: Development of a direct in vivo screening model to identify potential probiotic bacteria using Caenorhabditis elegans", Journal of Dairy Science, 2014, vol. 97, No. 11, pp. 6828-6834.
Parks, et al., "CheckM: assessing the quality of microbial genomes recovered from isolates, single cells, and metagenomes", Genome Research, 2015, pp. 1043-1055.
Paul, et al., "Probiotics and Amelioration of Rheumatoid Arthritis: Significant Roles of Lactobacillus casei and Lactobacillus acidophilus", Microorganisms, 2021, pp. 1-17.
Abdulla OA, Neamah W, Sultan M, Alghetaa HK, Singh N, Busbee PB, Nagarkatti M and Nagarkatti P (2021) The Ability of AhR Ligands to Attenuate Delayed Type Hypersensitivity Reaction Is Associated With Alterations in the Gut Microbiota. Front. Immunol. 12:684727. doi: 10.3389/fimmu.2021.684727.
Aghaloo, et al. "Periodontal Diseas and Bisphosphonates Induce Osteonecrosis of the Jaws in the Rat", Journal of Bone and Mineral Research, vol. 26, No. 8, Aug. 2011, pp. 1871-1882 DOI: 10.1002/jbmr.379.
Agus et al. "Gut Microbiota Regulation of Tryptophan Metabolism in Health and Disease," Cell Host & Microbe, vol. 23, Issue 6, 2018, pp. 716-724, ISSN 1931-3128, https://doi.org/10.1016/j.chom.2018.05.003.
Aletaha et al. "2010 Rheumatoid arthritis classification criteria: An American College of Rheumatology/European League Against Rheu-

(56) References Cited

OTHER PUBLICATIONS matism collaborative initiative." Arthritis & Rheumatism, 62: 2569-2581. https://doi.org/10.1002/art.27584.

Alipour, B. et.al. Effects of Lactobacillus casei supplementation on disease activity and inflammatory cytokines in rheumatoid arthritis patients: a randomized double-blind clinical trial. (2014) Int J Rheum Dis, 17: 519-527. https://doi.org/10.1111/1756-185X.12333.

Allen. P. et al. "Immunomodulatory Roles of Polysaccharide Capsules in the Intestine Frontiers in Immunology" vol. 11 (2020) https://www.frontiersin.org/articles/10.3389/fimmu.2020.00690, DOI= 10.3389/fimmu.2020.00690.

Almutairi et al., "The global prevalence of rheumatoid arthritis: a meta-analysis based on a systematic review", Rheumatology International, 2020, https://doi.org/10.1007/s00296-020-04731-0: pp. 1-15.

Alpert, et al., "A clinically meaningful metric of immune age derived from high-dimensional longitudinal monitoring", Nature Medcine, Mar. 2019, vol. 25, pp. 487-495.

Amalraj, et al., "A Novel Highly Bioavailable Curcumin Formulation Improves Symptoms and Diagnostic Indicators in Rheumatoid Arthritis Patients: A Randomized, Double-Blind, Placebo-Controlled, Two-Dose, Three-Arm, and Parallel-Group Study", J Med Food 20 (10) 2017, 1022-1030. DOI: 10.1089/jmf.2017.3930.

Amdekar, et al., "Lactobacillus casei reduces the Inflammatory Joint Damage Associated with Collagen-Induced Arthritis (CIA) by Reducing the Pro-Inflammatory Cytokines", J Clin Immunol (2011) 31:147-154.

An, et al., "GABA-producing Lactobacillus plantarum inhibits metastatic properties and induces apoptosis of 5-FU-resistant colorectal cancer cells via GABAB receptor signaling", Journal of Microbiology (2021) vol. 59, No. 2, pp. 202-216.

Apweiler, et al., "Protein sequence databases", Current Opinion in Chemical Biology (2004) 8:76-80.

Artacho, et al., "The Pretreatment Gut Microbiome Is Associated With Lack of Response to Methotrexate in New-Onset Rheumatoid Arthritis", American College of Rheumatology, vol. 73, No. 6, Jun. 2021, pp. 931-942.

Atkinson, et al., "Establishment and characterization of a sustained delayed-type hypersensitivity model with arthritic manifestations in C57BL/6J mice", Arthritis Research & Therapy (2012) 14:R134, pp. 1-16.

Atkinson, et al., "Pharmacological Value of Murine Delayed-type Hypersensitivity Arthritis: A Robust Mouse Model of Rheumatoid Arthritis in C57BL/6 Mice", Basic & Clinical Pharmacology & Toxicology, 2017, 120, 108-114.

Bae, et al., "Akkermansia muciniphila phospholipid induces homeostatic immune responses", Nature, Jul. 27, 2022, pp. 1-21.

Bagga, et al., "Differential effects of prostaglandin derived from w-6 and w-3 polyunsaturated fatty acids on COX-2 expression and IL-6 secretion", PNAS, Feb. 18, 2003, vol. 100, pp. 1751-1756.

Bander, et al., "The Gut Microbiota and Inflammation: An Overview", Int. J. Environ. Res. Public Health 2020, 17, 7618; doi:10.3390/ijerph17207618.

Bansal, et al., "The bacterial signal indole increases epithelial-cell tight-junction resistance and attenuates indicators of inflammation", PNAS, Jan. 5, 2010, vol. 107, pp. 1-6.

Belsky, et al., "Change in the Rate of Biological Aging in Response to Caloric Restriction: CALERIE Biobank Analysis", J Gerontol A Biol Sci Med Sci, 2018, vol. 73, No. 1, 4-10 doi: 10.1093/gerona/glx096.

Bharath, et al., "Metformin Enhances Autophagy and Normalizes Mitochondrial Function to Alleviate Aging-Associated Inflammation", Cell Metabolism, 2020, 32, 44-55. https://doi.org/10.1016/j.cmet.2020.04.015.

Bodkhe, et al., "The role of microbiome in rheumatoid arthritis treatment", Therapeutic Advances in Musculoskeletal Disease, Feb. 2019, vol. 11: pp. 1-16.

Brand, et al., "Collagen-induced arthritis", Nature Protocols, 2007, vol. 2 No. 5., 1269-1275. doi: 10.1038/nprot.2007.173.

Braun, et al., "Ankylosing spondylitis", Lancet 2007; 369: 1379-90.

Bürkle, et al., "Mechanisms of Ageing and Development", Mechanisms of Ageing and Development 151 (2015), pp. 2-12.

Caffaratti, et al., "What We Know So Far about the Metabolite-Mediated Microbiota-Intestinal Immunity Dialogue and How to Hear the Sound of This Crosstalk", Metabolites 2021, 11, 406. https://doi.org/10.3390/metabo11060406 https://www.mdpi.com/journal/metabolites: pp. 1-37.

Cario, "Barrier-protective function of intestinal epithelial Toll-like receptor 2", nature publishing group, vol. 1 Supplement 1 | Nov. 2008 | www.nature.com/mi, doi:10.1038/mi.2008.47: pp. S62-S66.

Catrina, et al., "RA: from risk factors and pathogenesis to prevention, Gene, environment, microbiome and mucosal immune tolerance in rheumatoid arthritis", Rheumatology Advance Access published Dec. 23, 2014, doi: 10.1093/rheumatology/keu469, Downloaded from http://rheumatology.oxfordjournals.org/ at University of California, San Francisco on Mar. 11, 2015: pp. 1-12.

Chassaing, et al., "Intestinal Epithelial cell Toll-like Receptor 5 Regulates the Intestinal Microbiota to Prevent Low-grade Inflammation and Metabolic Syndrome in Mice", Published in final edited form as: Gastroenterology. Dec. 2014 ; 147(6): 1363-1377.e17. doi: 10.1053/j.gastro.2014.08.033,; pp. 1-19.

Choi, et al., "Diet mimicking fasting promotes regeneration and reduces autoimmunity and multiple sclerosis symptoms", Published in final edited form as: Cell Rep. Jun. 7, 2016; 15(10): 2136-2146. doi:10.1016/j.celrep.2016.05.009: pp. 1-18.

Chriswell, et al., "Microbiota mediated mucosal inflammation in arthritis", Published in final edited form as: Best Pract Res Clin Rheumatol. Dec. 2019 ; 33(6): 101492. doi: 10.1016/j.berh.2020.101492; pp. 1-17.

Costa, et al., "Microbial Extracellular Polymeric Substances: Ecological Function and Impact on Soil Aggregation", Frontiers in Microbiology | www.frontiersin.org | Jul. 23, 2018 | vol. 9 | Article 1636 | doi: 10.3389/fmicb.2018.01636: pp. 1-14.

Crimmins, et al., "Quest for a summary measure of biological age: the health and retirement study", GeroScience (2021) 43:395-408, https://doi.org/10. 1007/s11357-021-00325-1: pp. 395-408.

Cunha, et al., "Nisin Influence on the Antimicrobial Resistance Ability of Canine Oral Enterococci", Antibiotics 2020, 9, 890; doi:10.3390/antibiotics9120890 www.mdpi.com/journal/antibiotics: pp. 1-14.

Cuollo, et al., "The Senescence-Associated Secretory Phenotype (SASP) in the Challenging Future of Cancer Therapy and Age-Related Diseases", Biology 2020, 9, 485; doi:10.3390/biology9120485 www.mdpi.com/journal/biology: pp. 1-16.

Deshpande, et al., "Para-probiotics for Preterm Neonates—The Next Frontier", Nutrients 2018, 10, 871; doi:10.3390/nu10070871 www.mdpi.com/journal/nutrients: pp. 1-9.

Diebel, et al., "Determination of Biological Age: Geriatric Assessment vs Biological Biomarkers", Current Oncology Reports (2021) 23: 104 | https://doi.org/10.1007/s11912-021-01097-9: pp. 1-8.

Fan, et al., "Lactobacillus casei CCFM1074 Alleviates Collagen-Induced Arthritis in Rats via Balancing Treg/Th17 and Modulating the Metabolites and Gut Microbiota", Frontiers in Immunology | www.frontiersin.org | May 17, 2021 | vol. 12 | Article 680073 | doi: 10.3389/fimmu.2021.680073: pp. 1-15.

Fan, et al., "Protective effects of Bifidobacterium adolescentis on collagen-induced arthritis in rats depend on timing of administration", Food Funct., 2020, 11, 4499-4511 | DOI: 10.1039/d0fo00077a | Published on Apr. 29, 2020. Downloaded by Harvard University on Dec. 7, 2021 9:17:48 PM: pp. 4499-4511.

Feres, et al., "The subgingival periodontal microbiota of the aging mouth", Periodontology 2000, vol. 72, 2016, 30-53 Printed in Singapore. All rights reserved | © 2016 John Wiley & Sons A/S. Published by John Wiley & Sons Ltd.: pp. 30-53.

Ferro, et al., "Probiotic Supplementation for Rheumatoid Arthritis: A Promising Adjuvant Therapy in the Gut Microbiome Era", Frontiers in Pharmacology | www.frontiersin.org | Jul. 23, 2021 | vol. 12 | Article 711788 | doi: 10.3389/fphar.2021.711788: pp. 1-17.

Fiorucci, et al., "Bile Acids Activated Receptors Regulate innate immunity", Frontiers in Immunology | www.frontiersin.org | Aug. 13, 2018 | vol. 9 | Article 1853 | doi: 10.3389/fimmu.2018.01853: pp. 1-17.

(56) References Cited

OTHER PUBLICATIONS

Flanagan, et al., "Annual Review of Nutrition Calorie Restriction and Aging in Humans", Annu. Rev. Nutr. 2020.40:105-133. Downloaded from www.annualreviews.org | Access provided by CASA Institution Identity on Feb. 20, 2023 | https://doi.org/10.1146/annurev-nutr-122319-034601: pp. 105-135.

Forster, et al., "Identification of gut microbial species linked with disease variability in a widely used mouse model of colitis", https://doi.org/10.1038/s41564-022-01094-z | Nature Microbiology | vol. 7 | Apr. 2022 | www.nature.com/naturemicrobiology: pp. 590-599.

Franceschi, et al., "Inflammaging: a new immune-metabolic viewpoint for age-related diseases", Nat Rev Endocrinol., Oct. 2018, vol. 14, No. 10: pp. 576-590.

Fransen, et al., "Aged Gut Microbiota Contributes to Systemical Inflammaging after Transfer to Germ-Free Mice", Frontiers in Immunology, Nov. 2017, vol. 8, Article 1385: pp. 1-12.

Gao, et al., "Impact of the Gut Microbiota on Intestinal Immunity Mediated by Tryptophan Metabolism", Frontiers in Cellular and Infection Microbiology, Feb. 2018, vol. 8, Article 13: pp. 1-22.

Gatej, et al., "Probiotic Lactobacillus rhamnosus GG prevents alveolar bone loss in a mouse model of experimental periodontitis", J Clin Periodontol., Nov. 2017, vol. 45, No. 2: pp. 1-21. doi: 10.1111/jcpe.12838.

Ge, et al., "Helicobacter pylori-infected C57BL/6 mice with different gastrointestinal microbiota have contrasting gastric pathology, microbial and host immune responses", Science Reports, May 2018, vol. 8, No. 1, Article: 8014: pp. 1-15.

Ghosh, et al., "The gut microbiome as a modulator of healthy ageing", Nature Reviews Gastroenterology & Hepatology, Epub: Apr. 2022, vol. 19, No. 9: pp. 565-584.

"Bone Density Study in Post-Menopausal Women", RDC Clinical, New Study Announcement, Dec. 3, 2021[online], [Retrieved Jun. 9, 2022]. Retrieved from the internet: https://www.rdcclinical.com.au/trials/bone-density-study/. 8 Pages.

"Solarea Bio Announces Licensing Agreement with ADM", Solarea Bio Press Release, Oct. 19, 2021, 10:17 ET: pp. 1-3.

"Solarea Bio Investigators Receive National Academy of Medicine Healthy Longevity 2022 Quickfire Challenge Award", Solarea Bio Press Release, Sep. 29, 2022, 09:17 ET: pp. 1-3.

"Solarea Bio Teams up with Hebrew SeniorLife Investigators on a Newly Awarded U.S. National Academy of Medicine Catalyst Grant", Solarea Bio Press Release, Nov. 4, 2021, 10:17 ET: pp. 1-4.

"Solarea peer-review publication reveals green olives and other fruits and vegetables have vast microbial diversity with the potential to deliver probiotic functionality", Solarea Bio Press Release, Solarea Bio Press Release, Dec. 15, 2021, 10:17 ET: pp. 1-3.

Abuajah, et al., "Functional components and medicinal properties of food: a review", J Food Sci Technol, 2015, vol. 52, No. 5: pp. 2522-2529.

Abubucker, et al., "Metabolic Reconstruction for Metagenomic Data and Its Application to the Human Microbiome", PLoS Computational Biology, Jun. 2012, vol. 8, No. 6: pp. 1-17.

Ahlborg, et al., "Bone Loss and Bone Size after Menopause", The New England Journal of Medicine, Jul. 24, 2003, vol. 349, No. 4: pp. 327-334.

Akamatsu, et al., "Conversion of antigen-specific effector/memory T cells Into Foxp3-expressing Treg cells by inhibition of CDK8/19", Science Immunology, Oct. 25, 2019, vol. 4: pp. 1-16.

Alcock, et al., "Is eating behavior manipulated by the gastrointestinal microbiota? Evolutionary pressures and potential mechanisms", Bioessays 2014, vol. 36: pp. 940-949.

Allgeier, et al., "A colorimetric method for the determination of butyric acid", J Bacteriol, 1929, vol. 17, No. 2: pp. 79-87.

Altman, et al., "Development of Criteria for the Classification and Reporting of Osteoarthritis," Arthritis and Rheumatism, Aug. 1986, vol. 29, No. 8: pp. 1039-1049.

Altschul, et al., "Basic Local Alignment Search Tool", J Mol Biol., Oct. 5, 1990, vol. 215, No. 3: pp. 403-410.

Ananthakrishnan, et al., "Gut Microbiome Function Predicts Response to Anti-integrin Biologic Therapy in Inflammatory Bowel Diseases", Cell Host & Microbe, May 10, 2017, vol. 21: pp. 603-610.

Anastasilakis, et al., "Head-to-head comparison of risedronate vs. teriparatideon bone turnover markers in women with postmenopausal osteoporosis: a randomised trial", Int J Clin Pract, Jun. 2008, vol. 62, No. 6: pp. 919-924.

Arjmandi, et al., "Bone-Protective Effects of Dried Plum in Postmenopausal Women: Efficacy and Possible Mechanisms", Nutrients, 2019, vol. 9, No. 496: pp. 1-19.

Aron-Wisnewsky, et al., "The importance of the gut microbiota after bariatric surgery", Nature, 2012, vol. 9, No. 10: pp. 590-598.

Arumugam, et al., "Enterotypes of the human gut microbiome", Nature, 2011, vol. 473, No. 7346: pp. 174-180.

Asgari, et al., "Nucleotide-pair encoding of 16S rRNA sequences for host phenotype and biomarker detection", bioRxiv, Jul. 19, 2018, pp. 1-25. https://doi.org/10.1101/334722.

Atarashi, et al., "Induction of Colonic Regulatory T Cells by Indigenous Clostridium Species", Science, Jan. 21, 2011, vol. 331: pp. 337-341.

Atarashi, et al., "Treg induction by a rationally selected mixture of Clostridia strains from the human microbiota", Nature, Aug. 8, 2013, vol. 500: pp. 232-236.

Backhed, et al., "Mechanisms underlying the resistance to diet-induced obesity in germ-free mice", PNAS, 2007, vol. 104, No. 3: pp. 979-984.

Backhed, et al., "The gut microbiota as an environmental factor that regulates fat storage", PNAS, 2004, vol. 101, No. 44: pp. 15718-15723.

Bahr, et al., "Risperidone-induced weight gain is mediated through shifts in the gut microbiome and suppression of energy expenditure", EBioMedicine, 2015, vol. 2: pp. 1725-1734.

Bai, et al., "Response of gut microbiota and inflammatory status to bitter melon (*Momordica charantia* L.) in high fat diet induced obese rats", J Ethnopharmacol, 2016, vol. 194: pp. 717-726.

Baker, et al., "Estrogen-gut microbiome axis: Physiological and clinical implications", Maturitas, 2017, vol. 103: pp. 45-53.

Bakker-Zierikzee, et al., "Effects of infant formula containing a mixture of galacto- and fructo-oligosaccharides or viable Bifidobacterium animalis on the intestinal microflora during the first 4 months of life", Br J Nutr, 2005, vol. 94: pp. 783-790.

Basu, et al., "Blueberries decrease cardiovascular risk factors in obese men and women with metabolic syndrome", J Nutr, 2010, vol. 140, No. 9: pp. 1582-1587.

Bellamy, et al., "Validation study of WOMAC: a health status instrument for measuring clinically important patient relevant outcomes to antirheumatic drug therapy in patients with osteoarthritis of the hip or knee", J Rheumatol, Dec. 1988, vol. 15, No. 12: pp. 1833-1840.

Berg, et al., "The Edible plant microbiome: importance and health issues", In: Lugtenberg B. (eds) Principles of plant-microbe interactions. Springer, Cham, 2015.

Bernini, et al., "Beneficial effects of Bifidobacterium lactis on lipid profile and cytokines in patients with metabolic syndrome", Nutrition, 2016, vol. 32: pp. 716-719.

Biaggini, et al., "The pathogenic potential of Pseudomonas fluorescens MFN1032 on enterocytes can be modulated by serotonin, substance P and epinephrine." *Archives of microbiology* 197, No. 8 (2015): 983-990.

Bischoff, et al., "Role of serotonin in intestinal inflammation: knockout of serotonin reuptake transporter exacerbates 2,4,6-trinitrobenzene sulfonic acid colitis in mice", Am J Physiol Gastrointest Liver Physiol, Mar. 2009, vol. 296, No. 3: pp. G685-G695.

Black, et al., "Postmenopausal Osteoporosis", The New England Journal of Medicine, Jan. 21, 2016, vol. 374, No. 3: pp. 254-262.

Bleau, et al., "Crosstalk between intestinal microbiota, adipose tissue and skeletal muscle as an early event in systemic low-grade inflammation and the development of obesity and diabetes", Diabetes Metab Res Rev, 2015, vol. 31, No. 6: pp. 545-561.

Boden, et al., "Obesity, Insulin Resistance and Free Fatty Acids", Curr Opin Endocrinol Diabetes Obes, 2011, vol. 18, No. 2: pp. 139-143.

(56) References Cited

OTHER PUBLICATIONS

Body, et al., "A Randomized Double-Blind Trial to Compare the Efficacy of Teriparatide [Recombinant Human Parathyroid Hormone (1-34)] with Alendronate in Postmenopausal Women with Osteoporosis", The Journal of Clinical Endocrinology & Metabolism, Oct. 2002, vol. 87, No. 10: pp. 4528-4535.
Bouxsein, et al., "Considerations for Development of Surrogate Endpoints for Antifracture Efficacy of New Treatments in Osteoporosis: A Perspective", Journal of Bone and Mineral Research, Mar. 3, 2008, vol. 23, No. 8: pp. 1155-1167.
Bouxsein, et al., "Ovariectomy-Induced Bone Loss Varies Among Inbred Strains of Mice", Journal of Bone and Mineral Research, Mar. 7, 2005, vol. 20, No. 7: pp. 1085-1092.
Brahe, et al., "Is butyrate the link between diet, intestinal microbiota and obesity-related metabolic diseases?", Obes Rev, 2013, vol. 14: pp. 950-959.
Britton, et al., "Probiotic L. reuteri Treatment Prevents Bone Loss in a Menopausal Ovariectomized Mouse Model", Journal of Cellular Physiology, 2014, vol. 229: pp. 1822-1830.
Bron, et al., "Emerging molecular insights into the interaction between probiotics and the host intestinal mucosa", Nat Rev Microbiol, 2012, vol. 10: pp. 66-78.
Brown, et al., "Comparison of the Effect of Denosumab and Alendronate on BMD and Biochemical Markers of Bone Turnover in Postmenopausal Women With Low Bone Mass: A Randomized, Blinded, Phase 3 Trial*", Journal of Bone and Mineral Research, 2009, vol. 24: pp. 153-161.
Brown, et al., "Gut Microbiota Regulation of T Cells During Inflammation and Autoimmunity", Annual Review of Immunology, 2019, vol. 37: pp. 599-624.
Brunkwall, et al., "The gut microbiome as a target for prevention and treatment of hyperglycemia in type 2 diabetes: from current human evidence to future possibilities", Diabetalogia, 2017, vol. 60: pp. 943-951.
Calise, et el., "Immune Response-Dependent Assembly of IMP Dehydrogenase Filaments", Frontiers in Immunology, Nov. 29, 2018, vol. 9, Article 2789: pp. 1-15.
Camacho, et al., "Metformin in breast cancer-an evolving mystery", Breast Cancer Res, 2015, vol. 17, No. 88: pp. 1-4.
Campbell, et al., "The China Study: The most comprehensive study of nutrition ever conducted and startling implications for diet, weight loss, and long term health," Benbella, 2006, 425 pages.
Cani, et al., "Changes in gut microbiota control metabolic endotoxemia-induced inflammation in high-fat diet-induced obesity and diabetes in mice", Diabetes, 2008, vol. 57: pp. 1470-1481.
Cani, et al., "Improvement of glucose tolerance and hepatic insulin sensitivity by oligofructose requires a functional glucagon-like peptide 1 receptor", Diabetes, 2006, vol. 55: pp. 1484-1490.
Cani, et al., "Metabolic endotoxemia initiates obesity and insulin resistance", Diabetes, 2007, vol. 56: pp. 1761-1772.
Cani, et al., "Selective increases of bifidobacteria in gut microflora improve high-fat-diet-induced diabetes in mice through a mechanism associated with endotoxaemia", Diabetologica, 2007, vol. 50: pp. 2374-2383.
Carbonero, et al., "Microbial pathways in colonic sulfur metabolism and links with health and disease", Frontiers in Immunology, Nov. 28, 2012, vol. 3, Article 448: pp. 1-11.
Chambers, et al., "Effects of targeted delivery of propionate to the human colon on appetite regulation, body weight maintenance and adiposity in overweight adults", Gut, 2015, vol. 64: pp. 1744-1754.
Chanclud, et al., "Plant hormones: key players in gut microbiota and human diseases?", Trends Plant Sci, 2017, vol. 22, No. 9: 754-758.
Charbonneau, et al., "Sialylated Milk Oligosaccharides Promote Microbiota-Dependent Growth in Models of Infant Undernutrition", Cell, Feb. 25, 2016, vol. 164, pp. 859-871.
Chaudhury, et al., "Clinical Review of Antidiabetic Drugs: Implications for Type 2 Diabetes Mellitus Management", Front Endocrinol, 2017, vol. 8, No. 6: pp. 1-12.
Chelliah, et al., "Evaluation of antimicrobial activity and probiotic properties of wild-strain Pichia kudriavzevii isolated from frozen idli batter", Yeast, 2016, vol. 33, pp. 385-401.
Chen, et al., "Estrogen and Microbiota Crosstalk: Should We Pay Attention?", Trends in Endocrinology & Metabolism, Nov. 2016, vol. 27, No. 11, pp. 752-755.
Chen, et al., "Metabolism of Fructooligosaccharides in Lactobacillus plantarum ST-III via Differential Gene Transcription and Alteration of Cell Membrane Fluidity", Appl Environ Microbiol, 2015, vol. 81, No. 22: pp. 7697-7707.
Chiang, et al., "Antiosteoporotic Effects of Lactobacillus-Fermented Soy Skim Milk on Bone Mineral Density and the Microstructure of Femoral Bone in Ovariectomized Mice", Journal of Agricultural and Food Chemistry, 2011, vol. 59: pp. 7734-7742.
Choi, et al., "Difference in the Gut Microbiome between Ovariectomy-Induced Obesity and Diet-Induced Obesity", J. Microbiol. Biotechnol, Dec. 28, 2017, vol. 27, No. 12: pp. 2228-2236.
Cockburn, et al., "Polysaccharide Degradation by the Intestinal Microbiota and Its Influence on Human Health and Disease", J Mol Biol, 2016, vol. 428, pp. 3230-3252.
Codella, et al., "Exercise has the guts: how physical activity may positively modulate gut microbiota in chronic and immune-based diseases", Digest Liv Dis, 2018, vol. 50: pp. 331-341.
Collins, et al., "Beneficial effects of Lactobacillus reuteri 6475 on bone density in male mice is dependent on lymphocytes", Scientific Reports, 2019, vol. 9: pp. 1-17.
Correa, et al., "Regulation of immune cell function by short-chain fatty acids", Clinical & Translational Immunology, 2016, vol. 5, pp. 1-8.
Cosman, et al., "Clinician's Guide to Prevention and Treatment of Osteoporosis", 2014, vol. 25, pp. 2359-2381.
Cowardin, et al., "Mechanisms by which sialylated milk oligosaccharides impact bone biology in a gnotobiotic mouse model of infant undernutrition", PNAS, Jun. 11, 2019, vol. 116, No. 24: pp. 11988-11996.
Cowardin, et al., "Supplementary Information for: Mechanisms by which sialylated milk oligosaccharides impact bone biology in a gnotobiotic mouse model of infant undernutrition", PNAS, www.pnas.org/cgi/doi/10.1073/pnas.1821770116.
Cox, et al., "SolexaQA: At-a-glance quality assessment of Illumina second-generation sequencing data", BMC Bioinformatics, 2010, vol. 11, No. 485: pp. 1-6.
Coyle, et al., "Metformin as an adjuvant treatment for cancer: a systematic review and meta analysis", Ann Onc, 2016, vol. 27, pp. 2184-2195.
Cristofori, et al., "Anti-Inflammatory and Immunomodulatory Effects of Probiotics in Gut Inflammation: A Door to the Body", Frontiers of Immunology, Feb. 26, 2021, vol. 12, Article 578386: pp. 1-21.
Dalby, et al., "Dietary Uncoupling of Gut Microbiota and Energy Harvesting from Obesity and Glucose Tolerance in Mice", Cell Reports, 2017, vol. 21 pp. 1521-1533.
Damani, et al., "The Role of Prunes in Modulating Inflammatory Pathways to Improve Bone Health in Postmenopausal Women", Adv Nutr, Oct. 2, 2022, vol. 13, No. 5: pp. 1476-1492.
Dane, et al., "Effect of risedronate on biochemical marker of bone resorption in postmenopausal women with osteoporosis or osteopenia", Gynecological Endocrinology, 2008, vol. 24, No. 4: pp. 207-213.
Dar, et al., "Bacillus clausii inhibits bone loss by skewing Treg-Th17 cell equilibrium in postmenopausal osteoporotic mice model", Nutrition, 2018, vol. 54, pp. 118-128.
Das, et al., "Prevention of Diabetes-A Historical Note", IJHS, 2013, vol. 48, No. 4, pp. 625-642.
David, et al., "Diet rapidly and reproducibly alters the human gut microbiome", Nature, 2014, vol. 505, pp. 559-563.
Davies, et al., "Effect of Oral Semaglutide Compared With Placebo and Subcutaneous Semaglutide on Glycemic Control in Patients With Type 2 Diabetes", JAMA, 2017, vol. 318, No. 15: pp. 1460-1470.
De Jesus Raposo, et al., "Emergent Sources of prebiotics: seaweed and microalgae", Mar. Drugs, 2016, vol. 14, No. 2: doi: 10.3390/md14020027.

(56) References Cited

OTHER PUBLICATIONS

De La Cuesta-Zuluaga, et al., "Metformin Is Associated With Higher Relative Abundance of Mucin-Degrading Akkermansia muciniphila and Several Short-Chain Fatty Acid-Producig Microbiota in the Gut", Diabetes Care, 2017, vol. 40: pp. 54-62.
De Vadder, et al., "Microbiota-Produced Succinate Improves Glucose Homeostasis via Intestinal Gluconeogenesis", Cell Metab, 2016, vol. 24: pp. 151-157.
Deehan, et al., "Precision Microbiome Modulation with Discrete Dietary Fiber Structures Directs Short-Chain Fatty Acid Production", Cell Host & Microbe, Mar. 11, 2020, vol. 27: pp. 1-16.
Delzenne, et al., "Gut microorganisms as promising targets for the management of type 2 diabetes", Diabetalogia, 2015, vol. 58: pp. 2206-2217.
Derrien, et al., "Fate, activity, and impact of ingested bacteria within the human gut microbiota", Trends in Microbiol, 2015, vol. 23, No. 6: pp. 354-366.
Devaraj, et al., "The Human Gut Microbiome and Body Metabolism: Implications for Obesity and Diabetes", Clin Chem, 2013, vol. 59, No. 4: pp. 617-628.
Di Francesco, et al., "A time to fast", Science, 2018, vol. 362: pp. 770-775.
Ding, et al., "The regulation of immune cells by Lactobacilli: a potential therapeutic target for anti-atherosclerosis therapy", Oncotarget, 2017, vol. 8, No. 35: pp. 59915-59928.
Drew, et al., "Reseeding the gut", Nature, 2016, 540:s109-s112.
Duncan, et al., "Contribution of acetate to butyrate formation by human faecal bacteria", Br J Nutr, 2004, vol. 91: pp. 915-923.
Duong-Ly, et al., "T cell activation triggers reversible inosine-5'-monophosphate dehydrogenase assembly", Journal of Cell Science, 2018, vol. 131: pp. 1-8.
Easson, et al., "Food safety assessment and toxicity study of the synbiotic consortium SBD111", Food and Chemical Toxicology, Oct. 2022, vol. 168, Article 113329: pp. 1-14.
Eastell, et al., "Use of bone turnover markers in postmenopausal osteoporosis", Lancet Diabetes Endocrinol 2017, vol. 5: pp. 908-923.
Edgar, "Updating the 97% identity threshold for 16S ribosomal RNA OTUs." *Bioinformatics* 34, No. 14 (2018): 2371-2375.
Elzinga, et al., "The Use of Defined Microbial Communities To Model Host-Microbe Interactions in the Human Gut", Microbiology and Molecular Biology Reviews, Jun. 2019, vol. 83, No. 2: pp. 1-40.
Engelke, et al., "Clinical Use of Quantitative Computed Tomography (QCT) of the Hip in the Management of Osteoporosis in Adults: the 2015 ISCD Official Positions—Part I", Journal of Clinical Densitometry: Assessment & Management of Musculoskeletal Health, 2015, vol. 18, No. 3: pp. 338-358.
Engelke, et al., "Clinical Use of Quantitative Computed Tomography and Peripheral Quantitative Computed Tomography in the Management of Osteoporosis in Adults: The 2007 ISCD Official Positions", Journal of Clinical Densitometry, 2008, vol. 11, No. 1: pp. 123-162.
Engelke, et al., "Regional distribution of spine and hip QCT BMD responses after one year of once-monthly ibandronate in postmenopausal osteoporosis", Bone, 2010, vol. 46: pp. 1626-1632.
Ericsson, et al., "Variable Colonization after Reciprocal Fecal Microbiota Transfer between Mice with Low and High Richness Microbiota", Front Microbiol, 2017, vol. 8, No. 196: pp. 1-13.
Everard, et al., "Cross-talk between Akkermansia muciniphila and intestinal epithelium controls diet-induced obesity", PNAS, 2013, vol. 11, No. 22: pp. 9066-9071.
Everard, et al., "Diabetes, obesity and gut microbiota", Best Pract Res Clin Gastroenterol, 2013, vol. 27: pp. 73-83.
Everard, et al., "Microbiome of prebiotic-treated mice reveals novel targets involved in host response during obesity", ISME, 2014, vol. 8: pp. 2116-2130.
Fairbanks, et al., "Importance of Ribonucleotide Availability to ProliferatingT-lymphocytes from Healthy Humans", The Journal of Biological Chemistry, 1995, vol. 270, No. 50; pp. 29682-29689.
Famouri, et al., "Effects of Probiotics on Nonalcoholic Fatty Liver Disease in Obese Children and Adolescents", JPGN, 2017, vol. 64, No. 3: pp. 413-417.
Fang, et al., "Intestinal FXR agonism promotes adipose tissue browning and reduces obesity and insulin resistance", Nature, 2015, vol. 21, No. 2: pp. 159-167.
Fletcher, et al., "Shifts in the Gut Metabolome and *Clostridium difficile* Transcriptome throughout Colonization and Infection in a Mouse Model", mSphere, Mar. 2018, vol. 3, No. 2: pp. 1-18.
Flores, et al., "Fecal microbial determinants of fecal and systemic estrogens and estrogen metabolites: a cross-sectional study", Journal of Translational Medicine, Dec. 21, 2012, vol. 10, No. 253: pp. 1-11.
Forslund, et al.(2015) Disentangling type 2 diabetes and metformin treatment signatures in the human gut microbiota. Nature 528(7581): 262-266.
Forslund, et al., "Corrigendum: Disentangling type 2 diabetes and metformin treatment signatures in the human gut microbiota", Nature, 2015, vol. 528, No. 7581: pp. 262-266.
Franzosa, et al., "Species-level functional profiling of metagenomes and metatranscriptomes", Nature Methods, Nov. 2018, vol. 15, pp. 962-968.
Frost, et al., "The short-chain fatty acid acetate reduces appetite via a central homeostatic mechanism", Nat Commun, 2014, vol. 5, No. 3611: pp. 1-11.
Gad, et al., "Anti-aging effects of L-arginine", Journal of Advanced Research, 2010, vol. 1: pp. 169-177.
Gagnon, et al., "Bone Health After Bariatric Surgery", JBMR Plus, 2017, vol. 2: pp. 1-13.
Garidou, et al., "The Gut Microbiota Regulates Intestinal CD4 T Cells Expressing RORγt and Controls Metabolic Disease", Cell Metab, 2015, vol. 22: pp. 100-112.
Gehrig, et al., "Effects of microbiota-directed foods in gnotobiotic animals and undernourished children", Science, Jul. 12, 2019, vol. 365, No. 139: pp. 1-12.
Gehrig, et al., "Supplementary Material for: Effects of microbiota-directed foods in gnotobiotic animals and undernourished children", Science, Jul. 12, 2019, vol. 365, No. 139: pp. 1-42.
GenBank KC111446.1. Hanseniaspora opuntiae strain JEY269 18S ribosomal RNA gene, partial sequence; internal transcribed spacer 1, 5.8S ribosomal RNA gene, and internal transcribed spacer 2, complete sequence; and 28S ribosomal RNA gene, partial sequence. Jul. 24, 2013 [online]. [Retrieved Dec. 10, 2019]. Retrieved from the internet: < URL: https:/twww.ncbi.nlm.nih.gov/nuccore/KC111446.1/ >. Especially p. 1.
Gentile, et al., "The gut microbiota at the intersection of diet and human health", Science, 2018, vol. 362: pp. 776-780.
Geva-Zatorsky, et al., "Mining the Human Gut for Immunomodulatory Organisms", Cell, Feb. 23, 2017, vol. 168: pp. 928-943.
Gibson, et al., "Dietary modulation of the human colonic microbiota: introducing the concept of prebiotics", J Nutr, 1995, vol. 125, No. 6: pp. 1401-1412.
Gilbert, et al., "Current understanding of the human microbiome", Nature Medicine, Apr. 2018, vol. 24, No. 4: pp. 392-400.
Gold, et al., "Longitudinal Analysis of the Association Between Vasomotor Symptoms and Race/Ethnicity Across the Menopausal Transition: Study of Women's Health Across the Nation", American Journal of Public Health, Jul. 2006, vol. 96, No. 7: pp. 1226-1235.
Gonzalez-Garcia, et al., "Microbial propionic acid production", Fermentation, 2017, vol. 3, No. 21: pp. 1-20.
Gosalbes, et al., "Metabolic adaptation in the human gut microbiota during pregnancy and the first year of life", EBioMedicine, 2019, vol. 39: pp. 497-509.
Graessler, et al., "Metagenomic sequencing of the human gut microbiome before and after bariatric surgery in obese patients with type 2 diabetes: correlation with inflammatory and metabolic parameters", Pharmacogenetics J, 2013, vol. 13: pp. 514-522.
Greenblatt, et al., "Bone Turnover Markers in the Diagnosis and Monitoring of Metabolic Bone Disease", Clinical Chemistry, 2017, vol. 63, No. 2: pp. 464-474.
Greenspan, et al., "Early Changes in Biochemical Markers of Bone Turnover Predict the Long-Term Response to Alendronate Therapy

(56) References Cited

OTHER PUBLICATIONS in Representative Elderly Women: A Randomized Clinical Trial", Journal of Bone and Mineral Research, 1998, vol. 13, No. 9: pp. 1431-1438.

Grey, et al., "Duration of Antiresorptive Effects of Low-Dose Zoledronate in Osteopenic Postmenopausal Women: A Randomized, Placebo-Controlled Trial", Journal of Bone and Mineral Research, Jan. 2014, vol. 29, No. 1: pp. 166-172.

Gu, et al., "Analyses of gut microbiota and plasma bile acids enable stratification of patients for antidiabetic treatment", Nature Commun, 2017, vol. 8: p. 1785.

Gunnarsson, et al., "Potential of Jerusalem artichoke (*Helianthus tuberosus* L.) as a biorefinery crop." *Industrial Crops and Products* 56 (2014): 231-240.

Guo, et al., "Secretions of Bifidobacterium infantis and Lactobacillus acidophilus Protect Intestinal Epithelial Barrier Function", JPGN, 2017, vol. 64, No. 3: pp. 404-412.

Hacquard, et al., "Microbiota and Host Nutrition across Plant and Animal Kingdoms", Cell Host & Microbe, 2015, vol. 17: pp. 603-616.

Harley, et al., "Obesity and the gut microbiome: Striving for causality", Mol Metab, 2012, vol. 1: pp. 21-31.

Heaney, et al., "Dairy and Bone Health", Journal of the American College of Nutrition, 2009, vol. 28, No. 1: pp. 82S-90S.

Hehemann, et al., "Transfer of carbohydrate-active enzymes from marine bacteria to Japanese gut microbiota", Nature, 2010, vol. 464: pp. 908-914.

Heineken, et al., "Systems-level characterization of a host-microbe metabolic symbiosis in the mammalian gut", Gut microbes, 2013, vol. 4, No. 1: pp. 28-40.

Heinemann, et al., "The Menopause Rating Scale (MRS) scale: A methodological review", Health and Quality of Life Outcomes, Sep. 2004, vol. 2, No. 45: pp. 1-8.

Henao-Mejia, et al., "Inflammasome-mediated dysbiosis regulates progression of NAFLD and obesity", Nature, 2012, vol. 482, No. 7384: p. 179-185.

Herr, et al., "The Effects of Serotonin in Immune Cells", Frontiers in Cardiovascular Medicine, Jul. 2017, vol. 4, Article 48: pp. 1-11.

Hess, et al., "Dairy Foods: Current Evidence of their Effects on Bone, Cardiometabolic, Cognitive, and Digestive Health", Comprehensive Reviews in Food Science and Food Safety, 2016, vol. 15: pp. 251-268.

Hildebrandt, et al., "High Fat Diet Determines the Composition of the Murine Gut Microbiome Independently of Obesity", Gastroenterology, 2009, vol. 137, No. 5: p. 1716.

Holmes, et al., "Diet-Microbiome Interactions in Health Are Controlled by Intestinal Nitrogen Source Constraints", Cell Metab, 2017, vol. 25: pp. 140-151.

Hooper, et al., "Interactions Between the Microbiota and the Immune System", Science, 2012, vol. 336, No. 6086: pp. 1268-1273.

Hugenholtz, et al., "Mouse models for human intestinal microbiota research: a critical evaluation", Cellular and Molecular Life Sciences, 2018, vol. 75: pp. 149-160.

Ibanez, et al., "Gut microbiome and bone", Joint Bone Spine, 2019, vol. 86: pp. 43-47.

Ilhan, et al., (2017) "Distinctive microbiomes and metabolites linked with weight loss after gastric bypass, but not gastric banding", ISME J 11(9): 2047-2058.

Imaoka, et al., "Anti-inflammatory activity of probiotic Bifidobacterium: enhancement of IL-10 production in peripheral blood mononuclear cells from ulcerative colitis patients and inhibition of IL-8 secretion in HT-29 cells", World J Gastroenterol, 2008, vol. 14, No. 16: pp. 2511-2516.

Imlay, et al., "Diagnosing oxidative stress in bacteria: not as easy as you might think", Current Opinion in Microbiology, 2015, vol. 24: pp. 124-131.

Iwami, et al., "Effects of Short Chain Fatty Acid, Sodium Butyrate, on Osteoblastic Cells and Osteoclastic Cells", Int. J. Biochem., 1993, vol. 25, No. 11: pp. 1631-1635.

Jackson, et al., "Culture dependent and independent analysis of bacterial communities associated with commercial salad leaf vegetables", BMC Microbiol, 2013, vol. 13, No. 274: pp. 1-12.

Jackson, et al., "Emerging Perspectives on the Natural Microbiome of Fresh Produce Vegetables", Agriculture, 2015, vol. 5: pp. 170-187.

Jafarnejad, et al., "Effects of a Multispecies Probiotic Supplement on Bone Health in Osteopenic Postmenopausal Women: A Randomized, Double-blind, Controlled Trial", Journal of the American College of Nutrition, 2017, vol. 36, No. 7: pp. 497-506.

Jahangir, et al., "Type 2 Diabetes Current and Future Medications: A Short Review", Int J Pharm Pharmacol, 2017, vol. 1, No. 1: p. 101.

Jain, et al., "High throughput ANI analysis of 90K prokaryotic genomes reveals clear species boundaries", Nature Communications, 2018, vol. 9, No. 5114: pp. 1-8.

Jain, et al., "Nanopore sequencing and assembly of a human genome with ultra-long reads", Nature Biotechnology, 2018, vol. 36, No. 4: p. 338.

Jansson, et al., "Probiotic treatment using a mix of three *Lactobacillus* strains for lumbar spine bone loss in postmenopausal women: a randomised, double-blind, placebo-controlled, multicentre trial", Lancet Rheumatol, Nov. 2019, vol. 1: e154-62.

Jarvis, et al., "Microbiomes Associated With Foods From Plant and Animal Sources", Front Microbiol, 2018, vol. 9: p. 2540.

Jennings, et al., "Amino Acid Intakes Are Associated With Bone Mineral Density and Prevalence of Low Bone Mass in Women: Evidence From Discordant Monozygotic Twins", Journal of Bone and Mineral Research, Feb. 2016, vol. 31, No. 2: pp. 326-335.

Jia, et al., "CARD 2017: expansion and model-centric curation of the comprehensive antibiotic resistance database", Nucleic Acids Res, 2017, No. 45: p. D566-D573.

Kaluzna-Czaplinska, et al., "Is there a relationship between intestinal microbiota, dietary compounds, and obesity?", Trends Food Sci Technol, 2017, vol. 70: p. 105-113.

Kapitza, et al., "Effects of semaglutide on beta cell function and glycaemic control in participants with type 2 diabetes: a randomized, double-blind, placebo-controlled trial", Diabetalogia, 2017, vol. 60: pp. 1390-1399.

Kaplan, et al., "Fermentation of Fructooligosaccharides by Lactic Acid Bacteria and Bifidobacterial", Appl Environ Microbiol, 2000, vol. 66, No. 6: pp. 2682-2684.

Kasubuchi, et al., "Dietary Gut Microbial Metabolites, Short-chain Fatty Acids, and Host Metabolic Regulation", Nutrients, 2015, vol. 7: pp. 2839-2849.

Kau, et al., "Human nutrition, the gut microbiome and the immune system", Nature, 2011, vol. 474: pp. 327-336.

Kellgren, et al., "Radiological Assessment of Osteo-Arthrosis", Ann. Rheum. Dis., Dec. 1957, vol. 16, No. 4: pp. 494-502.

Kim, et al., "Immune regulation by microbiome metabolites", Immunology, 2018, vol. 154, pp. 220-229.

Kim, et al., "Impact of L-Arginine Metabolism on Immune Response and Anticancer Immunotherapy", Frontiers in Oncology, Mar. 2018, vol. 8, No. 67: pp. 1-5.

Kimura, et al., "The gut microbiota suppresses insulin-mediated fat accumulation via the short-chain fatty acid receptor GPR43", Nat Commun, 2013, vol. 4, No. 1829: pp. 1-12.

King, et al., "Regulation of de novo purine synthesis in human bone marrow mononuclear cells by hypoxanthine.", The Journal of Clinical Investigation, 1983;72(3):965-970.

Kishida, et al., "Effect of miglitol on the suppression of nonalcoholic steatohepatitis development and improvement of the gut environment in a rodent model", J Gastroenterol, 2017, vol. 52, No. 11: pp. 1180-1191.

Koh, et al., "From Dietary Fiber to Host Physiology: Short Chain Fatty Acids as Key Bacterial Metabolites", Cell, 2016, vol. 165: pp. 1332-1345.

Kreznar, et al., "Host Genotype and Gut Microbiome Modulate Insulin Secretion and Diet-Induced Metabolic Phenotypes", Cell Rep, 2017, vol. 18: pp. 1739-1750.

Kuo, et al., "Bone biomarker for the clinical assessment of osteoporosis: recent developments and future perspectives", Biomarker Research, 2017, vol. 5, No. 18: pp. 1-9.

(56) References Cited

OTHER PUBLICATIONS

König, et al., "Specific Collagen Peptides Improve Bone Mineral Density and Bone Markers in Postmenopausal Women—A Randomized Controlled Study", Nutrients, 2018, vol. 10. No, 97: pp. 1-11.
Lambert, et al., "Combined bioavailable isoflavones and probiotics improve bone status and estrogen metabolism in postmenopausal osteopenic women: a randomized controlled trial", Am J Clin Nutr, 2017, vol. 106: pp. 909-920.
Lambert, et al., "Combined Red Clover isoflavones and probiotics potently reduce menopausal vasomotor symptoms", PLOS One, Jun. 7, 2017, vol. 12, No. 6: pp. 1-16.
Lang, et al., "The microbes we eat: abundance and taxonomy of microbes consumed in a day's worth of meals for three diet types", PeerJ, 2014, 2:e659; doi 10.7717/peerj.659.
Langmead, at al., "Fast gapped-read alignment with Bowtie 2", Nat Methods, 2012, vol. 9, No. 4: pp. 357-359.
Lawenius, et al., "A probiotic mix partially protects against castration-induced bone loss in male mice", Journal of Endocrinology, Jun. 2022, vol. 254, No. 2: pp. 91-101.
Lawenius, et al., "Development of a synbiotic that protects against ovariectomy-induced trabecular bone loss", Am J Physiol Endocrinol Metab., Apr. 1, 2022, vol. 322, No. 4: pp. E344-E354.
Lee, et al., "Blueberry Supplementation Influences the Gut Microbiota, Inflammation, and Insulin Resistance in High-Fat-Diet-Fed Rats", J Nutr, 2018, vol. 148, No. 2: pp. 209-219.
Lee, et al., "Effect of Enterotoxigenic Escherichia coli on Microbial Communities during Kimchi Fermentation", J. Microbiol. Biotechnol., Nov. 2021, vol. 31, No. 11: pp. 1552-1558.
Lee, et al., "Effect of Metformin on Metabolic Improvement and Gut Microbiota", Appl Environ Microbiol, 2014, vol. 80, No. 19: p. 59355943.
Lee, et al., "Gut microbiota-generated metabolites in animal health and disease", Nat Chem Biol, 2014, vol. 10: pp. 416-424.
Lewiecki, et al., "Once-Monthly Oral Ibandronate Improves Biomechanical Determinants of Bone Strength in Women with Postmenopausal Osteoporosis", J Clin Endocrinol Metab, Jan. 2009, vol. 94, No. 1: pp. 171-180.
Ley, et al., "Obesity alters gut microbial ecology", PNAS, 2005, vol. 102, No. 31: pp. 11070-11075.
Li, et al., "Butyrate reduces appetite and activates brown adipose tissue via the gut-brain neural circuit", Gut, 2017: pp. 1-11.
Li, et al., "Intermittent Fasting Promotes White Adipose Browning and Decreases Obesity by Shaping the Gut Microbiota", Cell Metab, 2017, vol. 26: pp. 672-685.
Li, et al., "Metabolic Surgery Profoundly Influences Gut Microbial-Host Metabolic Crosstalk", Gut, 2011, vol. 60, No. 9: pp. 1214-1223.
Li, et al., "Microbial osteoporosis: The interplay between the gut microbiota and bones via host metabolism and immunity", MicrobiologyOpen, 2019: pp. 1-15.
Li, et al., "Pro-and anti-inflammatory effects of short chain fatty acids on immune and endothelial cells." *European journal of pharmacology* 831 (2018): 52-59.
Li, et al., "Sex steroid deficiency-associated bone loss is microbiota dependent and prevented by probiotics", The Journal of Clinical Investigation, Jun. 2016, vol. 126, No. 6: pp. 2049-2063.
Lim, et al., "The Effect of Lactobacillus acidophilus YT1(MENOLACTO) on Improving Menopausal Symptoms: A Randomized, Double-Blinded, Placebo-Controlled Clinical Trial", Journal of Clinical Medicine, Jul. 9, 2020, vol. 9, No. 7, Article 2173: pp. 1-16.
Lin, et al., "Butyrate and propionate protect against diet-induced obesity and regulate gut hormones via free fatty acid receptor 3-independent mechanisms", PLoS One, 2012, vol. 7, No. 4: pp. 1-9.
Liu, et al., "The relationship between menopausal syndrome and gut microbes", BMC Women's Health, Nov. 2022, vol. 22, Article 437: pp. 1-11.

Liu, et al., "VFDB 2019: a comparative pathogenomic platform with an interactive web interface", Nucleic Acids Res, 2019, vol. 47: D687-D692.
Louis, et al., "Formation of propionate and butyrate by the human colonic microbiota", Environ Microbiol, 2017, vol. 19, No. 1: pp. 29-41.
Lu, et al., "Short Chain Fatty Acids Prevent High-fat-diet-induced Obesity in Mice by Regulating G Protein-coupled Receptors and Gut Microbiota", Sci Rep, 2016, vol. 6, No. 37589: pp. 1-13.
Lucas, et al., "Short-chain fatty acids regulate systemic bone mass and protect from pathological bone loss", Nature Communications, 2018, vol. 9, No. 55: pp. 1-10.
Lyu, et al., "Balancing Herbal Medicine and Functional Food for Prevention and Treatment of Cardiometabolic Diseases through Modulating Gut Microbiota", Front Microbiol, 2017, vol. 8, No. 2146: pp. 1-21.
Madiraju, et al., "Metformin suppresses gluconeogenesis by inhibiting mitochondrial glycerophosphate dehydrogenase", Nature, 2014, vol. 510: pp. 542-546.
Magnusdottir, et al., "Generation of genome-scale metabolic reconstructions for 773 members of the human gut microbiota", Nature Biotechnology, Jan. 2017, vol. 35, No. 1: pp. 81-89.
Maier, et al., Extensive impact of non-antibiotic drugs on human gut bacteria, Nature, 2018: pp. 1-6.
Martinez-Lopez, et al., "System-wide Benefits of Intermeal Fasting by Autophagy", Cell Metab, 2017, vol. 26: pp. 856-871.
McCabe, et al., "Exercise prevents high fat diet induced bone loss, marrow adiposity and dysbiosis in male mice", Bone, 2018: https://doi.org/10.1016/j.bone.2018.03.024.
McCabe, et al., "Prebiotic and Probiotic Regulation of Bone Health: Role of the Intestine and its Microbiome", Curr Osteoporosis Rep., Dec. 2015, vol. 13, No. 6: pp. 636-371.
Meng, et al., "Anti-inflammatory effects of *Bifidobacterium longum* subsp *infantis* secretions on fetal human enterocytes are mediated by TLR-4 receptors", Am J Physiol Gastrointest Liver Physiol, 2016, vol. 311:G744-G753.
Milajerdi, et al., "The effect of probiotics on inflammatory biomarkers: a meta-analysis of randomized clinical trials", European Journal of Nutrition, Mar. 11, 2020, vol. 59, No. 2: pp. 633-649.
Milani, et al., "Bifidobacteria exhibit social behavior through carbohydrate resource sharing in the gut", Sci Rep, 2015, vol. 5, No. 15782: pp. 1-14.
Montandon, et al., "Effects of Antidiabetic Drugs on Gut Microbiota Composition", Genes, 2017, vol. 8, No. 250: pp. 1-12.
Morishita, et al., "Production of menaquinones by lactic acid bacteria." Journal of dairy science 82, No. 9 (1999): 1897-1903.
Moriwake, et al., "Delphinidin, One of the Major Anthocyanidins, Prevents Bone Loss through the Inhibition of Excessive Osteoclastogenesis in Osteoporosis Model Mice", PLoS One, May 2014, vol. 9, No. 5: pp. 1-11.
Morrison, et al., "Formation of short chain fatty acids by the gut microbiota and their impact on human metabolism", Gut Microbes, 2016, vol. 7, No. 3: pp. 189-200.
Moslehi-Jenabian, et al., "Beneficial Effects of Probiotic and Food Borne Yeasts on Human Health", Nutrients, 2010, vol. 2: pp. 449-473.
Muller, et al., "The Plant Microbiota: Systems-Level Insights and Perspectives", The Annual Review of Genetics, 2016, vol. 50: pp. 211-234.
Munder, et al., "Arginase: an emerging key player in the mammalian immune system", British Journal of Pharmacology, 2009, vol. 158: pp. 638-651.
Myneni, et al., "Regulation of bone remodeling by vitamin K2", Oral Diseases, 2017, vol. 23 pp. 1021-1028.
Napolitano, et al., "Novel Gut-Based Pharmacology of Metformin in Patients with Type 2 Diabetes Mellitus", PLoS One, 2014, vol. 9, No. 7: e100778.
Naylor, et al., "Response of bone turnover markers to three oral bisphosphonatetherapies in postmenopausal osteoporosis: the TRIO study", Osteoporos Int, 2016, vol. 27: pp. 21-31.
Needleman, et al., "A General Method Applicable to the Search for Similarities in the Amino Acid Sequence of Two Proteins", J. Mol. Biol., Mar. 1970, vol. 48: pp. 443-453.

(56) References Cited

OTHER PUBLICATIONS

Nguyen, et al., "A perspective on 16S rRNA operational taxonomic unit clustering using sequence similarity." NPJ biofilms and microbiomes 2, No. 1 (2016): 1-8.
Ni, et al., "A Molecular-Level Landscape of Diet-Gut Microbiome Interactions: Toward Dietary Interventions Targeting Bacterial Genes", mBio, 2015, vol. 6, No. 6: e01263-15.
Nilsson, et al., "Lactobacillus reuteri reduces bone loss in older women with low bone mineral density: a randomized, placebo-controlled, double-blind, clinical trial", The Journal of Internal Medicine, 2018, vol. 284: pp. 307-317.
Ohlsson, et al., "Mild stimulatory effect of a probiotic mix on bone mass when treatment is initiated 1.5 weeks after ovariectomy in mice", Am J Physiol Endocrinol Metab., Feb. 1, 2021, vol. 320: pp. 591-E597.
Ohlsson, et al., "Probiotics Protect Mice from Ovariectomy-Induced Cortical Bone Loss", PLOS One, Mar. 2014, vol. 9, No. 3: pp. 1-8.
Okeke, et al., "The Role of the Gut Microbiome in the Pathogenesis and Treatment of Obesity", GAHMJ, 2014, vol. 3, No. 3: pp. 44-57.
Olar, et al., "Prospects for new antimicrobials based on N,N-dimethylbiguanide complexes as effective agents on both planktonic and adhered strains", Eur J Med Chem, 2010, vol. 45: pp. 2868-2875.
Olson, et al., "Obesity and the tumor microenvironment", Science, 2017, vol. 358, No. 6367: pp. 1130-1131.
Ozaki, et al., "The L-type amino acid transporter LAT1 inhibits osteoclastogenesis and maintains bone homeostasis through the mTORC1 pathway", Science Signaling, Jul. 9, 2019, vol. 12: pp. 1-14.
Ozcan, et al., "A Human Gut Commensal Ferments Cranberry Carbohydrates To Produce Formate", Appl Environ Microbiol, 2017, vol. 83, No. 17, pp. 1-16.
Pacifici, et al., "Bone Remodeling and the Microbiome", Cold Spring Harb Perspect Med, 2018, vol. 8, pp. 1-20.
Pacifici, et al., "T cells: Critical bone regulators in health and disease", Bone, 2010, vol. 47, pp. 461-471.
Palacios, et al., "The effect of a novel probiotic on metabolic biomarkers in adults with prediabetes and recently diagnosed type 2 diabetes mellitus: study protocol for a randomized controlled trial", Trials, 2017, vol. 18, No. 7: pp. 1-8.
Pan, et al., "A single bacterium restores the microbiome dysbiosis to protect bones from destruction in a rat model of rheumatoid arthritis", Microbiome, 2019, vol. 7, No. 107: pp. 1-11.
Pandiyan, et al., "Microbiome Dependent Regulation of Treg and Th17 Cells in Mucosa", Frontiers in Immunology, Mar. 8, 2019, vol. 10, Article 426: pp. 1-17.
Parekh, et al., "The role and influence of gut microbiota in pathogenesis and management of obesity and metabolic syndrome", Front Endocrinol, 2014, vol. 5, No. 47: pp. 1-7.
Patnode, et al., "Interspecies Competition Impacts Targeted Manipulation of Human Gut Bacteria by Fiber-Derived Glycans", Cell, Sep. 19, 2019, vol. 159: pp. 59-73.
PCT/US2019/049823—International Search Report and Written Opinion, Feb. 20, 2020, 12 pages.
PCT/US2019/049823—Invitation to Pay Additional Fees, Dec. 10, 2019, 2 pages.
PCT/US2020/038830—International Search Report and Written Opinion, Dec. 16, 2020, 23 pages.
PCT/US2020/038830—Invitation to Pay Additional Fees, Oct. 29, 2020, 24 pages.
Pearson, et al., "Improved tools for biological sequence comparison", Proc. Natl. Acad. Sci. USA, Apr. 1988, vol. 85: pp. 2444-2448.
Perry, et al., "Acetate mediates a microbiome-brain-β-cell axis to promote metabolic syndrome", Nature, 2016, vol. 534: pp. 213-217.
Plovier, et al., "A purified membrane protein from Akkermansia muciniphila or the pasteurized bacterium improves metabolism in obese and diabetic mice", Nat. Med., 2017, vol. 23, No. 1: pp. 107-113.
Postler, et al., "Understanding the Holobiont: How Microbial Metabolites Affect Human Health and Shape the Immune System", Cell, 2017, vol. 26: pp. 110-130.
Psichas, et al., "The short chain fatty acid propionate stimulates GLP-1 and PYY secretion via free fatty acid receptor 2 in rodents", Int J Obes, 2015, vol. 39: pp. 424-429.
Puertollano, et al., "Biological significance of short-chain fatty acid metabolism by the intestinal microbiome", Curr Opin Clin Nutr Metab Care, 2014, vol. 17, No. 2: pp. 139-144.
Pyra, et al., "Prebiotic Fiber Increases Hepatic Acetyl CoA Carboxylase Phosphorylation and Suppresses Glucose-Dependent Insulinotropic Polypeptide Secretion More Effectively When Used with Metformin in Obese Rats", J Nutr, 2012, vol. 142, No. 2: pp. 213-220.
Qin, et al., "A human gut microbial gene catalogue established by metagenomic sequencing", Nature, 2010, vol. 464: pp. 59-65.
Quach, et al., "Characterizing how probiotic Lactobacillus reuteri 6475 and lactobacillic acid mediate suppression of osteoclast differentiation", Bone Reports, 2019, vol. 11, pp. 1-14.
Raisz, et al., "Short-Term Risedronate Treatment in Postmenopausal Women: Effects on Biochemical Markers of Bone Turnover", Osteoporosis International, 2000, vol. 11: pp. 615-620.
Ramirez-Puebla, et al., "Gut and Root Microbiota Commonalities", App Environ Microbiol, 2013, vol. 79, No. 1: pp. 2-9.
Rastall, et al., "Recent developments in prebiotics to selectively impact beneficial microbes and promote intestinal health", Curr Opin Biotechnol, 2015, vol. 32, pp. 42-46.
Rastogi, et al., "Leaf microbiota in an agroecosystem: spatiotemporal variation in bacterial community composition on field-grown lettuce", ISME J, 2012, vol. 6: pp. 1812-1822.
Ravussin, et al., "Responses of Gut Microbiota to Diet Composition and Weight Loss in Lean and Obese Mice", Obesity, 2012, vol. 20, No. 4: pp. 738-747.
Reichardt, et al., "Phylogenetic distribution of three pathways for propionate production within the human gut microbiota", ISME J, 2014, vol. 8: pp. 1323-1335.
Reichold, et al., "Bifidobacterium adolescentis protects from the development of nonalcoholic steatohepatitis in a mouse model", J Nutr Biochem, 2014, vol. 25: pp. 118-125.
Rendina, et al., "Dried Plum's Unique Capacity to Reverse Bone Loss and Alter Bone Metabolism in Postmenopausal Osteoporosis Model", PLoS One, Mar. 2013, vol. 8, No. 3: pp. 1-10.
Rios-Covain, et al., "Enhanced butyrate formation by cross-feeding between Faecalibacterium prausnitzii and Bifidobacterium adolescentis", FEMS Microbiol Lett, 2015, vol. 362, No. 21: pp. 1-7.
Rodriguez-R, et al., "The enveomics collection: a toolbox for specialized analyses of microbial genomes and metagenomes", PeerJ Preprints, 2016, vol. 4: e1900v1.
Rosales-Bravo, et al., "Novel consortium of Klebsiella variicola and Lactobacillus species enhances the functional potential of fermented dairy products by increasing the availability of branched-chain amino acids and the amount of distinctive volatiles." Journal of applied microbiology 123, No. 5 (2017): 1237-1250.
Rosario, et al., "Understanding the Representative Gut Microbiota Dysbiosis in Metformin-Treated Type 2 Diabetes Patients Using Genome-Scale Metabolic Modeling", Front Physiol, 2018, vol. 9: p. 775.
Rosen, et al., "Treatment With Once-Weekly Alendronate 70 mg Compared With Once-Weekly Risedronate 35 mg in Women With Postmenopausal Osteoporosis: A Randomized Double-Blind Study", Journal of Bone and Mineral Research, 2005, vol. 20, No. 1: pp. 141-151.
Rosenbaum, et al., "The gut microbiota in human energy homeostasis and obesity", Trends Endocrinol Metab, 2015, vol. 26, No. 9: pp. 493-501.
Rosenberg, et al., "Interaction between the Microbiome and Diet: The Hologenome Concept", J Nutr Food Sci, 2016, vol. 6, No. 5: p. 1000545.
Rosenblatt, et al., "Is It Ethical to Conduct Placebo-Controlled Clinical Trials in the Development of New Agents for Osteoporosis? An Industry Perspective", Journal of Bone and Mineral Research, 2003, vol. 18, No. 6: pp. 1142-1145.

(56) References Cited

OTHER PUBLICATIONS

Rothschild, et al., "Environment dominates over host genetics in shaping human gut microbiota", Nature, 2018: pp. 1-6.
Round, et al., "The gut microbiota shapes intestinal immune responses during health and disease", Nat Rev Immunol, 2009, vol. 9: pp. 313-324.
Saltiel, et al., "Inflammatory mechanisms linking obesity and metabolic disease", J Clin Invest, 2017, vol. 127, No. 1: pp. 1-4.
Saltiel, et al., "New therapeutic approaches for the treatment of obesity", Sci Transl Med, 2016, vol. 8, No. 323: p. 1-12.
Sam, et al., "The Fungal Mycobiome and Its Interaction with Gut Bacteria in the Host", Int J Mol Sci, 2017, vol. 18, No. 330: pp. 1-11.
Samah, et al., "Probiotics for the management of type 2 diabetes mellitus: A systematic review and meta-analysis", Diabetes Res Clin Pract, 2016, vol. 118: pp. 172-182.
Samuel, et al., "A humanized gnotobiotic mouse model of host-archaeal-bacteria mutualism", PNAS, 2006, vol. 103, No. 26: pp. 10011-10016.
Samuel, et al., "Effects of the gut microbiota on host adiposity are modulated by the short-chain fatty-acid binding G protein-coupled receptor, Gpr41", PNAS, 2008, vol. 105, No. 43: pp. 16767-16772.
Santos-Marcos, et al., "Influence of gender and menopausal status on gut microbiota", Maturitas, Oct. 2018, vol. 116: pp. 43-53.
Sarioglu, et al., "Comparison of the effects of alendronate and risedronate on bone mineral density and bone turnover markers in postmenopausal osteoporosis", Rheumatol Int, 2006, vol. 26: pp. 195-200.
Sawin, et al., "Glycomacropeptide is a prebiotic that reduces *Desulfovibrio* bacteria, increases cecal short-chain fatty acids, and is anti-inflammatory in mice", Am J Physiol Gastrointest Liver Physiol, 2015, vol. 309: G590-G601.
Schirmer, et al., "Linking the Human Gut Microbiome to Inflammatory Cytokine Production Capacity", Cell, 2016, vol. 167, No. 4: pp. 1125-1136.
Schoch, C.L. et al., "Nuclear ribosomal internal transcribed spacer (ITS) region as a universal DNA barcode marker for Fungi, " Proceedings of the National Academy of Sciences, 2012, vol. 109, No. 16, pp. 6241-6246.
Schroeder, et al., "Bifidobacteria or Fiber Protects against Diet-Induced Microbiota-Mediated Colonic Mucus Deterioration", Cell Host & Microbe, 2018, vol. 23: pp. 27-40.
Schroeder, et al., "Signals from the gut microbiota to distant organs in physiology and disease", Nat Med, 2016, vol. 22, No. 10: pp. 1079-1089.
Schwarzer, et al., "*Lactobacillus plantarum* strain maintains growth of infant mice during chronic undernutrition", Science, Feb. 19, 2016, vol. 351, No. 6275: pp. 854-857.
Scott, et al., "Manipulating the gut microbiota to maintain health and treat disease", Micro Ecol Health Dis, 2015, vol. 26, No. 25877: pp. 1-10.
Seeman, et al., "Age- and Menopause-Related Bone Loss Compromise Cortical and Trabecular Microstructure", J Gerontol A Biol Sci Med Sci, Oct. 2013, vol. 10: pp. 1218-1225.
Serino, et al., "Metabolic adaptation to a high-fat diet is associated with a change in the gut microbiota", Gut, 2012, vol. 61: pp. 543-553.
Shajib, et al., "Diverse Effects of Gut-Derived Serotonin in Intestinal Inflammation", ACS Chemical Neuroscience, May 2017, vol. 8: pp. 920-931.
Sheikhi, et al., "Probiotic Yogurt Culture Bifidobacterium Animalis Subsp Lactis BB-12 and Lactobacillus Acidophilus LA-5 Modulate the Cytokine Secretion by Peripheral Blood Mononuclear Cells from Patients with Ulcerative Colitis", Drug Res, 2016, vol. 66: pp. 300-305.
Sheth, et al., "Spatial metagenomic characterization of microbial biogeography in the gut", Nature Biotechnology, Aug. 2019, vol. 37, pp. 877-883.
Shin, et al., "An increase in the *Akkermansia* spp population induced by metformin treatment improves glucose homeostasis in diet-induced obese mice", Gut, 2014, vol. 63: pp. 727-735.
Shoaie, et al., "Quantifying Diet-Induced Metabolic Changes of the Human Gut Microbiome", Cell Metab, 2015, vol. 22: pp. 320-331.
Simpson, et al., "Review article: dietary fibre-microbiota interactions", Aliment Pharmacol Ther, 2015, vol. 42: pp. 158-179.
Singer, et al., "The initiation of metabolic inflammation in childhood obesity", J Clin Invest, 2017, vol. 127, No. 1: pp. 65-73.
Singh, et al., "Dysregulated Microbial Fermentation of Soluble Fiber Induces Cholestatic Liver Cancer", Cell, 2018, vol. 175: pp. 679-694.
Sjogren, et al., "The Gut Microbiota Regulates Bone Mass in Mice", Journal of Bone and Mineral Research, Jun. 2012, vol. 27, No. 6: pp. 1357-1367.
Slavin, et al., "Fiber and Prebiotics: Mechanisms and Health Benefits", Nutrients, 2013, vol. 5: pp. 1417-1435.
Smith, et al., "Comparison of Biosequences", Advances in Applied Mathematics 2, 1981: pp. 482-489.
Smith, et al., "Yeast Modulation of Human Dendritic Cell Cytokine Secretion: An In Vitro Study", PLoS One, 2014, vol. 9, No. 5: pp. 1-14.
Solarea Bio, "Managing inflammatory diseases and aging with edible plant microbes", www.nature.com/biopharmdeal, Dec. 2022: pp. B2-B3.
Solarea Bio, Inc., "Food Trial Evaluating the Efficacy of SBD111 Versus Placebo for the Clinical Dietary Management of the Metabolic Processes of Osteopenia", NIH U.S. National Library of Medicine, Last updated Jan. 28, 2022: pp. 1-6. <https://beta.clinicaltrials.gov/study/NCT05009875>.
Sonnenburg, et al., "Diet-microbiota interactions as moderators of human metabolism", Nature, 2016, vol. 535: pp. 56-64.
Strorelli, et al., "Metformin, Microbes, and Aging", Cell Metab, 2013, vol. 17: pp. 809-811.
Stuible, et al., "Mechanism and Function of Monoclonal Antibodies Targeting Siglec-15 for Therapeutic Inhibition of Osteoclastic Bone Resorption*", The Journal of Biological Chemistry, vol. 289, No. 10: pp. 6498-6512.
Stull, et al., "Bioactives in Blueberries Improve Insulin Sensitivity in Obese, Insulin-Resistant Men and Women", J Nutr, 2010, vol. 140, No. 10: pp. 1764-1768.
Stull, et al., "Blueberries' Impact on Insulin Resistance and Glucose Intolerance", Antioxidants, 2016, vol. 5, No. 44: pp. 1-11.
Suez, et al., "Post-Antibiotic Gut Mucosal Microbiome Reconstitution Is Impaired by Probiotics and Improved by Autologous FMT", Cell, 2018, vol. 174: pp. 1406-1423.
Sun, et al., "Gut mirobiota and intestinal FXR mediate the clinical benefits of metformin", Nat Med, 2018, vol. 24: pp. 1919-1929.
Suzek, et al., "UniRef clusters: a comprehensive and scalable alternative for improving sequence similarity searches", Bioinformatics, 2015, vol. 31, No. 6: pp. 926-932.
Sweeney, et al., "Metabolic surgery: action via hormonal milieu changes, changes in bile acids or gut microbiota? A summary of the literature", Best Pract Res Clin Gastroenterol, 2014, vol. 28: pp. 727-740.
Takimoto, et al., "Effect of *Bacillus subtilis* C-3102 on bone mineral density in healthy postmenopausal Japanese women: a randomized, placebo-controlled, double-blind clinical trial", Bioscience of Microbiota, Food and Health, 2018, vol. 37, No. 4: pp. 87-96.
Tan, et al., "The Role of Short-Chain Fatty Acids in Health and Disease", Advances in Immunology, 2014, vol. 121: pp. 91-119.
Terrapon, et al., "How do gut microbes break down dietary fiber?", Trends Biochem Sci, 2014, vol. 39, No. 4: pp. 156-158.
Tilg, et al., "The intestinal microbiota fuelling metabolic inflammation", Nature Reviews, Aug. 6, 2019: pp. 1-15.
Tohidi, et al., "Omentin-1, visfatin and adiponectin levels in relation to bone mineral density in Iranian postmenopausal women", Bone, 2012, vol. 51: pp. 876-881.
Tolhurst, et al., "Short-Chain Fatty Acids Stimulate Glucagon-Like Peptide-1 Secretion via the G-Protein-Coupled Receptor FFAR2", Diabetes, 2012, vol. 61: pp. 364-371.
Truong, et al., "MetaPhlAn2 for enhanced metagenomic taxonomic profiling", Nature Methods, Oct. 2015, vol. 12, No. 10: pp. 902-904.
Tuohy, et al., "Up-regulating the Human Intestinal Microbiome Using Whole Plant Foods, Polyphenols, and/or Fiber", J Agric Food Chem, 2012, vol. 60: pp. 8776-8782.

(56) References Cited

OTHER PUBLICATIONS

Turnbaugh, et al., "A core gut microbiome in obese and lean twins", Nature, 2009, vol. 457, No. 7228: pp. 480-484.
Turnbaugh, et al., "An obesity-associated gut microbiome with increased capacity for energy harvest", Nature, 2006, vol. 444: pp. 1027-1031.
Turnbaugh, et al., "Diet-Induced Obesity is Linked to Marked but Reversible Alterations in the Mouse Distal Gut Microbiome", Cell Host Microbe, 2008, vol. 3: pp. 213-223.
Turnbaugh, et al., "Supplementary Materials for : The Effect of Diet on the Human Gut Microbiome: A Metagenomic Analysis in Humanized Gnotobiotic Mice", Sci Transl Med, 2009: pp. 1-23.
Turnbaugh, et al., "The Effect of Diet on the Human Gut Microbiome: A Metagenomic Analysis in Humanized Gnotobiotic Mice", Sci Transl Med, 2009: pp. 1-23.
Tyagi, et al., "The Microbial Metabolite Butyrate Stimulates Bone Formation via T Regulatory Cell-Mediated Regulation of WNT10B Expression", Immunity, 2018, vol. 49: pp. 1116-1131.
U.S. Appl. No. 16/235,858—Notice of Allowance, Jan. 23, 2020.
U.S. Appl. No. 16/235,858—Office Action, Aug. 6, 2019.
U.S. Appl. No. 16/694,876—Office Action, Dec. 8, 2021, 41 pages.
U.S. Appl. No. 16/694,876—Office Action, Nov. 5, 2020, 34 pages.
U.S. Appl. No. 16/694,876—Office Action,m Jul. 20, 2022, 26 pages.
Van Der Beek, et al., "Streptococcal dTDP-L-rhamnose biosynthesis enzymes: functional characterization and lead compound identification", Molecular Microbiology, Jan. 1, 2019, vol. 111, No. 4: pp. 1-32.
Van Hul, et al., "Reduced obesity, diabetes and steatosis upon cinnamon and grape pomace are associated with changes in gut microbiota and markers of gut barrier", Am J Physiol Endocrinol Metab, 2017, vol. 314, No. 4: E3340E352.G.
Van Wyk, et al., "Current perspectives on the families of glycoside hydrolases of *Mycobacterium tuberculosis*: their importance and prospects for assigning function to unknowns", Glycobiology, 2017, vol. 27, No. 2: pp. 112-122.
Vatanen, et al., "Variation in Microbiome LPS Immunogenicity Contributes to Autoimmunity in Humans", Cell, 2016, vol. 165: pp. 842-853.
Verma, et al. "Cell surface polysaccharides of Bifidobacterium bifidum induce the generation of Foxp3+ regulatory T cells", Sci Immunol. 3, Oct. 19, 2018: pp. 1-14.
Vital, et al., "A gene-targeted approach to investigate the intestinal butyrate-producing bacterial community", Microbiome, 2013, vol. 1, No. 8: pp. 1-14.
Vogt, et al., "L-Rhamnose increases serum propionate in humans1-3", Am J Clin Nutr, 2004, vol. 80: pp. 89-94.
Voreades, et al., "Diet and the development of the human intestinal microbiome", Front Microbiol, 2014, vol. 5, No. 494: 1-9.
Vorholt, et al., "Microbial life in the phyllosphere", Institute of Microbiology, Dec. 2012, vol. 10: pp. 828-840.
Wagner, et al., "Pyruvate fermentation by Oenococcus oeni and Leuconostoc mesenteroides and role of pyruvate dehydrogenase in anaerobic fermentation." Applied and environmental microbiology 71, No. 9 (2005): 4966-4971.
Wagner, et al., "The Pentose Phosphate Pathway in Regenerating Skeletal Muscle", Biochem. 1978, vol. 170: pp. 17-22.
Wahlstrom, et al., "Intestinal Crosstalk between Bile Acids and Microbiota and Its Impact on Host Metabolism", Cell Metab, 2016, vol. 24: pp. 41-50.
Wallace, et al., "Use and Abuse of HOMA Modeling", Diabetes Care, 2004, vol. 27, No. 6: pp. 1487-1495.
Wang, et al., "Modulation of gut microbiota during probiotic-mediated attenuation of metabolic syndrome in high fat diet-fed mice", ISME J, 2015, vol. 9: pp. 1-15.
Wasserman, et al., "An Apple a Day: Which Bacteria Do We Eat With Organic and Conventional Apples", Frontiers in Microbiology, Jul. 24, 2019, vol. 10, Article 1629: pp. 1-13.
Wassermann, et al., "Harnessing the microbiomes of Brassica vegetables for health issues", Sci Rep, 2017, vol. 7: p. 17649.
Weitkunat, et al., "Short-chain fatty acids and inulin, but not guar gum, prevent diet-induced obesity and insulin resistance through differential mechanisms in mice", Sci Rep, 2017, vol. 7, No. 6109: pp. 1-13.
Weitzmann, et al., "Estrogen deficiency and bone loss: an inflammatory tale", The Journal of Clinical Investigation, May 2006, vol. 116, No. 5: pp. 1186-1194.
Welch, et al., "The Effects of Flavonoids on Bone", Curr Osteoporos Rep., 2014, vol. 12: pp. 205-210.
Whisner, et al., "Prebiotics, Bone and Mineral Metabolism", Calcif Tissue Int, 2018, vol. 102: pp. 443-479.
White, et al., "A Brief History of the Development of Diabetes Medications", Diabetes Spectr, 2015, vol. 27, No. 2: pp. 82-86.
Wikipedia, https://en.wikipedia.org/wiki/Pyruvate_dehydrogenase_complex, accessed Dec. 3, 2021.
Williams, et al., "Ethanol and volatile fatty acid production from lignocellulose by Clostridium cellulolyticum." *International Scholarly Research Notices* 2013, pp. 1-7.
Winer, et al., "The Intestinal Immune System in Obesity and Insulin Resistance", Cell Metab, 2016, vol. 23: pp. 413-426.
Winer, et al., "Immunologic impact of the intestine in metabolic disease", J Clin Invest, 2017, vol. 127, No. 1: pp. 33-42.
Wolfert, et al., "Adaptive immune activation: glycosylation does matter", Nat Chem Biol, Dec. 2013, vol. 9, No. 12: pp. 776-784.
Woo, et al., "Metformin Ameliorates Hepatic Steatosis and Inflammation without Altering Adipose Phenotype in Diet-Induced Obesity", PLoS One, 2014, vol. 9, No. 3: e91111.
Wu, et al., "Arginine metabolism and nutrition in growth, health and disease", Amino Acids, May 2009, vol. 31, No. 1: pp. 153-168.
Wu, et al., "Metformin alters the gut microbiome of individuals with treatment-naïve type 2 diabetes, contributing to the therapeutic effects of the drug", Nat Med, 2017, vol. 23, No. 7: pp. 850-858.
Wu, et al., "Supplement: Metformin alters the gut microbiome of individuals with treatment-naïve type 2 diabetes, contributing to the therapeutic effects of the drug", Nat Med, 2017, vol. 23, No. 7.
Xu, et al., "Intestinal microbiota: a potential target for the treatment of postmenopausal osteoporosis", Bone Research, 2017, vol. 5: pp. 1-18.
Xu, et al., "Paenibacillus panacisoli enhances growth of *Lactobacillus* spp. by producing xylooligosaccharides in corn stover ensilages." Carbohydrate polymers 184 (2018): 435-444.
Yan, et al., "Gut microbiota induce IGF-1 and promote bone formation and growth", PNAS, Nov. 7, 2016: pp. 1-10.
Yang et al., "The prospects of Jerusalem artichoke in functional food ingredients and bioenergy production," Biotechnology Reports 5: 77-88 (2015).
Yang, et al., "Potent Anti-Inflammatory and Antiadipogenic Properties of Bamboo (*Sasa coreana* Nakai) Leaves Extract and Its Major Constituent Flavonoids", J Agric Food Chem, 2017, vol. 65: pp. 6665-6673.
Yassour, et al., "Natural history of the infant gut microbiome and impact of antibiotic treatment on bacterial strain diversity and stability", Sci Transl Med, 2016, vol. 8, No. 343: pp. 1-12.
Yousef, et al., "Metformin: A Unique Herbal Origin Medication", GJMR-B: Pharma, Drug Discovery, Toxicology, and Medicine, 2017, vol. 17, No. 3: pp. 31-37.
Zaiss, et al., "Increased Bone Density and Resistance to Ovariectomy-Induced Bone Loss in FoxP3-Transgenic Mice Based on Impaired Osteoclast Differentiation", Arthritis & Rheumatism, Aug. 2010, vol. 62, No. 8: pp. 2328-2338.
Zaiss, et al., "Treg Cells Suppress Osteoclast Formation", Arthritis & Rheumatism, Dec. 2017, vol. 56, No. 12: pp. 4104-4112.
Zhang, et al., "Effect of probiotics on glucose metabolism in patients with type 2 diabetes mellitus: a meta-analysis of randomized controlled trials", Medicina, 2016, vol. 52: pp. 28-34.
Zhang, et al., "Effects of Acarbose on the Gut Microbiota of Prediabetic Patients: A Randomized, Double-blind, Controlled Crossover Trial", 2017, vol. 8: pp. 293-307.
Zhang, et al., "Human gut microbiota in obesity and after gastric bypass", PNAS, 2009, vol. 106, No. 7: pp. 2365-2370.
Zhang, et al., "Modulation of gut microbiota by berberine and metformin during the treatment of high-fat diet-induced obesity in rats", Sci Rep, 2015, vol. 5, No. 14405: pp. 1-10.

(56) References Cited

OTHER PUBLICATIONS

Zhang, et al., "Structural Changes of Gut Microbiota during Berberine-Mediated Prevention of Obesity and Insulin Resistance in High-Fat Diet-Fed Rats", PLoS One, 2012, vol. 7, No. 8: e42529.
Zhao, et al., "Gut bacteria selectively promoted by dietary fibers alleviate type 2 diabetes", Science, 2018, vol. 359: pp. 1151-1156.
Zheng, et al., "Prebiotic mannan-oligosaccharides augment the hypoglycemic effects of metformin in correlation with modulating gut microbiota", J Agric Food Chem, 2018, vol. 66, No. 23: pp. 5821-5831.
Zhou, et al., "Age-dependent variations of cancellous bone in response to ovariectomy in C57BL/6J mice", Experimental and Therapeutic Medicine, 2018, vol. 15: pp. 3623-3632.
Zmora, et al., "Personalized Gut Mucosal Colonization Resistance to Empiric Probiotics Is Associated with Unique Host and Microbiome Features", Cell, 2018, vol. 174: pp. 1388-1405.
Paynich, et al., "Exopolysaccharide from Bacillus subtilis Induces Anti-Inflammatory M2 Macrophages That Prevent T Cell-Mediated Disease", The Journal of Immunology, 2017, pp. 1-10.
Peng, et al., "IDBA-UD: a de novo assembler for single-cell and metagenomic sequencing data with highly uneven depth", Bioinformatics, 2012, vol. 28, No. 11, 1420-1428.
Peters, et al., "The transcriptional landscape of age in human peripheral blood", Nature Communications, 2015, pp. 1-14.
Piatek, et al., "In-Vitro Growth Inhibition of Bacterial Pathogens by Probiotics and a Synbiotic: Product Composition Matters", Int. J. Environ. Res. Public Health, 2020, pp. 1-10.
Pineda, et al., "A randomized, double-blinded, placebo-controlled pilot study of probiotics in active rheumatoid arthritis", Med Sci Monit, 2011; 17(6): CR347-354, Published: Jun. 1, 2011, http://www.medscimonit.com/fulltxt.php?ICID=881808: pp. 348-354.
Pinoli, et al., "Dopaminergic Regulation of Innate Immunity: a Review", J Neuroimmune Pharmacol, DOI 10.1007/s11481-017-9749-2, Published online: Jun. 3, 2017: pp. 1-22.
Poupet, et al., "Caenorhabditis elegans, a Host to Investigate the Probiotic Properties of Beneficial Microorganisms", Frontiers in Nutrition | www.frontiersin.org, Aug. 2020 | vol. 7 | Article 135, published: Aug. 21, 2020, doi: 10.3389/fnut.2020.00135: pp. 1-22.
Pérez-Chaparro, "Newly Identified Pathogens Associated with Periodontitis: A Systematic Review", Journal of Dental Research, Jul. 29, 2014, pp. 846-858.
Quinn, et al., "Global chemical effects of the microbiome include new bile-acid conjugations", https://doi.org/10.1038/s41586-020-2047-9, Published online: Feb. 26, 2020, Nature | vol. 579 | Mar. 5, 2020: pp. 123-129—Total pp. 22.
Raftis, et al., "An immunomodulatory member of the gut microbiota reduces clinical signs and inflammatory joint damage in an animal model of rheumatoid arthritis": 4D Pharma PLC, p. 1.
Rahman, et al., "NemaLife chip: a micropillar-based microfluid culture device optimized for aging studies in crawling C. elegans", www.nature.com/scientificreports, (2020) 10:16190 | https://doi.org/10.1038/s41598-020-73002-6: pp. 1-19.
Rao, et al., "Human Peripheral Blood Mononuclear Cells Exhibit Heterogeneous CD52 Expression Levels and Show Differential Sensitivity to Alemtuzumab Mediated Cytolysis", PLoS One | Heterogeneous CD52 Expression on Human PBMCs, www.plosone.org, Jun. 2012 | vol. 7 | Issue 6 | e39416: pp. 1-12.
Reinhoud, et al., "Analysis of Glutamate, GABA, Noradrenaline, Dopamine, Serotonin, and Metabolites Using Microbore UHPLC with Electrochemical Detection", ACS Chemical Neuroscience, pubs.acs.org/chemneuro, 2013 American Chemical Society, dx.doi.org/10.1021/cn400044s | ACS Chem. Neurosci. 2013, 4: pp. 888?894.
Riskedal, et al., "Development and Performance of a Diagnostic Precision Biomarker for Seronegative Rheumatoid Arthritis Based on DNA Methylation in Blood", Meeting: ACR Convergence 2022, Date: Saturday, Nov. 12, 2022: pp. 1-4.
Robida-Stubbs, et al., "TOR Signaling and Rapamycin Influence Longevity by Regulating SKN-1/Nrf and DAF-16/ FoxO", Cell Metabolism 15, 713-724, May 2, 2012 ª2012 Elsevier Inc.: pp. 713-724.
Rogier, et al., "Alteration of the intestinal microbiome characterizes preclinical inflammatory arthritis in mice and its modulation attenuates established arthritis", Published online: Nov. 15, 2017, www.nature.com/scientificreports | Scientific Reports 7:15613 | DOI:10.1038/s41598-017-15802-x: pp. 1-12.
Romanin, et al., "Probiotic yeast Kluyveromyces marxianus CIDCA 8154 shows anti-inflammatory and anti-oxidative stress properties in in vivo models", Beneficial Microbes, 2016; 7(1): 83-93, ISSN 1876-2833 print, ISSN 1876-2891 online, DOI 10.3920/BM2015.0066, http://www.wageningenacademic.com/doi/pdf/10.3920/BM2015.0066—Friday, Sep. 22, 2017 8:40:22 AM—Göteborgs Universitet IP Address:130.241.16.16: pp. 83-93.
Roon, et al., "Methotrexate bioavailability", Clinical and Experimental Rheumatology 2010, Clin Exp Rheumatol 2010; 28 (suppl. 61): pp. s27-s32.
Roselli, et al., "Caenorhabditis Elegans and Probiotics Interactions from a Prolongevity Perspective", International Journal of Molecular Sciences, Int. J. Mol. Sci. 2019, 20, 5020; doi: 10.3390/ijms20205020, www.mdpi.com/journal/ijms: pp. 1-14.
Roshchina, "Chapter 2 Evolutionary Considerations of Neurotransmitters in Microbial, Plant, and Animal Cells", M. Lyte and P.P.E. Freestone (eds.), Microbial Endocrinology, Interkingdom Signaling in Infectious Disease and Health, DOI 10.1007/978-1-4419-5576-0_2: pp. 17-52.
Rutledge, et a;., "Measuring biological age using omics data", Nature Reviews | Genetics vol. 23 | Dec. 2022: pp. 715-727.
Rühmann, et al., "Methods to identify the unexplored diversity of microbial exopolysaccharides", Frontiers in Microbiology | www.frontiersin.org, Jun. 2015 | vol. 6 | Article 565, published: Jun. 9, 2015, doi: 10.3389/fmicb.2015.00565: pp. 1-8.
Saccon, et al., "Senolytic Combination of Dasatinib and Quercetin Alleviates Intestinal Senescence and Inflammation and Modulates the Gut Microbiome in Aged Mice", Journals of Gerontology: Biological Sciences, cite as: J Gerontol A Biol Sci Med Sci, 2021, vol. 76, No. 11, 1895-1905, doi:10.1093/gerona/glab002, Advance Access publication Jan. 6, 2021: pp. 1895-1905.
Salminen, et al., "Activation of innate immunity system during aging: NF-κB signaling is the molecular culprit of inflamm-aging", Ageing Research Reviews 7 (2008), doi:10.1016/j.arr.2007.09.002: pp. 83-105.
Sanchez, et al., "Efficacy of Probiotics in Rheumatoid Arthritis and Spondyloarthritis: A Systematic Review and Meta-Analysis of Randomized Controlled Trials", Published: Jan. 14, 2022, Nutrients 2022, 14, 354. https://doi.org/10.3390/nu14020354, https://www.mdpi.com/journal/nutrients: pp. 1-19.
Sandrini, et al., "Microbial endocrinology: host-bacteria communication within the gut microbiome", Journal of Endocrinology, (2015) 225, R21-R34, http://joe.endocrinology-journals.org, DOI: 10.1530/JOE-14-0615: pp. R21-34.
Santano, et al., "Comparative Evaluation of the Antimicrobial and Mucus Induction Properties of Selected Bacillus Strains against Enterotoxigenic *Escherichia coli*", Antibiotics 2020, 9, 849; doi: 10.3390/antibiotics9120849 www.mdpi.com/journal/antibiotics: pp. 1-10.
Saraiva, et al., "The regulation of IL-10 production by immune cells", doi:10.1038/nri2711, Published online Feb. 15, 2010, Mar. 2010 | vol. 10, www.nature.com/reviews/immunol: pp. 170-181.
Saul, et al., "A new gene set identifies senescent cells and predicts senescence-associated pathways across issues", Published online: Aug. 16, 2022, Nature Communications | (2022)13:4827, https://doi.org/10.1038/s41467-022-32552-1: pp. 1-15.
Sayed, et a;.,"An inflammatory aging clock (iAge) based on deep learning tracks multimorbidity, immunosenescence, frailty and cardiovascular aging", https://doi.org/10.1038/s43587-021-00082-y, Nature Aging | vol. 1 | Jul. 2021 | 598-615 | www.nature.com/nataging: pp. 598-615, Total pp. 31.
Scher, et al., "Expansion of intestinal Prevotella copri correlates with enhanced susceptibility to arthritis", Elife, Nov. 2013, vol. 2:e01202 (20 pages).

(56) References Cited

OTHER PUBLICATIONS

Schiavi, et al., "The Surface-Associated Exopolysaccharide of Bifidobacterium longum 35624 Plays an Essential Role in Dampening Host Proinflammatory Responses and Repressing Local TH17 Responses", Appl Environ Microbiol, Nov. 2016, vol. 82, No. 24: pp. 7185-7196.

Schorpion, et al., "Can Probiotic Supplements Improve Outcomes in Rheumatoid Arthritis?", Curr Rheumatol Rep, Nov. 2017, vol. 19, No. 11, Article 73: pp. 7.

Schott, et al., "Targeting the gut microbiome to treat the osteoarthritis of obesity", JCI Insight, Apr. 2018, vol. 3, No. 8: e95997 (18 pages).

Scortichini, et al., "Development and validation of a GC-FID method for the analysis of short chain fatty acids in rat and human faeces and in fermentation fluids", J Chromatogr B Analyt Technol Biomed Life Sci., Apr. 2020, vol. 1143, Article 121972: pp. 1-9. Epub Jan. 13, 2020.

Segata, et al., "Metagenomic microbial community profiling using unique clade-specific marker genes", Nature Methods, Jun. 2012, vol. 9, No. 8: pp. 811-814.

Sethi, et al., "Design, synthesis and computational studies involving Indole-Coumarin hybrids as galectin-1 inhibitors", Chemical Papers, Month 2021, vol. 75: pp. 2791-2805. Epub Feb. 2, 2021.

Shahbizi, et al., "Anti-Inflammatory and Immunomodulatory Properties of Fermented Plant Foods", Nutrients, Apr. 2021, vol. 13, No. 5, Article 1516: pp. 1-20.

Skelly, et al., "Mining the microbiota for microbial and metabolite-based immunotherapies", Nat Rev Immunol, May 2019, vol. 19, No. 5: pp. 305-323 (19 pages).

Skirbekk, et al., "How to Measure Population Aging? The Answer Is Less than Obvious: A Review", Gerontology, 2019, vol. 65, No. 2: pp. 136-144. Epub Dec. 13, 2018.

Smolen, et al., "Clinical trials of new drugs for the treatment of rheumatoid arthritis: focus on early disease", Ann Rheum Dis., Jul. 2016, vol. 75, No. 7: pp. 1268-1271. Epub Apr. 2016.

Smollen, et al., "Rheumatoid arthritis", Nature Reviews Disease Primers, Feb. 2018, vol. 4, Article 18001: pp. 1-23.

Sonowal, et al., "Indoles from commensal bacteria extend healthspan", Proc Natl Acad Sci USA, Sep. 2017, vol. 114, No. 36: pp. E7506-E7515. Epub Aug. 2017.

Soto-Giron, et al., "The Edible Plant Microbiome represents a diverse genetic reservoir with functional potential in the human host", Scientific Reports, Dec. 2021, vol. 11, No. 1, Article 24017: pp. 1-14.

Sun, et al., "Assessments of Probiotic Potentials of Lactiplantibacillus plantarum Strains Isolated From Chinese Traditional Fermented Food: Phenotypic and Genomic Analysis", Frontiers in Microbiology, May 2022, vol. 13, Article 895132: pp. 1-10.

Sutphin, et al., "Caenorhabditis elegans orthologs of human genes differentially expressed with age are enriched for determinants of longevity", Aging Cell, Aug. 2017, vol. 16, No. 4: pp. 672-682. Epub Apr. 2017.

Ternes, et al., "The gut microbial metabolite formate exacerbates colorectal cancer progression", Nature Metabolism, Apr. 2022, vol. 4, No. 4: pp. 458-475. Epub Apr. 2022.

The Tabula Muris Consortium, et al., "A single-cell transcriptomic atlas characterizes ageing tissues in the mouse", Nature, Jul. 2020, vol. 583, No. 7817: pp. 590-595. Epub Jul. 2020.

Thevaranjan, et al., "Age-Associated Microbial Dysbiosis Promotes Intestinal Permeability, Systemic Inflammation, and Macrophage Dysfunction", Cell Host & Microbe, Apr. 2017, vol. 21, No. 4: pp. 455-466 (19 pages).

Théatre, et al., "The Surfactin-Like Lipopeptides From *Bacillus* spp.: Natural Biodiversity and Synthetic Biology for a Broader Application Range", Frontiers in Bioengineering and Biotechnology, Mar. 2021, vol. 9, Article 623701: pp. 1-20.

Tsai, et al., "Gerobiotics: probiotics targeting fundamental aging processes", Bioscience of Microbiota, Food and Health, 2021, vol. 40, No. 1: pp. 1-11. Epub Oct. 2020.

United Nations, et al., "World Population Prospects 2019: Highlights", Department of Economic and Social Affairs, Statistical Papers—United Nations (Ser. A), Population and Vital Statistics Report, Jun. 2019: pp. 1-2.

U.S. Appl. No. 16/826,078—Office Action, Oct. 5, 2022, 54 pages.

Vanzanten, et al., "Gastric transitional zones, areas where Helicobacter treatment fails: results of a treatment trial using the Sydney strain mouse model", Antimicrobial Agents and Chemotherapy, Jul. 2003, vol. 47, No. 7: pp. 2249-2255.

Vavassori, et al., "The bile acid receptor FXR is a modulator of intestinal innate immunity", The Journal of Immunology, Nov. 2009, vol. 183, No. 10: pp. 6251-6261 (12 pages). Epub Oct. 2009.

Veghef-Mehrabany, et al., "Effects of Probiotic Supplementation on Oxidative Stress Indices in Women with Rheumatoid Arthritis: A Randomized Double-Blind Clinical Trial", Journal of the American College of Nutrition, May-Jun. 2016, vol. 35, No. 4: pp. 291-299 (10 pages). Epub Apr. 2015.

Veghef-Mehrabany, et al., "Probiotic supplementation improves inflammatory status in patients with rheumatoid arthritis", Nutrition, Apr. 2014, vol. 30, No. 4: pp. 430-435. Epub Dec. 2013.

Verginer, et al., "Production of Volatile Metabolites by Grape-Associated Microorganisms", Journal Agricultural and Food Chemistry, Jul. 2010, vol. 58, No. 14: pp. 8344-8350.

Vijayakumar, et al., "A Microplate Growth Inhibition Assay for Screening Bacteriocins against Listeria monocytogenes to Differentiate Their Mode-of-Action", Biomolecules, Jun. 2015, vol. 5, No. 2: pp. 1178-1194.

Villageliu, et al., "Dopamine production in Enterococcus faecium: A microbial endocrinology-based mechanism for the selection of probiotics based on neurochemical-producing potential", PLoS One, Nov. 2018, vol. 13, No. 11: e0207038 (10 pages).

Visser, et al., "Optimal dosage and route of administration of methotrexate in rheumatoid arthritis: a systematic review of the literature", Ann Rheum Dis., Jul. 2009, vol. 68, No. 7: pp. 1094-1099. Epub Nov. 2009.

Vivekananda, et al., "Effect of the probiotic Lactobacilli reuteri (Prodentis) in the management of periodontal disease: a preliminary randomized clinical trial", Journal of Oral Microbiology, Nov. 2010, vol. 2, Article 5344: pp. 1-10.

Vlyhlidalova, et al., "Gut Microbial Catabolites of Tryptophan Are Ligands and Agonists of the Aryl Hydrocarbon Receptor: A Detailed Characterization", International Journal of Molecular Sciences, Apr. 2020, vol. 21, No. 7, Article 2614: pp. 1-17.

Walsham, et al., "Lactobacillus reuteri Inhibition of Enteropathogenic *Escherichia coli* Adherence to Human Intestinal Epithelium", Frontiers in Microbiology, Mar. 2016, vol. 7, Article 244: pp. 1-10.

Walter, et al., "Screening Concepts for the Isolation of Biosurfactant Producing Microorganisms", Part of the Advances in Experimental Medicine and Biology (AEMB) book series, 2010, vol. 672: pp. 1-13 (20 pages).

Wan, et al., "Serotonin: A Potent Immune Cell Modulator in Autoimmune Diseases", Frontiers in Immunology, Feb. 2020, vol. 11, Article 186: pp. 1-12.

Wang, et al., "FXR: a metabolic regulator and cell protector", Cell Research, Nov. 2008, vol. 18, No. 11: pp. 1087-1095.

Watanabe, et al., "Impact of senescence-associated secretory phenotype and its potential as a therapeutic target for senescence-associated diseases", Cancer Science, Apr. 2017, vol. 108, No. 4: pp. 563-569.

Wells, et al., "Associations between gut microbiota and genetic risk for rheumatoid arthritis in the absence of disease: a cross-sectional study", Lancet Rheumatology, Jul. 2020, vol. 2, No. 7: pp. e418-e427.

Weyand, et al., "The immunology of rheumatoid arthritis", Nature Immunology, Jan. 2021, vol. 22, No. 1: pp. 10-18.

Wilson, et al., "Microbial Influences of Mucosal Immunity in Rheumatoid Arthritis ", Current Rheumatology Reports, Oct. 2020, vol. 22, No. 11: pp. 1-8.

Wilson, Timothy M., et al., "Microbial Influences of Mucosal Immunity in Rheumatoid Arthritis", Curr Rheumatol Rep., 22(11), 83, doi:10.1007/s11926-020-00960-1.

(56) References Cited

OTHER PUBLICATIONS

Woo, Jae-Yeon, et al., "*Lactobacillus pentosus* var. plantarum C29 ameliorates memory impairment and inflammaging in a D-galactose-induced accelerated aging mouse model", Anaerobe, 27, 2014, pp. 22-26.

Xu, Huihui, et al., "Interactions between Gut Microbiota and Immunomodulatory Cells in Rheumatoid Arthritis", Hindawi, Mediators of Inflammation, vol. 2020, Article ID 1430605, 14 Pages, https://doi.org/10.1155/2020/1430605.

Yamashita, Maya, et al., "Lactobacillus helveticus SBT2171 Attenuates Experimental Autoimmune Encephalomyelitis in Mice", Frontiers in Microbiology, Jan. 2018, vol. 8, Article 2596.

Yamashita, Maya, et al., "Preventive Effect of Lactobacillus helveticus SBT2171 on Collagen-Induced Arthritis in Mice", Frontiers in Microbiology, Jun. 2017, vol. 8, Article 1159.

Yamazaki, Munchiro, et al., "Dopamine inhibition of superoxide anion production by polymorphonuclear leukocytes", J. Allergy Clin. Immunol., May 1989, pp. 967-972.

Yan, Yiqing, et al., "Dopamine Controls Systemic Inflammation through Inhibition of NLRP3 Inflammasome", Cell, 160, Jan. 15, 2015, pp. 62-73.

Yoneno, Kazuaki et al., "TGR5 signalling inhibits the production of pro-inflammatory cytokines by in vitro differentiated inflammatory and intestinal macrophages in Crohn's disease", Immunology, 2013, 139, pp. 19-29.

You, Xin-yu, et al., "Intestinal Mucosal Barrier Is Regulated by Intestinal Tract Neuro-Immune Interplay", Frontiers in Pharmacology, May 2021, vol. 12, Article 659716.

Yu, Haitao, et al., "Protective Ability of Biogenic Antimicrobial Peptide Microcin J25 Against Enterotoxigenic *Escherichia coli*-Induced Intestinal Epithelial Dysfunction and Inflammatory Reponses IPEC-J2 Cells", Frontiers in Cellular and Infection Microbiology, Jul. 2018, vol. 8, Article 242.

Yusufu, Ibrahim, et al., "A Tryptophan-Deficient Diet Induces Gut Microbiota Dysbiosis and Increases Systemic Inflammation in Aged Mice", Int. J. Mol. Sci., 2021, 22, 5005, <https://doi.org/10.3390/ijms22095005>.

Zaiss, Mario M., et al., "The gut-joint axis in rheumatoid arthritis", Nature Reviews | Rheumatology, vol. 17, Apr. 2021, pp. 224-237.

Zamani, Batol, et al., "Synbiotic supplementation and the effects on clinical and metabolic responses in patients with rheumatoid arthritis: a randomised, double-blind, placebo-controlled trial", British Journal of Nutrition, 2017, 117, pp. 1095-1102.

Zampieri, Raffaella Margherita, et al., "Anti-Inflammatory Activity of Exopolysaccharides from *Phormidium* sp. ETS05, the Most Abundant Cyanobacterium of the Therapeutic Euganean Thermal Muds, Using the Zebrafish Model", Biomolecules, Apr. 10, 2020, 10, 582.

Zhang, Xuan, et al., "The oral and gut microbiomes are perturbed in rheumatoid arthritis and partly normalized after treatment", Nature Medicine, vol. 21, No. 8, Aug. 2015, pp. 895-907.

Zhang, Yiqiang, et al., "Rapamycin Extends Life and Health in C57BL/6 Mice", J Gerontol A Biol Sci Med Sci, Feb. 2014, 69(2), pp. 119-130.

Zhang, Yuanyuan, et al., "Anti-inflammatory Activity and Mechanism of Surfactin in Lipopolysaccharide-Activated Macrophages", Inflammation, vol. 38, No. 2, Apr. 2015, pp. 756-764.

Zhao, Ruixiang, et al., "Purification and characterization of bacteriocin produced by Lactobacillus rhamnosus zrx01", Food Bioscience, 38, 2020, 100754.

Zhou, Bin and Zhang, Defeng, "Antibacterial effects of bacteriocins isolated from Lactobacillus rhamnosus (ATCC 53103) in a rabbit model of knee implant infection", Experimental and Therapeutic Medicine, 15, 2018, pp. 2985-2989.

U.S. Appl. No. 16/694,876, filed Nov. 25, 2019, Pending.
U.S. Appl. No. 17/816,371, filed Jul. 29, 2022, Pending.
U.S. Appl. No. 18/053,262, filed Nov. 7, 2022, Pending.
U.S. Appl. No. 16/235,858, filed Dec. 28, 2018, U.S. Pat. No. 10,596,209, Mar. 24, 2020, Issued.
U.S. Appl. No. 16/826,078, filed Mar. 20, 2020, Pending.
U.S. Appl. No. 17/555,261, filed Dec. 17, 2021, Pending.
U.S. Appl. No. 17/816,932, filed Aug. 2, 2022, Pending.
U.S. Appl. No. 18/181,495, filed Mar. 9, 2023, Pending.

* cited by examiner

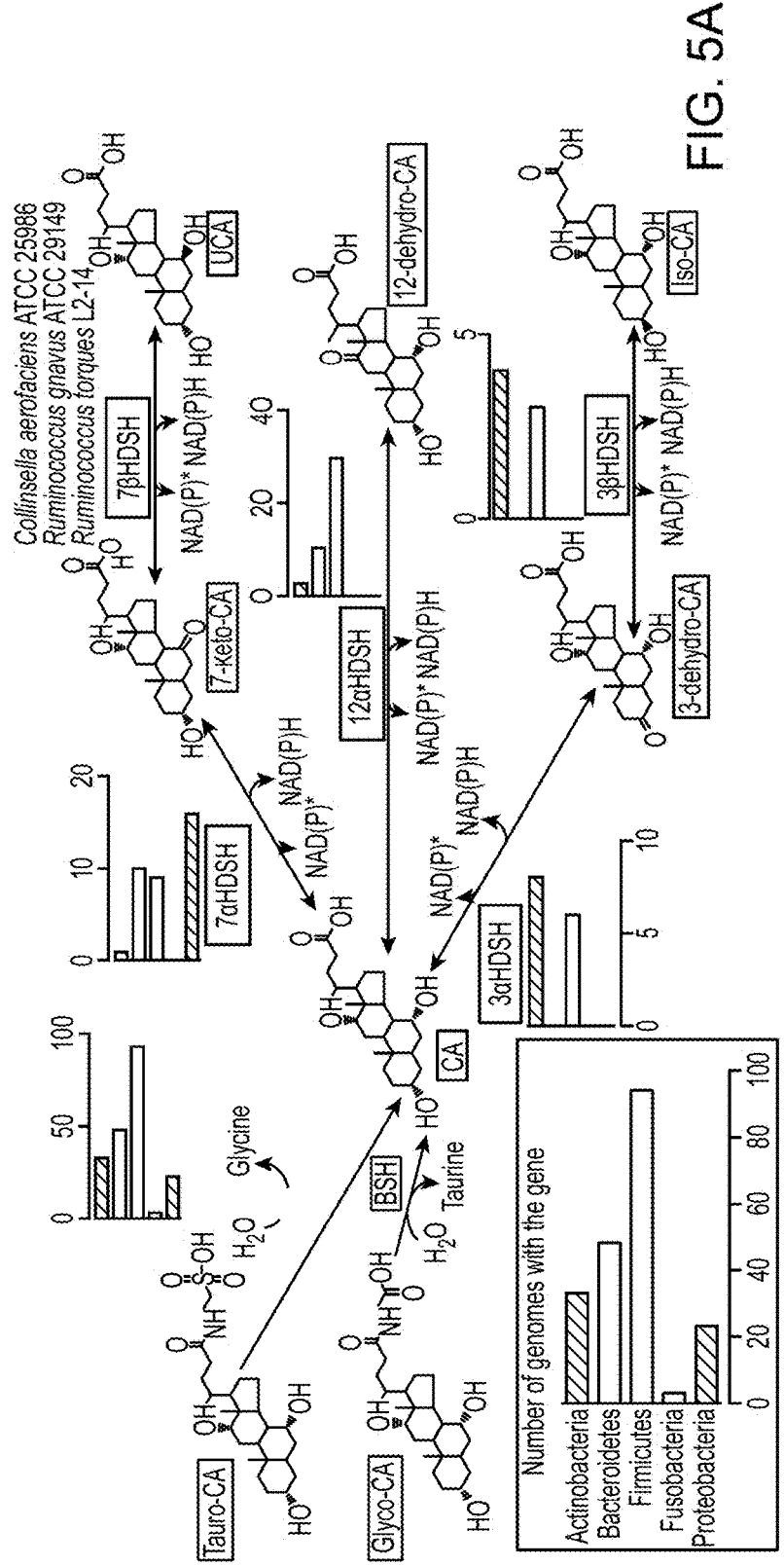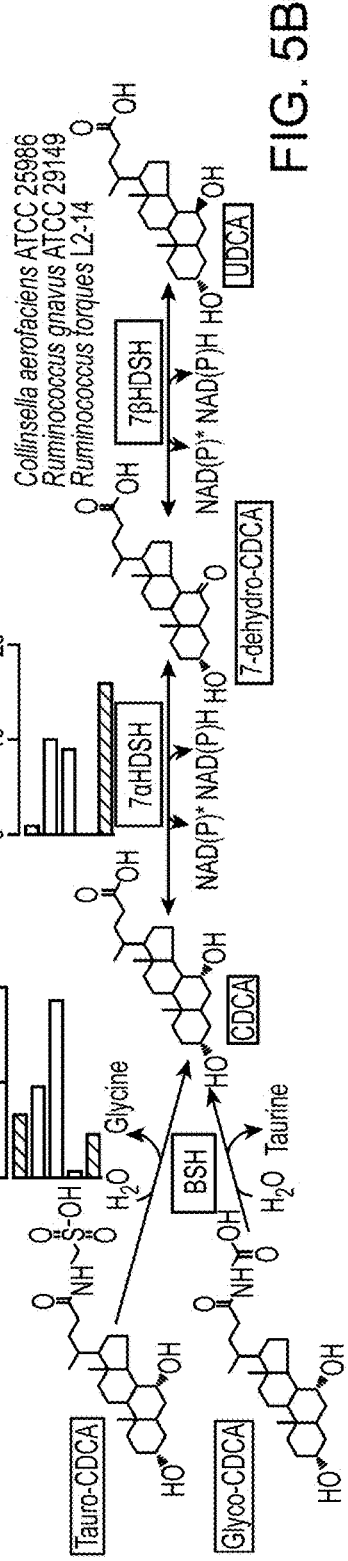

Enzymes involved in biosynthetic pathway of EPS.

| S.no. | Group | Enzyme | Mode of action | References |
|---|---|---|---|---|
| 1. | Group-1 | Hexokinase | Intracellular enzymes converts glucose to glucose-6-phosphate | [43] |
| 2. | Group-2 | Uridine-5' diphosphate (UDP)-glucose pyrophosphorylase | Catalyzes conversion of glucose-1-phosphate to UDP-glucose (key molecule of EPS synthesis) | [147] |
| 3. | Group-3 | Glycosyl transferases (GTFs) | Transfers sugar nucleotides to a glycosyl carrier lipid | [55] |
| 4. | Group-4 | Wzx protein (flippase), permease and ABC-transporters | Involved in the polymerization of the macromolecules and situated outside the cell membrane and cell wall Translocate individual repeating units attached to UDP-C55 lipid carrier across cytoplasmic membrane | [61] |

FIG. 6

Table 1. Details of the essential genes in the *Lactobacillus* EPS gene clusters and families of the encoded putative proteins.

| | Genes | Abbreviation | Total Number of Genes | Number of PLFams | Number of Clusters not Having the Gene | Number of Proteins: PGFams | PLFams | PGFams | % of Singleton Families # | Number of Clusters Having Multicopy Genes | For Clusters Having >2 Copies of Gene, Average Number of Those Genes | Families # |
|---|---|---|---|---|---|---|---|---|---|---|---|---|
| 1 | LytR-transcriptional regulator | epsA | 78 | 8 | 74 | 2 | 9.8 | 4 | 12.5 | 5 | 2.2 | 1 |
| 2 | Tyrosine kinase modulator | epsB | 130 | 29 | 25 | 15 | 4.4 | 1.9 | 37.9 | 9 | 2 | 2 |
| 3 | Tyrosine kinase | epsC | 125 | 25 | 30 | 10 | 5 | 2.5 | 28 | 8 | 2 | 2 |
| 4 | Phosphotyrosine phosphatase | epsD | 97 | 11 | 49 | 1 | 8.8 | 11 | 9.1 | 0 | - | - |
| 5 | Priming glycosyltransferase | epsE | 140 | 24 | 10 | 8 | 5.8 | 3 | 33.3 | 4 | 2 | 1.8 |
| 6 | Glycosyltransferase | gt | 670 | 343 | 0 | 246 | 1.9 | 1.4 | 66.6 | 140 | 4.6 | 4.3 |
| 7 | Flippase | wzx | 147 | 39 | 18 | 16 | 3.8 | 2.4 | 46.2 | 17 | 2.17 | 2 |
| 8 | Polysaccharide polymerase | wzy | 103 | 50 | 42 | 42 | 2 | 1.2 | 73.8 | 2 | 2 | 2 |

PGFams were considered for GT and Wzy, while PLFams were considered for all other proteins.

FIG. 7

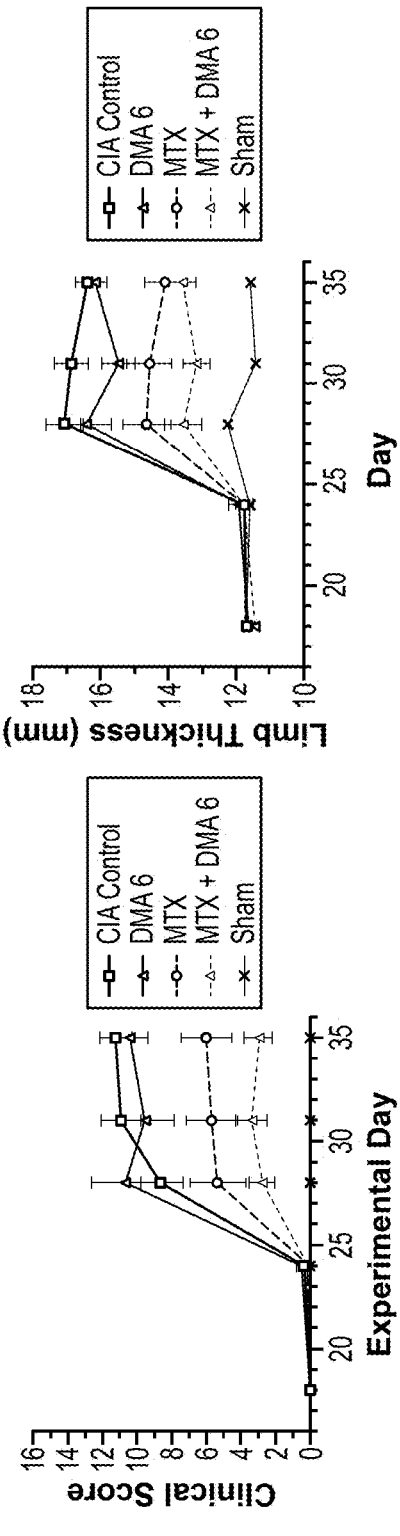
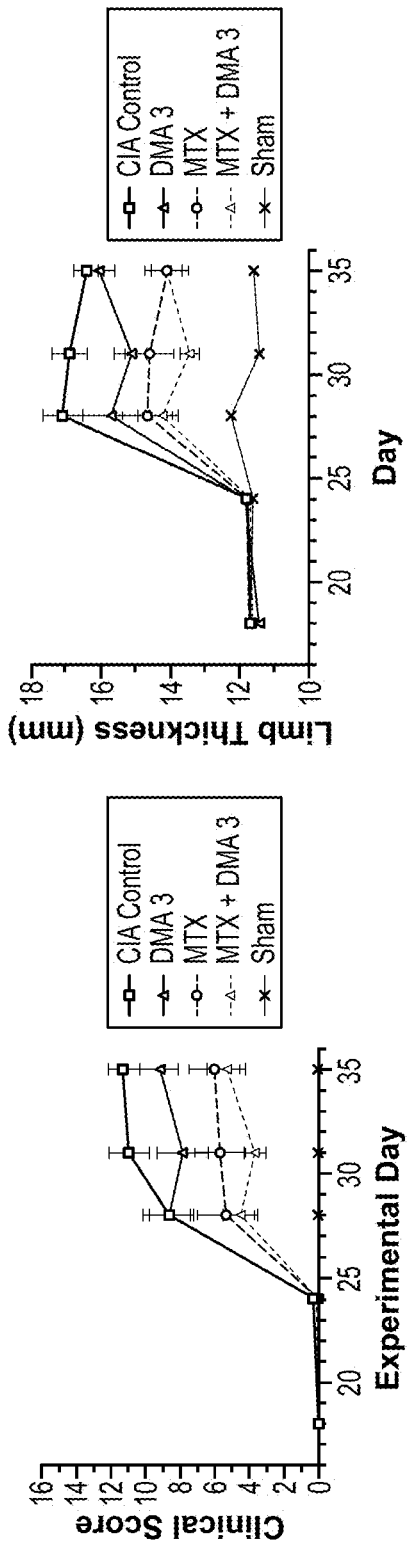

ic supplementation found that orally administered microbes can significantly reduce systemic inflammatory biomarkers in human subjects (Milajerdi, A. et al. Eur J Nutr 59, 633-649 (2020)), and there is evidence that probiotic organisms can also promote longevity in model organisms, including *Caenorhabditis elegans* (Roselli, M. et al. Int J Mol Sci 20, E5020 (2019)). However, commercial probiotics are limited to a small number of bacterial and fungal species, and novel sources of beneficial microbes present new possible solutions to address systemic inflammation in the aging population. Thus, there is a significant need to identify microbes and produce compositions comprising live microbial populations that can be used to treat and/or prevent symptoms of aging-associated inflammation.

IMMUNOMODULATORY COMPOSITIONS COMPRISING MICROBIAL ENTITIES

CROSS REFERENCE TO RELATED APPLICATIONS

This application is a continuation application of International Application No. PCT/US2022/053684, filed on Dec. 21, 2022, which claims the benefit of and priority to U.S. Provisional Application Nos. 63/292,362 filed Dec. 21, 2021, and 63/348,854 filed Jun. 3, 2022, each of which is hereby incorporated in its entirety by reference for all purposes.

SEQUENCE LISTING

The instant application contains a Sequence Listing which has been submitted via Patent Center and is hereby incorporated by reference in its entirety. Said XML, created on Mar. 30, 2023, is named SBI-011WO_SL.xml, and is 1,354,275 bytes in size.

BACKGROUND

Plant-based and fermented foods are rich sources of diverse microbes. Daily consumption of fresh fruits, vegetables, seeds and other plant-derived ingredients of salads and juices is recognized as part of a healthy diet and associated with weight loss, weight management and overall healthy lifestyles. This is demonstrated clinically and epidemiologically in the "China Study" (Campbell, T. C. and Campbell T. M. 2006. The China Study: startling implications for diet, weight loss and long-term health. Benbella books pp 419) where a lower incidence of inflammatory-related indications were observed in rural areas where diets are whole food plant-based. The benefit from these is thought to be derived from the vitamins, fiber, antioxidants, and other molecules that are thought to benefit the microbial flora through the production of prebiotics. These can be in the form of fermentation products from the breakdown of complex carbohydrates and other plant-based polymers. There has been no clear mechanistic association between microbes in whole food plant-based diets and the benefits conferred by such a diet. The role of these microbes as probiotics, capable of contributing to gut colonization and thereby influencing a subject's microbiota composition in response to a plant-based diet, has been underappreciated.

In particular, although it is appreciated that the gut microbiome has important effects on the development and functioning of the immune system, how probiotics modulate the immune system, and which populations are most effective at doing so, is not well understood. Thus, there is a significant need to identify microbes found in plants and fermented foods and produce compositions comprising live microbial populations that can be used to treat and/or prevent immune system disorders, and conditions related to inflammation.

The global human population is aging, with the number of individuals over age fifty estimated to have exceeded 1.8 billion in 2020 (United Nations World Population Prospects 2019). One consequence of this is the increased incidence of aging-related diseases, including metabolic syndrome, cardiovascular disease, and obesity; each leading to increased healthcare costs and compromising the length and quality of life for older adults (Franceschi, C., et al. Nat Rev Endocrinol 14, 576-590 (2018)). A central feature of aging is low-grade, chronic inflammation that occurs in the absence of infection, a phenomenon termed "inflammaging" or "aging-associated inflammation". In the context of an aging global population and increasing incidence of aging-related diseases, there is a pressing need to identify strategies to prevent and/or manage inflammaging. However, aside from recommendations regarding diet and exercise, effective options for aging-associated inflammation are lacking.

Aging-associated inflammation is thought to be mediated by a shared set of mechanisms, including cellular senescence, activation of both the inflammasome and DNA damage response, as well as intestinal dysbiosis; changes in the structure of the microorganisms that reside within the human intestinal tract (the gut microbiota) (Franceschi, C., et al. Nat Rev Endocrinol 14, 576-590 (2018)). The gut microbiota plays an integral role in regulating host immunity and inflammation through a variety of mechanisms (Brown, E. M., et al. Ann Rev Immunol 37, 599-624 (2019)). A recent meta-analysis of randomized clinical trials utilizing probiotic supplementation found that orally administered microbes can significantly reduce systemic inflammatory biomarkers in human subjects (Milajerdi, A. et al. Eur J Nutr 59, 633-649 (2020)), and there is evidence that probiotic organisms can also promote longevity in model organisms, including *Caenorhabditis elegans* (Roselli, M. et al. Int J Mol Sci 20, E5020 (2019)). However, commercial probiotics are limited to a small number of bacterial and fungal species, and novel sources of beneficial microbes present new possible solutions to address systemic inflammation in the aging population. Thus, there is a significant need to identify microbes and produce compositions comprising live microbial populations that can be used to treat and/or prevent symptoms of aging-associated inflammation.

SUMMARY

In certain aspects, disclosed herein are pharmaceutical compositions comprising a population of viable microbes, comprising:
(i) a first microbial entity comprising a first bacterial species comprising:
  (a) an 16S rDNA sequence that is at least 97% identical to a 16S rDNA sequence set forth in SEQ ID NO: 1-233 from Table 4;
  (b) a first genome; wherein the first genome comprises at least one functional expression sequence at least about 30% identical to a functional expression sequence selected from Table 5 or Table 6; or
  (c) a bacterial species capable of producing an enzyme having an amino acid sequence at least 60% identical to an enzyme selected from Table 5 or an enzyme capable of acting on the same substrate as an enzyme having an amino acid sequence at least 60% identical to an enzyme selected from Table 5 or Table 6;
(ii) a second microbial entity comprising a first fungal species comprising:
  (a) an 18S or ITS rDNA sequence that is at least 97% identical to a 18S or ITS rDNA sequence set forth in SEQ ID NO: 1-233 from Table 4;
  (b) a genome comprising a functional expression sequence selected from at least about 30% identical to a functional expression sequence selected from Table 5 or Table 6; or
  (c) a metabolic signature or functionality selected from Table 5 or Table 7; and
  (iii) a pharmaceutically acceptable delivery vehicle.

In certain aspects, disclosed herein are pharmaceutical compositions comprising a population of viable microbes, comprising:

(i) first microbial entity comprising a first bacterial species comprising a 16S rDNA sequence that is at least 97% identical to a 16S rDNA sequence set forth in SEQ ID NO 1-233 from Table 4;

(ii) a second microbial entity comprising a first fungal species comprising:

(a) an 18S or ITS rDNA sequence that is at least 97% identical to a 18S or ITS rDNA sequence set forth in SEQ ID NO: 1-233 from Table 4;

(b) a genome comprising a functional expression sequence selected from at least about 30% identical to a functional expression sequence selected from Table 5 or Table 6; or (c) a metabolic signature or functionality or functionality selected from Table 5 or Table 7; and (iii) a pharmaceutically acceptable delivery vehicle.

In certain aspects, disclosed herein are pharmaceutical compositions comprising a functional population of viable microbes, comprising:

(i) a first microbial entity comprising a first bacterial species comprising a first genome; wherein the first genome comprises at least one functional expression sequence at least about 30% identical to a functional expression sequence selected from Table 5 or Table 6;

(ii) a second microbial entity comprising a first fungal species comprising:

(a) an 18S or ITS rDNA sequence that is at least 97% identical to a 18S or ITS rDNA sequence set forth in SEQ ID NO:233 from Table 4;

(b) a genome comprising a functional expression sequence selected from at least about 30% identical to a functional expression sequence selected from Table 5 or Table 6; or (c) a metabolic signature or functionality or functionality selected from Table 5 or Table 7; and (iii) a pharmaceutically acceptable delivery vehicle.

In certain aspects, disclosed herein are pharmaceutical compositions comprising a functional population of viable microbes, comprising:

(i) a first microbial entity comprising a bacterial species capable of producing an enzyme having an amino acid sequence at least 60% identical to an enzyme selected from Table 5 or Table 6 or an enzyme capable of acting on the same substrate as an enzyme having an amino acid sequence at least 60% identical to an enzyme selected from Table 5 or Table 6;

(ii) a second microbial entity comprising a first fungal species comprising:

(a) an 18S or ITS rDNA sequence that is at least 97% identical to a 18S or ITS rDNA sequence set forth in SEQ ID NO: 1-233 from Table 4;

(b) a genome comprising a functional expression sequence selected from at least about 30% identical to a functional expression sequence selected from Table 5 or Table 6; or (c) a metabolic signature or functionality selected from Table 5 or Table 7; and (iii) a pharmaceutically acceptable delivery vehicle.

In certain aspects, disclosed herein are pharmaceutical compositions comprising a population of viable microbes, comprising:

(i) a first microbial entity comprising a first bacterial species comprising:

(a) an 16S rDNA sequence that is at least 97% identical to a 16S rDNA sequence set forth in SEQ ID NO: 1-233 from Table 4;

(b) a first genome; wherein the first genome comprises at least one functional expression sequence at least about 30% identical to a functional expression sequence selected from Table 5 or Table 6; or (c) a bacterial species capable of producing an enzyme having an amino acid sequence at least 60% identical to an enzyme selected from Table 5 or Table 6 or an enzyme capable of acting on the same substrate as an enzyme having an amino acid sequence at least 60% identical to an enzyme selected from Table 5 or Table 6;

(ii) a second microbial entity comprising a first fungal species comprising an 18S or ITS rDNA sequence that is at least 97% identical to a 18S or ITS rDNA sequence set forth in SEQ ID NO: 1-233 from Table 4; and (iii) a pharmaceutically acceptable delivery vehicle.

In certain aspects, disclosed herein are pharmaceutical compositions comprising a population of viable microbes, comprising:

(i) a first microbial entity comprising a first bacterial species comprising:

(a) an 16S rDNA sequence that is at least 97% identical to a 16S rDNA sequence set forth in SEQ ID NO: 1-233 from Table 4;

(b) a first genome; wherein the first genome comprises at least one functional expression sequence at least about 30% identical to a functional expression sequence selected from Table 5 or Table 6; or (c) a bacterial species capable of producing an enzyme having an amino acid sequence at least 60% identical to an enzyme selected from Table 5 or Table 6 or an enzyme capable of acting on the same substrate as an enzyme having an amino acid sequence at least 60% identical to an enzyme selected from Table 5 or Table 6;

(ii) a second microbial entity comprising a first fungal species comprising a genome comprising a functional expression sequence selected from at least about 30% identical to a functional expression sequence selected from Table 5 or Table 6; and (iii) a pharmaceutically acceptable delivery vehicle.

In certain aspects, disclosed herein are pharmaceutical compositions comprising a population of viable microbes, comprising:

(i) a first microbial entity comprising a first bacterial species comprising:

(a) an 16S rDNA sequence that is at least 97% identical to a 16S rDNA sequence set forth in SEQ ID NO: 1-233 from Table 4;

(b) a first genome; wherein the first genome comprises at least one functional expression sequence at least about 30% identical to a functional expression sequence selected from Table 5 or Table 6; or (c) a bacterial species capable of producing an enzyme having an amino acid sequence at least 60% identical to an enzyme selected from Table 5 or Table 6 or an enzyme capable of acting on the same substrate as an enzyme having an amino acid sequence at least 60% identical to an enzyme selected from Table 5 or Table 6;

(ii) a second microbial entity comprising a first fungal species comprising a metabolic signature or functionality selected from Table 5 or Table 7; and (iii) a pharmaceutically acceptable delivery vehicle.

In certain aspects, disclosed herein are pharmaceutical compositions comprising a population of viable microbes, comprising:

(i) first microbial entity comprising a first bacterial species comprising a 16S rDNA sequence that is at least 97% identical to a 16S rDNA sequence set forth in SEQ ID NO: 1-233 from Table 4;

(ii) a second microbial entity comprising a first fungal species comprising an 18S or ITS rDNA sequence that is at least 97% identical to a 18S or ITS rDNA sequence set forth in SEQ ID NO: 1-233 from Table 4; and (iii) a pharmaceutically acceptable delivery vehicle.

In certain aspects, disclosed herein are pharmaceutical compositions comprising a functional population of viable microbes, comprising:

(i) a first microbial entity comprising a first bacterial species comprising a first genome; wherein the first genome comprises at least one functional expression sequence at least about 30% identical to a functional expression sequence selected from Table 5 or Table 6.

(ii) a second microbial entity comprising a first fungal species comprising a genome comprising a functional expression sequence selected from at least about 30% identical to a functional expression sequence selected from Table 5 or Table 6; and (iii) a pharmaceutically acceptable delivery vehicle.

In certain aspects, disclosed herein are pharmaceutical compositions comprising a functional population of viable microbes, comprising:

(i) a first microbial entity comprising a first bacterial species capable of producing an enzyme having an amino acid sequence at least 60% identical to an enzyme selected from Table 5 or Table 6 or an enzyme capable of acting on the same substrate as an enzyme having an amino acid sequence at least 60% identical to an enzyme selected from Table 5 or Table 6;

(ii) a second microbial entity comprising a first fungal species comprising a metabolic signature or functionality selected from Table 5 or Table 7; and (iii) a pharmaceutically acceptable delivery vehicle.

In certain aspects, disclosed herein are pharmaceutical compositions comprising a population of viable microbes, comprising:

(i) a first and second microbial entity, wherein each microbial entity comprises a bacterial species, each species comprising:

(a) an 16S rDNA sequence that is at least 97% identical to a 16S rDNA sequence set forth in SEQ ID NO: 1-233 from Table 4;

(b) a first genome; wherein the first genome comprises at least one functional expression sequence at least about 30% identical to a functional expression sequence selected from Table 5 or Table 6; or (c) a bacterial species capable of producing an enzyme having an amino acid sequence at least 60% identical to an enzyme selected from Table 5 or an enzyme capable of acting on the same substrate as an enzyme having an amino acid sequence at least 60% identical to an enzyme selected from Table 5 or Table 6; and (ii) a pharmaceutically acceptable delivery vehicle.

In certain aspects, disclosed herein are pharmaceutical compositions comprising a population of viable microbes, comprising:

(i) a first and second microbial entity, wherein each microbial entity comprises a fungal species, each species comprising:

(a) an 18S or ITS rDNA sequence that is at least 97% identical to a 18S or ITS rDNA sequence set forth in SEQ ID NO: 1-233 from Table 4;

(b) a genome comprising a functional expression sequence selected from at least about 30% identical to a functional expression sequence selected from Table 5 or Table 6; or (c) a metabolic signature or functionality selected from Table 5 or Table 7; and (ii) a pharmaceutically acceptable delivery vehicle.

In certain embodiments, the first bacterial species comprises a 16S rDNA sequence that is at least 97.5%, at least 98%, at least 98.5%, at least 99%, at least 99.5%, or 100% identical to the 16S rDNA sequence set forth in SEQ ID NO: 1-233 from Table 4. In certain embodiments, the first fungal species comprises an 18S or ITS rDNA sequence that is at least 97.5%, at least 98%, at least 98.5%, at least 99%, at least 99.5%, or 100% identical to the 18S or ITS rDNA sequence set forth in SEQ ID NO: 1-233 from Table 4. In certain embodiments, the functional expression sequence comprises an amino acid sequence selected from Table 5 or Table 6. In certain embodiments, the functional expression sequence comprises an mRNA sequence which encodes an amino acid sequence selected from Table 5 or Table 6. In certain embodiments, the first genome comprises at least one functional expression sequence at least 60% identical to a functional expression sequence selected from Table 5 or Table 6. In certain embodiments, the second genome comprises at least one functional expression sequence at least 60% identical to a functional expression sequence selected from Table 5 or Table 6. In certain embodiments, the first bacterial species comprises one or more features selected from the group consisting of:

(i) capable of engrafting when administered to a subject,
(ii) capable of having anti-inflammatory activity,
(iii) not capable of inducing pro-inflammatory activity,
(iv) capable of producing a secondary bile acid,
(v) capable of producing a tryptophan metabolite,
(vi) capable of restoring epithelial integrity as determined by a primary epithelial cell monolayer barrier integrity assay,
(vii) capable of being associated with remission of an inflammatory bowel disease,
(viii) capable of producing a short-chain fatty acid,
(ix) capable of inhibiting a Histone Deacetylase (HDAC) activity,
(x) capable of producing a medium-chain fatty acid,
(xi) capable of expressing catalase activity,
(xii) capable of having alpha-fucosidase activity,
(xiii) capable of inducing Wingless-Type MMTV Integration Site Family (Wnt) activation,
(xiv) capable of producing a B vitamin,
(xv) capable of modulating host metabolism of endocannabinoid,
(xvi) capable of producing a polyamine and/or modulating a host metabolism of a polyamine,
(xvii) capable of reducing fecal levels of a sphingolipid,
(xviii) capable of modulating host production of kynurenine,
(xix) capable of reducing fecal calprotectin level,
(xx) not capable of activating a toll-like receptor pathway,
(xxi) capable of activating a toll-like receptor pathway,
(xxii) not capable of producing ursodeoxycholic acid,
(xxiii) capable of not being associated with clinical non-remission of an inflammatory bowel disease,
(xxiv) capable of inhibiting apoptosis of intestinal epithelial cells,
(xxv) capable of inducing an increased anti-inflammatory interleukin (IL)-10/IL-6 cytokine ratio in macrophages, (xxvi) capable of not inducing pro-inflammatory IL-6, Tumor Necrosis Factor alpha (TNFα), IL-1b, IL-23 or IL-12 production or gene expression in macrophages,
(xxvii) capable of downmodulating one or more genes induced in Interferon Gamma (IFN-γ) treated colonic organoids,
(xxix) capable of producing IL-18,
(xxx) capable of inducing the activation of antigen presenting cells,
(xxxi) capable of reducing the expression of one or more inhibitory receptors on T cells,
(xxxii) capable of increasing expression of one or more genes/proteins associated with T cell activation and/or function,
(xxxiii) capable of enhancing the ability of CD8+ T cells to kill tumor cells, (xxxiv) capable of enhancing the efficacy of an immune checkpoint inhibitor therapy,
(xxxv) capable of reducing colonic inflammation,
(xxxvi) capable of promoting the recruitment of CD8+ T cells to tumors
(xxxvii) capable of promoting the production of T-regulatory cells, and.
(xxxviii) combinations thereof.

In certain embodiments, the not activating a toll-like receptor (TLR) pathway comprises no activation of TLR4 or TLR5. In certain embodiments, the activating a toll-like receptor pathway comprises activation of TLR2. In certain embodiments, the one or more genes induced in IFN-γ treated colonic organoids, is selected from genes associated with inflammatory chemokine signaling, Nuclear Factor Kappa B (NF-κB) signaling, Tumor Necrosis Factor (TNF) family signaling, type I interferon signaling, type II interferon signaling, TLR signaling, lymphocyte trafficking, Th17 cell differentiation, Th1 differentiation, Th2 differentiation, apoptosis, inflammasomes, autophagy, oxidative stress, Major Histocompatability Complex (MHC) class I and II antigen presentation, complement, Mechanistic Target of Rapamycin Kinase (mTor), nod-like receptor signaling, Phosphatidylinositol-4,5-Bisphosphate 3-Kinase (PI3K) signaling, and combinations thereof. In certain embodiments, the one or more inhibitory receptors on T cells is selected from T Cell Immunoreceptor With Ig And ITIM Domains (TIGIT), T-Cell Immunoglobulin Mucin Receptor 3 (TIM-3), Lymphocyte Activating 3 (LAG-3), and combinations thereof. In certain embodiments, the one or more genes or proteins associated with T cell activation and/or function is selected from Protein Tyrosine Phosphatase Receptor Type C (PTPRC/CD45RO), Early T-Cell Activation Antigen P60 (CD69), IL-24, TNF-α, perforin, IFN-γ, and combinations thereof.

In certain embodiments, the first bacterial species is capable of producing indole-containing compounds. In certain embodiments, the indole containing compound is selected from indole, indole acetic acid (IAA), and indole propionic acid (IPA). In certain embodiments, the first bacterial species is capable of producing bacteriocins and antibacterial peptides. In certain embodiments, the first bacterial species is capable of producing neurotransmitters selected from serotonin, gamma-aminobutyric acid (GABA), dopamine, melatonin, and combinations thereof. In certain embodiments, the first bacterial species is capable of inducing the production of IFNγ, IL-12, TNF-α, IL-17, IL-6, or combinations thereof. In certain embodiments, the first bacterial species is capable of producing a biosurfactant that reduces pro-inflammatory cytokines. In certain embodiments, the first bacterial species metabolizes human produced primary bile acids into secondary bile acids. In certain embodiments, the primary bile acid is cholic acid, chenodeoxycholic acid, or combinations thereof. In certain embodiments, the secondary bile acid inhibits Farnesoid X-Activated Receptor (NR1H4/FXR) and/or activates G Protein-Coupled Bile Acid Receptor 1 (GPBAR1/TGR5). In certain embodiments, the first bacterial species produces more omega-3 fatty acids compared to omega-6 fatty acids.

In certain embodiments, the first bacterial species comprises one or more bacteria that are capable of producing a metabolite selected from Table 5 or Table 7. In certain embodiments, the first fungal species comprises one or more fungi that are capable of producing a metabolite selected from Table 5 or Table 7. In certain embodiments, the first fungal species utilizes a metabolite produced by the first bacterial species. In certain embodiments, the first fungal species utilizes a metabolite selected from Table 5 or Table 7. In certain embodiments, the pharmaceutical composition further comprises a metabolite selected from Table 5 or Table 7. In certain embodiments, the pharmaceutical composition further comprises a metabolite produced by the first bacterial entity, produced by the first fungal entity, or combinations thereof.

In certain embodiments, the composition includes a prebiotic fiber. In certain embodiments, the pharmaceutically acceptable delivery vehicle comprises an excipient or carbon source. In certain embodiments, the pharmaceutically acceptable delivery vehicle is present at an amount of 50% or less by weight.

In certain embodiments, the pharmaceutical composition is formulated in an oral administration form comprising between $1 \times 10^6$ and $1 \times 10^{12}$ cfu/dose of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production at least one anti-inflammatory metabolite by either the first microbial entity, the second microbial entity or both the first and the second microbial entities. In certain embodiments, administering an effective dose of the pharmaceutical composition to a human subject reduces the level and/or activity of at least one inflammatory cytokine from Table 8 relative to a level and/or activity of the inflammatory cytokine in the serum of the human subject; or a tissue of the subject, prior to administering the pharmaceutical composition to the subject.

In certain embodiments, administering an effective dose of the pharmaceutical composition to a human subject treats, prevents, or reduces the severity of at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, or combinations thereof. In certain embodiments, the human subject has an altered Th17 activity, In certain embodiments, administering an effective dose of the pharmaceutical composition to a human subject treats, prevents, or reduces the severity of at least one symptom in the subject of a rheumatic disease selected from rheumatoid arthritis, spondyloarthritis, and psoriasis.

In certain embodiments, administering an effective dose of the pharmaceutical composition to a human subject treats, prevents, or reduces the severity of at least one symptom in the subject of periodontal disease.

In certain embodiments, administering an effective dose of the pharmaceutical composition to a human subject treats, prevents, or reduces the severity of at least one symptom in the subject of gastritis. In certain embodiments, the gastritis is *H. pylori*-associated gastritis.

In certain embodiments, the pharmaceutical compositions described herein, comprise at least one additional microbial entity.

In certain aspects, described herein are medical foods comprising:
(i) a first microbial entity of the pharmaceutical compositions described herein;
(ii) a second microbial entity of the pharmaceutical compositions described herein; and
(iii) an excipient.

In certain embodiments, the medical food further comprises a metabolite selected from Table 5 or Table 7. In certain embodiments, the first microbial entity comprises one or more bacteria that are capable of producing a metabolite selected from Table 5 or Table 7. In certain embodiments, the first microbial entity comprises one or more fungi that are capable of producing a metabolite selected from Table 5 or Table 7. In certain embodiments, the first microbial entity utilizes a metabolite produced by the second microbial entity. In certain embodiments, the first microbial entity utilizes a metabolite selected from Table 5 or Table 7. In certain embodiments, the medical food further comprises a metabolite produced by the first microbial entity, produced by the second microbial entity, or combinations thereof.

In certain embodiments, the medical food further comprises a prebiotic fiber. In certain embodiments, the medical food further comprises at least one additional microbial entity.

In certain embodiments, the medical food is formulated in an oral administration form comprising between $1 \times 10^6$ and $1 \times 10^{12}$ cfu/administration of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production of at least one anti-inflammatory metabolite by either the first microbial entity, the second microbial entity or both the first and the second microbial entities. In certain embodiments, administering an effective amount of the medical food to a human subject reduces the level and/or activity of at least one inflammatory cytokine from Table 8 relative to a level and/or activity of the inflammatory cytokine in the serum of the human subject; or a tissue of the subject, prior to administering the medical food to the subject.

In certain embodiments, administering an effective amount of the medical food to a human subject enables the dietary management of at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, or combinations thereof. In certain embodiments, the human subject has an altered Th17 activity.

In certain embodiments, administering an effective amount of the medical food to a human subject enables the dietary management of at least one symptom in the subject of a rheumatic disease selected from rheumatoid arthritis, spondyloarthritis, and psoriasis.

In certain embodiments, administering an effective amount of the medical food to a human subject enables the dietary management of at least one symptom in the subject of periodontal disease.

In certain embodiments, administering an effective amount of the medical food to a human subject enables the dietary management of at least one symptom in the subject of gastritis. In certain embodiments, the gastritis is *H. pylori*-associated gastritis.

In certain aspects, described herein is a solid food stuff comprising:
(i) a first microbial entity of the pharmaceutical compositions described herein;
(ii) a second microbial entity of the pharmaceutical compositions described herein;
and
(iii) an excipient.

In certain embodiments, the solid food stuff further comprises a metabolite selected from Table 5 or Table 7. In certain embodiments, the solid stuff further comprises a metabolite produced by the first bacterial entity, produced by the first fungal entity, or combinations thereof. In certain embodiments, the solid food stuff further comprises a prebiotic fiber. In certain embodiments, the solid food stuff further comprises at least one additional microbial entity. In certain embodiments, the solid food stuff is formulated in an oral administration form comprising between $1 \times 10^6$ and $1 \times 10^{12}$ cfu/administration of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production at least one anti-inflammatory metabolite by either the first microbial entity, the second microbial entity, or both the first and the second microbial entities.

In certain embodiments, administering an effective amount of the solid food stuff to a human subject reduces the level and/or activity of at least one inflammatory cytokine from Table 8 relative to a level and/or activity of the inflammatory cytokine in the serum of the human subject; or a tissue of the subject, prior to administering the solid food stuff to the subject.

In certain embodiments, administering an effective amount of the solid food stuff to a human subject enables the dietary management of at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and combinations thereof. In certain embodiments, the human subject has an altered Th17 activity.

In certain embodiments, administering an effective amount of the solid food stuff to a human subject enables the dietary management of at least one symptom in the subject of a rheumatic disease selected from rheumatoid arthritis, spondyloarthritis, and psoriasis.

In certain embodiments, administering an effective amount of the solid food stuff to a human subject enables the dietary management of at least one symptom in the subject of periodontal disease.

In certain embodiments, administering an effective amount of the solid food stuff to a human enables the dietary management of at least one symptom in the subject of gastritis. In certain embodiments, the gastritis is *H. pylori*-associated gastritis.

In certain aspects, described herein are dietary supplements comprising:
(i) a first microbial entity of the pharmaceutical compositions described herein;
(ii) a second microbial entity of the pharmaceutical compositions described herein; and
(iii) an excipient.

In certain embodiments, the dietary supplement further comprises a metabolite selected from Table 5 or Table 7. In certain embodiments, the first microbial entity comprises one or more bacteria that are capable of producing a metabolite selected from Table 5 or Table 7. In certain embodiments, the first microbial entity comprises one or more fungi that are capable of producing a metabolite selected from Table 5 or Table 7. In certain embodiments, the first microbial entity utilizes a metabolite produced by the second microbial entity. In certain embodiments, the first microbial entity utilizes a metabolite selected from Table 5 or Table 7. In certain embodiments, the dietary supplement further comprises a metabolite produced by the first microbial entity, produced by the second microbial entity, or combinations thereof. In certain embodiments, the dietary supplement further comprises a prebiotic fiber. In certain embodiments, the dietary supplement further comprises at least one additional microbial entity. In certain embodiments, the dietary supplement is formulated in an oral administration form comprising between $1\times10^6$ and $1\times10^{12}$ cfu/dose of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production of at least one anti-inflammatory metabolite by either the first microbial entity, the second microbial entity or both the first and the second microbial entities. In certain embodiments, administering an effective amount of the dietary supplement to a human subject reduces the level and/or activity of at least one inflammatory cytokine from Table 8 relative to a level and/or activity of the inflammatory cytokine in the serum of the human subject; or a tissue of the subject, prior to administering the dietary supplement to the subject.

In certain embodiments, administering an effective amount of the dietary supplement to a human subject reduces and/or prevents at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, or combinations thereof. In certain embodiments, the human subject has an altered Th17 activity.

In certain embodiments, administering an effective amount of the dietary supplement to a human subject reduces and/or prevents at least one symptom in the subject of a rheumatic disease selected from rheumatoid arthritis, spondyloarthritis, and psoriasis.

In certain embodiments, administering an effective amount of the dietary supplement to a human subject reduces and/or prevents at least one symptom in the subject of periodontal disease.

In certain embodiments, administering an effective amount of the dietary supplement to a human subject reduces and/or prevents at least one symptom in the subject of gastritis. In certain embodiments, the gastritis is *H. pylori*-associated gastritis.

In certain embodiments of the pharmaceutical composition, medical food, dietary supplement, or nutritional food stuff described herein, the pharmaceutically acceptable delivery vehicle or excipient comprises a non-naturally occurring compound. In certain embodiments of the pharmaceutical composition, medical food, dietary supplement, or nutritional food stuff described herein, the first or second microbial entity exhibits at least one of mucoadherence or mammalian epithelial cell adherence. In certain embodiments, the pharmaceutical composition, medical food, dietary supplement, or nutritional food stuff described herein further comprises at tastant, a flavorant, a vitamin or mineral, an agriculturally-derived carbohydrate, an agriculturally-derived lipid, or combinations thereof. In certain embodiments, the pharmaceutical composition, medical food, dietary supplement, or nutritional food stuff described herein is in a solid, semi-solid, liquid, or gel state at room temperature. In certain embodiments, the pharmaceutical composition, medical food, dietary supplement, or nutritional food stuff described herein is formulated for administration as an infant formula, an elderly nutritional formula, a prenatal nutrition formula, an athletic performance formula, a ready-to-use therapeutic food formula, or an athletic recovery formula.

In certain aspects, described herein are methods comprising administering a pharmaceutical composition, medical food, dietary supplement, or solid food stuff described herein to a human subject. In certain aspects, described herein is a method of reducing the level and/or activity of at least one inflammatory cytokine from Table 8, comprising administering an effective amount to a human subject an effective amount of the pharmaceutical composition, medical food, dietary supplement or solid food stuff described herein. In certain embodiments, the level and/or activity of the at least one inflammatory cytokine from Table 8 is reduced in the serum or select tissue of the human subject after administration of the pharmaceutical composition, medical food, or solid food stuff compared to a level and/or activity of the at least one inflammatory cytokine from Table 8 prior to administration of the pharmaceutical composition, medical food, or solid food stuff In certain aspects, described herein are methods of treating, preventing or reducing the severity of at least one symptom of an immune system disorder, and/or enabling dietary management of at least one symptom of an immune system disorder, comprising administering to a human subject an effective amount of the pharmaceutical composition, medical food, dietary supplement or solid food stuff described herein. In certain embodiments, the immune system disorder is selected from the group consisting of allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and combinations thereof.

In certain aspects, described herein are methods of treating, preventing or reducing the severity of at least one symptom of a rheumatic disease, and/or enabling dietary management of at least one symptom of a rheumatic disease, selected from rheumatoid arthritis, spondyloarthritis, and psoriasis, comprising administering to a human subject an effective amount of the pharmaceutical composition, medical food, dietary supplement or solid food stuff described herein. In certain embodiments, the rheumatic disease is rheumatoid arthritis. In certain embodiments, the symptom of rheumatic disease is selected from synovial hyperplasia, articular cartilage damage, damage to the metaphyseal bone, or combinations thereof.

In certain aspects, described herein are methods of treating, preventing or reducing the severity of at least one symptom of periodontal disease, and/or enabling dietary management of at least one symptom of periodontal disease, comprising administering to a human subject an effective amount of the pharmaceutical composition, medical food, dietary supplement or solid food stuff described herein.

In certain aspects, described herein are methods of treating, preventing or reducing the severity of at least one symptom of gastritis, and/or enabling dietary management of at least one symptom of gastritis, comprising administering to a human subject an effective amount of the pharmaceutical composition, medical food, dietary supplement or solid food stuff described herein. In certain embodiments, the gastritis is *H. pylori*-associated gastritis.

In certain aspects, described herein are methods of treating, preventing or reducing the severity of at least one symptom of osteoarthritis, and/or enabling dietary management of at least one symptom of osteoarthritis comprising administering to a human subject an effective amount of the pharmaceutical composition, medical food, dietary supplement or solid food stuff described herein.

In certain aspects, described herein are methods of selecting a microbial entity for a pharmaceutical composition, medical food, dietary supplement, or solid foodstuff for treating, preventing, reducing the severity, and/or enabling dietary management of at least one symptom of an immune system disorder comprising a viable microbial population, the method comprising:
(i) providing a library of whole-genome or cDNA transcriptome sequences of microbial candidates of different species; and
(ii) generating a gene-of-interest database for orthologous genes-of-interest from the different species, wherein the gene-of-interest is selected from genes involved in the metabolism or biogenesis of short chain fatty acid (propionate and butyrate), indole (indole-3-acetic acid and indole propionic acid), Gamma-aminobutyric acid (GABA), surfactants (surfactin, nisin, fengycin, and iturin), dopamine, secondary bile acids, exopolysaccharide proteins (EPS), omega 3 fatty acids, and combinations thereof.

In certain aspects, described herein are methods of formulating a pharmaceutical composition, medical food, dietary supplement, or solid food stuff comprising a viable microbial population for treating, preventing, reducing the severity, and/or enabling dietary management of at least one symptom of an immune system disorder, the method comprising:
(i) selecting at least two microbial entity candidates of different species with immunomodulatory function; and
(ii) identifying genes-of-interest that indicate synergistic functions of the at least two microbial entities in silico using predictive modeling of libraries of whole-genome or cDNA transcriptome sequences of the microbial candidates of different species; and/or
(iii) culturing the at least two microbial entities in combination in vitro and detecting formation of an anti-inflammatory product.

In certain aspects, described herein are methods of formulating a pharmaceutical composition, medical food, dietary supplement, or solid food stuff comprising a viable microbial population for treating, preventing, reducing the severity, and/or enabling dietary management of at least one symptom of a rheumatic disease, the method comprising:
(i) selecting at least two microbial entity candidates of different species with immunomodulatory function; and
(ii) identifying genes-of-interest that indicate synergistic functions of the at least two microbial entities in silico using predictive modeling of libraries of whole-genome or cDNA transcriptome sequences of the microbial candidates of different species; and/or
(iii) culturing the at least two microbial entities in combination in vitro and detecting formation of an anti-inflammatory product.

In certain aspects, described herein are methods of formulating a pharmaceutical composition, medical food, dietary supplement or nutritional food stuff comprising a viable microbial population for treating, preventing, reducing the severity, and/or enabling dietary management of at least one symptom of a periodontal disease, the method comprising:
(i) selecting at least two microbial entity candidates of different species with immunomodulatory function; and
(ii) identifying genes-of-interest that indicate synergistic functions of the at least two microbial entities in silico using predictive modeling of libraries of whole-genome or cDNA transcriptome sequences of the microbial candidates of different species; and/or
(iii) culturing the at least two microbial entities in combination in vitro and detecting formation of an antimicrobial product.

In certain aspects, described herein are methods of formulating a pharmaceutical composition, medical food, dietary supplement or nutritional food stuff comprising a viable microbial population for treating, preventing, reducing the severity, and/or enabling dietary management of at least one symptom of gastritis, the method comprising:
(i) selecting at least two microbial entity candidates of different species with immunomodulatory function; and
(ii) identifying genes-of-interest that indicate synergistic functions of the at least two microbial entities in silico using predictive modeling of libraries of whole-genome or cDNA transcriptome sequences of the microbial candidates of different species; and/or
(iii) culturing the at least two microbial entities in combination in vitro and detecting formation of an anti-microbial and/or anti-inflammatory product. In certain embodiments, the gastritis is *H. pylori*-associated gastritis.

In certain aspects, described herein are methods of formulating a pharmaceutical composition, medical food, dietary supplement or nutritional food stuff comprising a viable microbial population for treating, preventing, reducing the severity, and/or enabling dietary management of at least one symptom of osteoarthritis, the method comprising:
(i) selecting at least two microbial entity candidates of different species with immunomodulatory function; and
(ii) identifying genes-of-interest that indicate synergistic functions of the at least two microbial entities in silico using predictive modeling of libraries of whole-genome or cDNA transcriptome sequences of the microbial candidates of different species; and/or (iii) culturing the at least two microbial entities in combination in vitro and detecting formation of an antimicrobial and/or anti-inflammatory product.

In certain aspects, described herein are methods of treating, preventing, or reducing the severity of at least one symptom of aging-associated inflammation, and/or enabling dietary management of at least one symptom of aging-associated inflammation in a human subject, the method comprising administering to the human subject an effective amount of the pharmaceutical composition, medical food, dietary supplement or solid food stuff described herein. In certain embodiments, the symptom of aging-associated inflammation is selected from the group consisting of frailty, chronic pain, sarcopenia, impaired mobility, walking speed, cognitive processing speed, and executive functioning.

In certain aspects, described herein are methods of modulating the level and/or activity of an inflammatory cytokine related to human aging in a human subject, comprising administering to the human subject an effective amount of the pharmaceutical composition, medical food, dietary supplement or solid food stuff described herein. In certain embodiments, the modulating the level and or activity of an inflammatory cytokine related to human aging, comprises reducing the level and/or activity of at least one inflammatory cytokine from Table 8. In certain embodiments, the level and/or activity of the at least one inflammatory cytokine from Table 8 is reduced in the serum or select tissue of the human subject after administration of the pharmaceutical composition, medical food, dietary supplement or solid food stuff compared to a level and/or activity of the at least one inflammatory cytokine from Table 8 prior to administration of the pharmaceutical composition, medical food, dietary supplement or solid food stuff. In certain embodiments, the inflammatory cytokine is selected from the group consisting of IFNγ, IL-12, TNF-α, IL-17, IL-6, IL-1β, IL-10, and combinations thereof. In certain embodiments, the level and/or activity of the at least one inflammatory cytokine related to human aging is reduced in the serum or select tissue of the human subject after the administration of the effective amount of the pharmaceutical composition, medical food, dietary supplement or solid food stuff In certain aspects, described herein are methods of reducing the level of at least one biomarker associated with aging-associated inflammation in a human subject, comprising administering to the human subject an effective amount of the pharmaceutical composition, medical food, dietary supplement or solid food stuff described herein. In certain embodiments, the at least one biomarker associated with aging-associated inflammation is selected from the group consisting of IL-6, TNF-α, TNF-α Receptor II (TNFRII), Growth Differentiating Factor 15 (GDF15), Cystatin-C, B-type Natriuretic peptides (BNP, NT-proBNP), C-Reactive Protein (CRP), C-X-C Motif Chemokine Ligand 10 (CXCL10), C-X3-C Motif Chemokine Ligand 1 (CX3CL1), Insulin Like Growth Factor (IGF) 1 (IGF-1), IGF binding proteins, Insulin, and Hemoglobin Subunit Alpha 1 (HbA1C). In certain embodiments, the level of the at least one biomarker associated with aging-associated inflammation is reduced in the serum or select tissue of the human subject after administration of the pharmaceutical composition, medical food, dietary supplement or solid food stuff compared to a level and/or activity of the at least one biomarker associated with aging-associated inflammation prior to administration of the pharmaceutical composition, medical food, dietary supplement or solid food stuff. In certain embodiments, the method results in reducing the severity of at least one symptom of aging-associated inflammation in the human subject; wherein the symptom of aging-associated inflammation is selected from the group consisting of frailty, chronic pain, sarcopenia, impaired mobility, walking speed, cognitive processing speed, and executive functioning.

In certain aspects, described herein are methods of improving immune health in a subject, the method comprising administering to the subject an effective amount of the pharmaceutical composition, medical food, dietary supplement or solid food stuff described herein. In certain embodiments, the method modulates the level and/or activity of an inflammatory cytokine in a subject. In certain embodiments, the modulating the level and or activity of an inflammatory cytokine, comprises reducing the level and/or activity of at least one inflammatory cytokine from Table 8. In certain embodiments, the level and/or activity of the at least one inflammatory cytokine from Table 8 is reduced in the serum or select tissue of subject after administration of the pharmaceutical composition, medical food, dietary supplement or solid food stuff compared to a level and/or activity of the at least one inflammatory cytokine from Table 8 prior to administration of the pharmaceutical composition, medical food, dietary supplement or solid food stuff. In certain embodiments, the inflammatory cytokine is selected from the group consisting of IFNγ, IL-12, TNF-α, IL-17, IL-6, IL-1β, IL-10, and combinations thereof. In certain embodiments, the level and/or activity of the at least one inflammatory cytokine in the serum or select tissue of a human subject after the administration of the effective amount of the pharmaceutical composition, medical food, dietary supplement or solid food stuff. In certain embodiments, the method causes an anti-inflammatory effect in the subject. In certain embodiments, the anti-inflammatory effect is caused by the production of at least one anti-inflammatory metabolite by either the first microbial entity, the second microbial entity or both the first and the second microbial entities. In certain embodiments, the method prevents, reduces the severity of, and/or enables the dietary management of an immune system disorder. In certain embodiments, the immune system disorder is selected from the group consisting of allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and combinations thereof.

In certain aspects, described herein are methods of selecting a microbial entity for a pharmaceutical composition, medical food, dietary supplement, or solid foodstuff comprising a viable microbial population for treating, preventing, reducing the severity, and/or enabling dietary management of at least one symptom of aging-associated inflammation in a human subject, modulating the level and/or activity of an inflammatory cytokine related to human aging in a human subject, and/or reducing the level of at least one biomarker associated with aging-associated inflammation in a human subject, the method comprising:
(i) providing a library of whole-genome or cDNA transcriptome sequences of microbial candidates of different species; and
(ii) generating a gene-of-interest database for orthologous genes-of-interest from the different species, wherein the gene-of-interest is selected from genes involved in the metabolism or biogenesis of short chain fatty acid (propionate and butyrate), indole (indole-3-acetic acid and indole propionic acid), Gamma-aminobutyric acid (GABA), surfactants (surfactin, nisin, fengycin, and iturin), dopamine, secondary bile acids, exopolysaccharide proteins (EPS), omega 3 fatty acids, and combinations thereof.

In certain aspects, described herein are methods of formulating a pharmaceutical composition, medical food, dietary supplement, or solid food stuff comprising a viable microbial population for treating, preventing, reducing the severity, and/or enabling dietary management of at least one symptom of aging-associated inflammation in human subject, modulating the level and/or activity of an inflammatory cytokine related to human aging in a human subject, and/or reducing the level of at least one biomarker associated with aging-associated inflammation in a human subject, the method comprising:
   (i) selecting at least two microbial entity candidates of different species with immunomodulatory function; and
   (ii) identifying genes-of-interest that indicate synergistic functions of the at least two microbial entities in silico using predictive modeling of libraries of whole-genome or cDNA transcriptome sequences of the microbial candidates of different species; and/or
   (iii) culturing the at least two microbial entities in combination in vitro and detecting formation of an anti-inflammatory product.

In certain aspects, disclosed herein are methods of improving immune health, comprising administering to a human subject an effective amount of a composition comprising viable microbes, comprising:
   (i) a first microbial entity comprising a first bacterial population comprising *Lactobacillus brevis*;
   (ii) a second microbial entity comprising a second bacterial population comprising *Lactococcus lactis*;
   (iii) a third microbial entity comprising a third bacterial population comprising *Bacillus velenzensis*; and.
   (iv) a fourth microbial entity comprising a fourth bacterial population comprising *Lactobacillus harbinensis*.

In certain aspects, disclosed herein are methods of improving immune health, comprising administering to a human subject an effective amount of a composition comprising:
   (i) a first microbial entity comprising a first bacterial species comprising a 16S rDNA sequence that is at least 97% identical to a 16S rDNA sequence set forth in SEQ ID NO: 43;
   (ii) a second microbial entity comprising a second bacterial species comprising a 16S rDNA sequence that is at least 97% identical to a 16S rDNA sequence set forth in SEQ ID NO: 224;
   (iii) a third microbial entity comprising a third bacterial species comprising a 16S rDNA sequence that is at least 97% identical to a 16S rDNA sequence set forth in SEQ ID NO: 221; and
   (iv) a fourth microbial entity comprising a fourth bacterial species comprising a 16S rDNA sequence that is at least 97% identical to a 16S rDNA sequence set forth in SEQ ID NO: 198.

In certain embodiments of any of the foregoing methods, the composition comprises a medical food, nutritional supplement or foodstuff. In certain embodiments of any of the foregoing methods, the composition comprises a pharmaceutical composition.

In certain embodiments of any of the foregoing methods, the viable microbes are plant-derived or food-derived. In certain embodiments, improving immune health comprises reducing inflammation in the human subject.

In certain aspects, described herein are methods of inhibiting inflammation in a human subject, the method comprising: administering to a human subject an effective amount of a composition comprising:
   (i) a first microbial entity comprising a first bacterial species comprising a 16S rDNA sequence that is at least 97% identical to a 16S rDNA sequence set forth in SEQ ID NO: 43;
   (ii) a second microbial entity comprising a second bacterial species comprising a 16S rDNA sequence that is at least 97% identical to an 16S rDNA sequence set forth in SEQ ID NO:224;
   (iii) a third microbial entity comprising a third bacterial species comprising a 16S rDNA sequence that is at least 97% identical to an 16S rDNA sequence set forth in SEQ ID NO: 221; and
   (iv) a fourth microbial entity comprising a fourth bacterial species comprising a 16S rDNA sequence that is at least 97% identical to an 16S rDNA sequence set forth in SEQ ID NO:198; wherein the human subject has lower circulating levels of at least one anti-inflammatory marker and/or higher circulating levels of at least one inflammation-associated marker.

In certain embodiments of any of the foregoing methods, the methods result higher circulating levels of at least one anti-inflammatory marker and/or lower circulating levels of at least one inflammation-associated marker in the human subject.

In certain embodiments of any of the foregoing methods, the composition is capable of producing neurotransmitters selected from the group consisting of serotonin, gamma-aminobutyric acid (GABA), dopamine, acetylcholine and combinations thereof. In certain embodiments, the composition is capable of modulating IFNγ, IL-12, TNF-α, IL-17, IL-6, IL-1β, IL-10 or combinations thereof in the human subject. In certain embodiments, at least one microbial entity comprises a first genome; wherein the first genome comprises at least one functional expression sequence at least about 30% identical to a functional expression sequence selected from Table 5 or Table 6. In certain embodiments, at least one microbial entity is capable of producing an enzyme having an amino acid sequence at least 60% identical to an enzyme selected from Table 5 or an enzyme capable of acting on the same substrate as an enzyme having an amino acid sequence at least 60% identical to an enzyme selected from Table 5 or Table 6. In certain embodiments, at least one microbial entity comprises a genus of bacteria with a metabolic signature or functionality selected from Table 5 or Table 7.

In certain embodiments of any of the foregoing methods, at least one microbial entity comprises one or more features selected from the group consisting of:
   (i) capable of engrafting when administered to a subject,
   (ii) capable of having anti-inflammatory activity,
   (iii) not capable of inducing pro-inflammatory activity,
   (iv) capable of producing a secondary bile acid,
   (v) capable of producing a tryptophan metabolite,
   (vi) capable of restoring epithelial integrity as determined by a primary epithelial cell monolayer barrier integrity assay,
   (vii) capable of being associated with remission of an inflammatory bowel disease,
   (viii) capable of producing a short-chain fatty acid,
   (ix) capable of inhibiting a histone deacetylase (HDAC) activity,
   (x) capable of producing a medium-chain fatty acid,
   (xi) capable of expressing catalase activity, (xii) capable of having alpha-fucosidase activity,
(xiii) capable of inducing Wnt activation,
(xiv) capable of producing a B vitamin,
(xv) capable of modulating host metabolism of endocannabinoid,
(xvi) capable of producing a polyamine and/or modulating a host metabolism of a polyamine,
(xvii) capable of reducing fecal levels of a sphingolipid,
(xviii) capable of modulating host production of kynurenine and/or capable of producing kynurenine,
(xix) capable of reducing fecal calprotectin level,
(xx) not capable of activating a pattern recognition receptor (PRR) pathway, and optionally, a toll-like receptor (TLR) pathway, a NACHT, LRR, and PYD domains-containing protein 3 (NLRP3) inflammasome pathway, or a C-type lectin receptor pathway and combinations thereof;
(xxi) capable of activating a PRR pathway, and optionally a TLR pathway, a NLRP3 pathway a C-type lectin receptor pathway, and combinations thereof;
(xxii) not capable of producing ursodeoxycholic acid,
(xxiii) capable of not being associated with clinical non-remission of an inflammatory bowel disease,
(xxiv) capable of inhibiting apoptosis of intestinal epithelial cells,
(xxv) capable of inducing an increased anti-inflammatory Interleukin(IL)-10/IL-6 cytokine ratio in macrophages,
(xxvi) capable of not inducing pro-inflammatory IL-6, Tumor Necrosis Factor Alpha (TNFα), IL-1β, IL-23 or IL-12 production or gene expression in macrophages,
(xxvii) capable of downmodulating one or more genes induced in Interferon gamma (IFN-γ) treated colonic organoids,
(xxix) capable of producing IL-18,
(xxx) capable of inducing the activation of antigen presenting cells,
(xxxi) capable of reducing the expression of one or more inhibitory receptors on T cells,
(xxxii) capable of increasing expression of one or more genes/proteins associated with T cell activation and/or function,
(xxxiii) capable of enhancing the ability of CD8+ T cells to kill tumor cells,
(xxxiv) capable of enhancing the efficacy of an immune checkpoint inhibitor therapy,
(xxxv) capable of reducing colonic inflammation,
(xxxvi) capable of promoting the recruitment of CD8+ T cells to tumors, and combinations thereof.
(xxxvii) capable of producing antioxidants, and optionally, flavonoids, terpenoids, acorbate and combinations thereof.

In certain embodiments, the not activating a toll-like receptor pathway comprises no activation of TLR4 or TLR5, and/or wherein the activating a toll-like receptor pathway comprises activation of TLR2. In certain embodiments, the one or more genes induced in IFN-γ treated colonic organoids, is selected from the group consisting of genes associated with inflammatory chemokine signaling, Nuclear Factor Kappa B (NF-κB) signaling, TNF family signaling, type I interferon signaling, type II interferon signaling, TLR signaling, lymphocyte trafficking, Th17 cell differentiation, Th1 differentiation, Th2 differentiation, apoptosis, inflammasomes, autophagy, oxidative stress, major histocompatibility (MHC) class I and II antigen presentation, complement, mTor, nod-like receptor signaling, Phosphatidylinositol-4,5-Bisphosphate 3-Kinase (PI3K) signaling, and combinations thereof. In certain embodiments, the one or more inhibitory receptors on T cells is selected from the group consisting of T Cell Immunoreceptor With Ig And ITIM Domains (TIGIT), T-Cell Immunoglobulin Mucin Family Member 3 (TIM-3), Lymphocyte Activating 3 (LAG-3), and combinations thereof. In certain embodiments, the one or more genes or proteins associated with T cell activation and/or function is selected from the group consisting of CD45RO, CD69, IL-24, TNF-α, perforin, IFN-γ, and combinations thereof. In certain embodiments, at least one microbial entity is capable of producing (a) one or more indole-containing compounds, optionally wherein the indole-containing compound is selected from the group consisting of indole, indole acetic acid (IAA), and indole propionic acid (IPA) and/or (b) bacteriocins and/or antibacterial peptides and/or (c) a biosurfactant that reduces pro-inflammatory cytokines. In certain embodiments, at least one microbial entity metabolizes human produced primary bile acids into secondary bile acids, optionally wherein the primary bile acid is cholic acid, chenodeoxycholic acid, or combinations thereof, and optionally wherein the secondary bile acid inhibits FXR and/or activates TGR5. In certain embodiments, at least one microbial entity produces more omega-3 fatty acids compared to omega-6 fatty acids. In certain embodiments, at least one microbial entity comprises one or more bacteria that are capable of producing a metabolite selected from Table 5 or Table 7. In certain embodiments, the composition further comprises a metabolite selected from Table 5 or Table 7. In certain embodiments, the composition further comprises a prebiotic fiber. In certain embodiments, the inhibition of inflammation in the subject is caused by the production at least one anti-inflammatory metabolite by at least one microbial entity. In certain embodiments, the method reduces the level and/or activity of at least one inflammatory cytokine from Table 8 relative to a level and/or activity of the inflammatory cytokine in the serum of the human subject; or a tissue of the subject, prior to administering the pharmaceutical composition, medical food, or food stuff. In certain embodiments, method comprises treating, preventing, reducing the severity, and/or enabling dietary management of at least one symptom of an immune system disorder. In certain embodiments, the immune system disorder is selected from the group consisting of allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and a rheumatic disease selected from spondyloarthritis, psoriasis and rheumatoid arthritis.

In certain embodiments, the methods described herein further comprise administering an effective amount of at least one immunosuppressive agent to the subject. In certain embodiments, at least one immunosuppressive agent is administered before, simultaneously with, or after the administration of the effective amount of the pharmaceutical composition, medical food, dietary supplement or solid food stuff described herein.

In certain embodiments, the methods described herein further comprise administering one or more additional agents for the treatment, prevention or management of one or more symptoms of rheumatic disease. In certain embodiments, the one or more additional agents for the treatment, prevention or management of one or more symptoms of rheumatic disease comprises methotrexate.

In certain embodiments, the methods described herein further comprise administering one or more additional agents for the treatment, prevention or management of one or more symptoms of periodontal disease.

In certain embodiments, the methods described herein further comprise administering one or more additional agents for the treatment, prevention or management of one or more symptoms of gastritis.

In certain embodiments, the methods described herein further comprise administering one or more additional agents for the treatment, prevention or management of one or more symptoms of osteoarthritis.

In certain embodiments, the methods described herein further comprise administering one or more additional agents for the treatment, prevention or management of one or more symptoms of aging-associated inflammation.

BRIEF DESCRIPTION OF THE SEVERAL VIEWS OF THE DRAWINGS

These and other features, aspects, and advantages of the present invention will become better understood with regard to the following description, and accompanying drawings, where:

FIG. 5A is a diagram of the metabolic pathways of secondary acids, specifically the deconjugation of Tauro-Cholic Acid (CA)/Glyco-CA and subsequent conversion to 12-dehydro-CA, UCA, and Iso-CA.

FIG. 5B is a diagram of the metabolic pathways of secondary acids, specifically the deconjugation of Tauro-Chenodeoxycholic acid (CDCA)/Glyco-CDCA and subsequent conversion to Ursodeoxycholic acid (UDCA).

FIG. 6 is a table listing the enzymes involved in the biosynthesis of EPS.

FIG. 7 is a table listing the essential genes in the *Lactobacillus* EPS gene clusters and families.

FIG. 32A-D are graphs depicting results of effects of DMA administration in combination with methotrexate on paw swelling and clinical scores in a collagen induced arthritis mouse model, using the experimental design described in FIG. 31. FIG. 32A and FIG. 32C depict arthritis clinical score in mice administered the indicated DMA with or without methotrexate (MTX). FIG. 32B and FIG. 32D depict limb thickness in mice administered the indicated DMA with or without methotrexate (MTX).

FIG. 33A depicts acetate production (04) of individual strains and DMA swaps. Error bars indicate SD (n=3). FIG. 33B depicts serotonin production by DMAs. FIG. 33C depicts IL-8 secretion of HT-29 epithelial cells stimulated with individual isolates or DMA swaps. Note the high levels of IL-8 elicited from the B. velezensis isolates, which is not recapitulated in the DMAs, despite containing this species. Data are represented as percent IL-8 secretion relative to an LPS agonist control. Error bars represent SEM (n=3-13). Significance was determined via One-way ANOVA. Outliers determined through ROUT method using Q=1%.

DETAILED DESCRIPTION

Definitions

Figure 1:
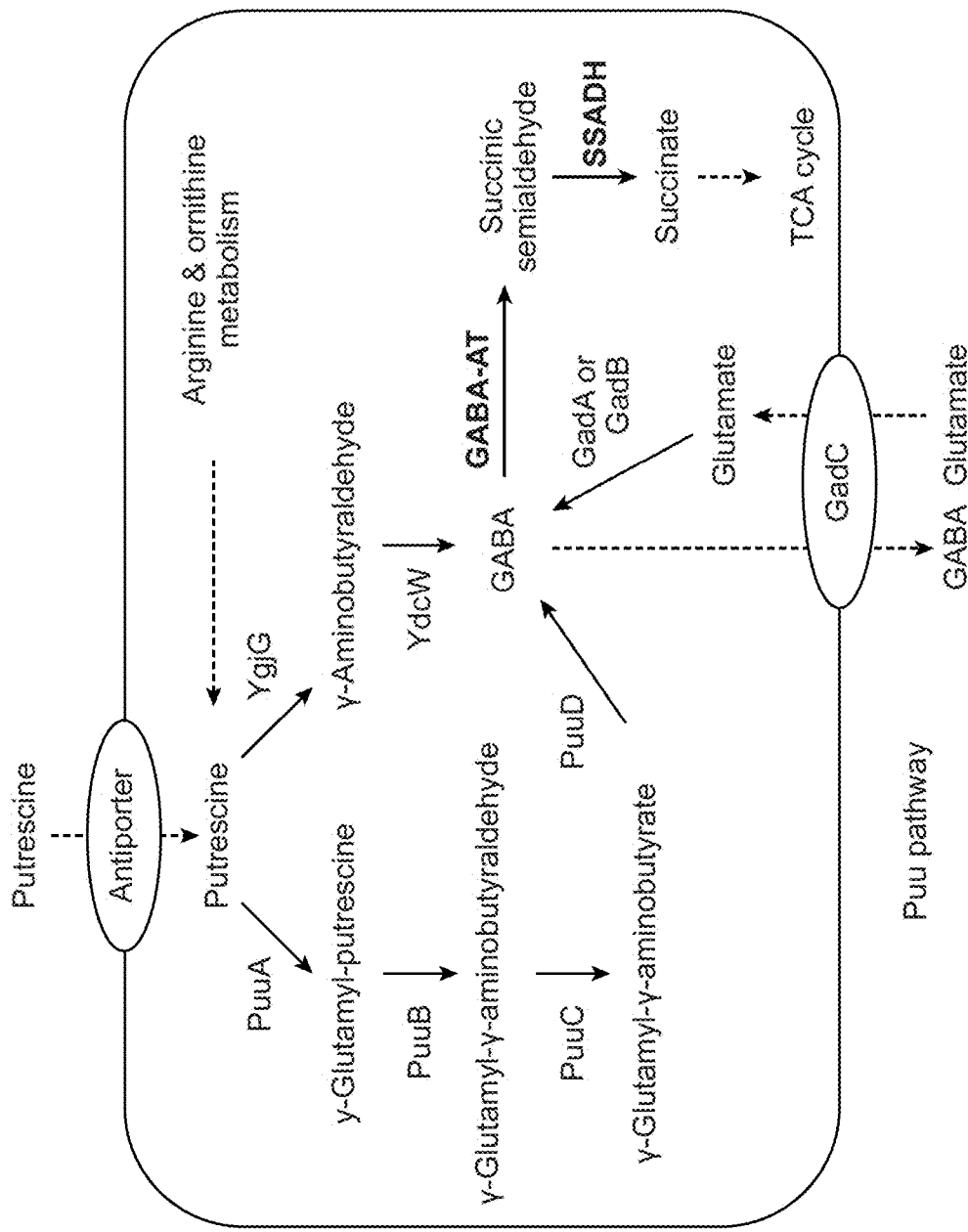
FIG. 1 is a diagram of the metabolic pathways involving Gamma aminobutyric acid (GABA).
Figure 2:
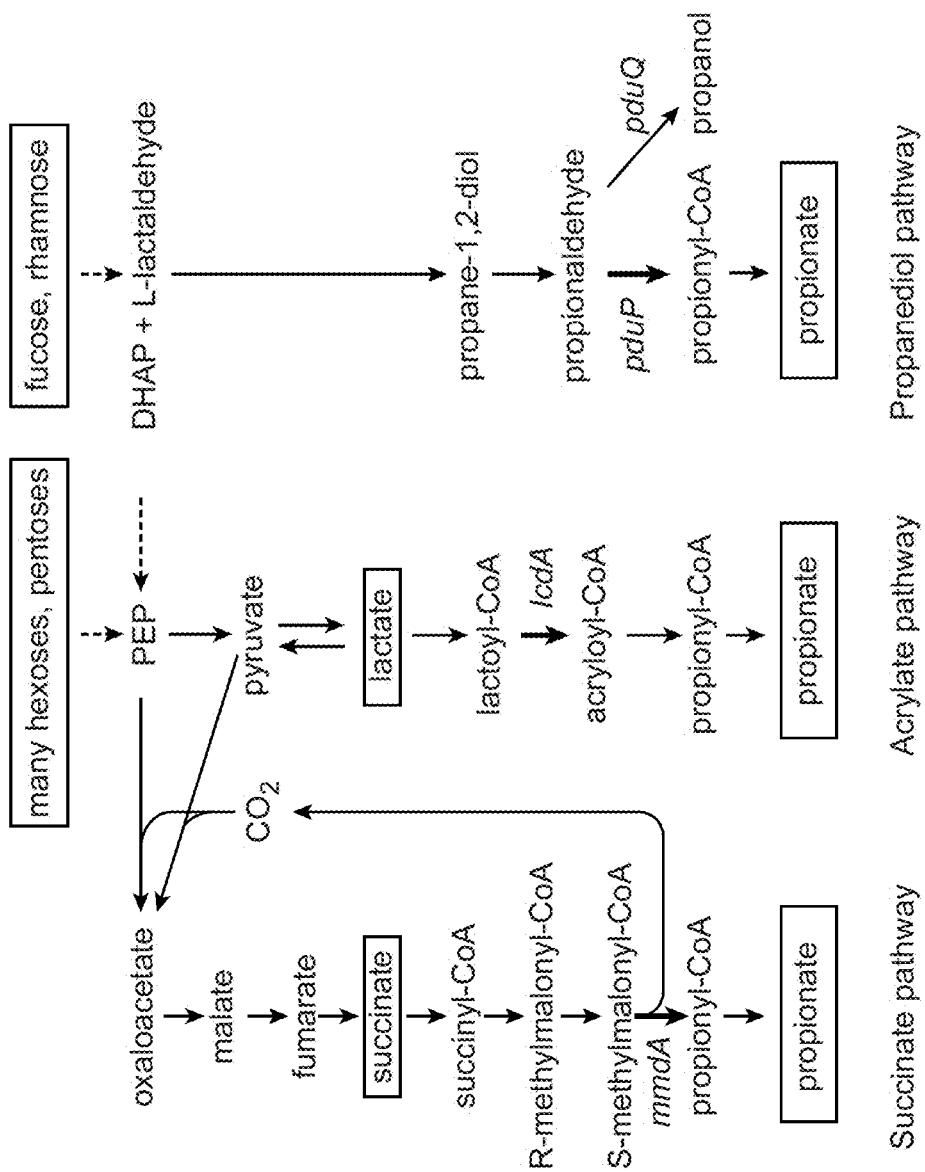
FIG. 2 is a diagram of the metabolic pathways of succinate, acrylate and propanediol.
Figure 3:
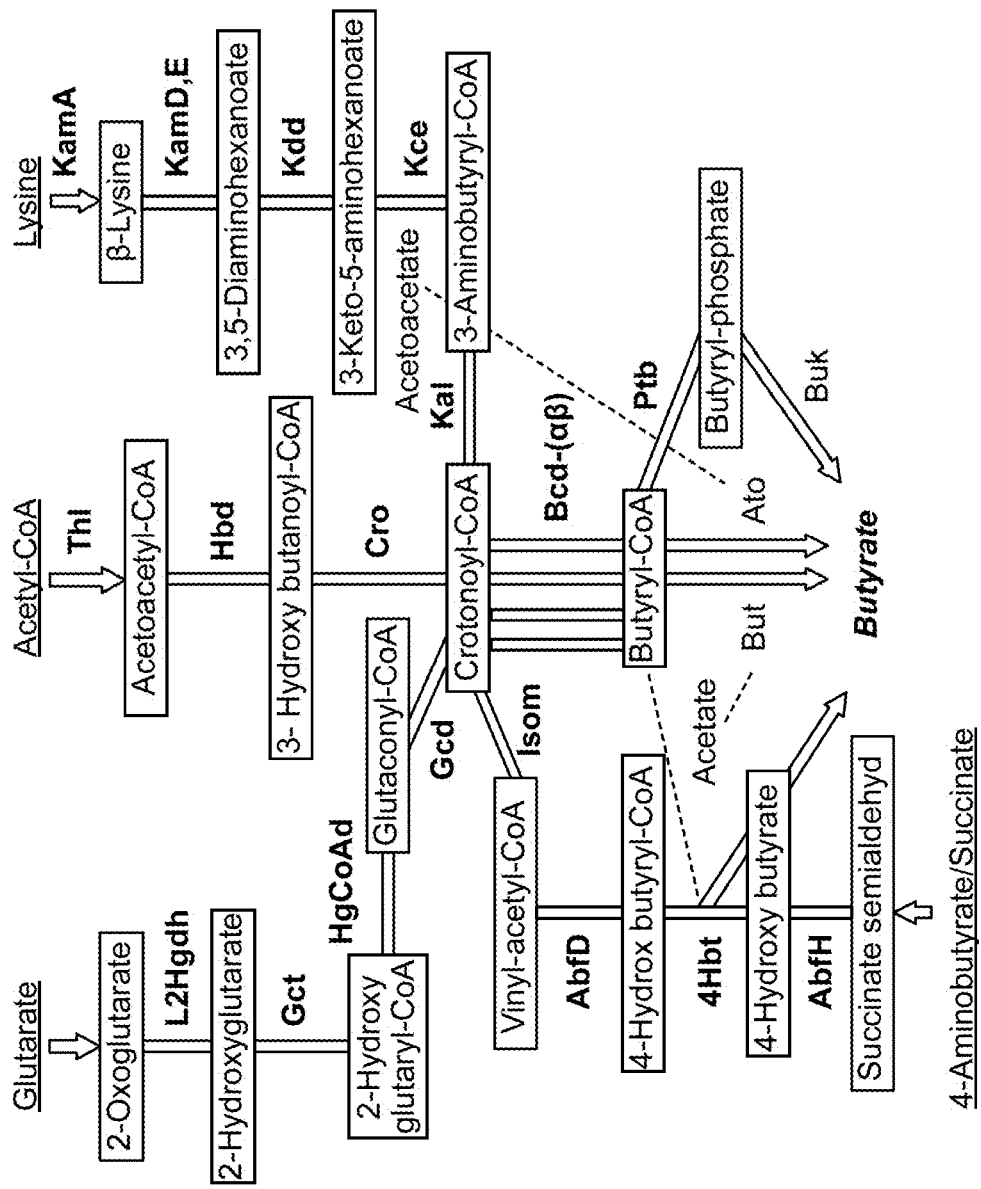
FIG. 3 is a diagram of the metabolic pathways of Butyrate.
Figure 4:
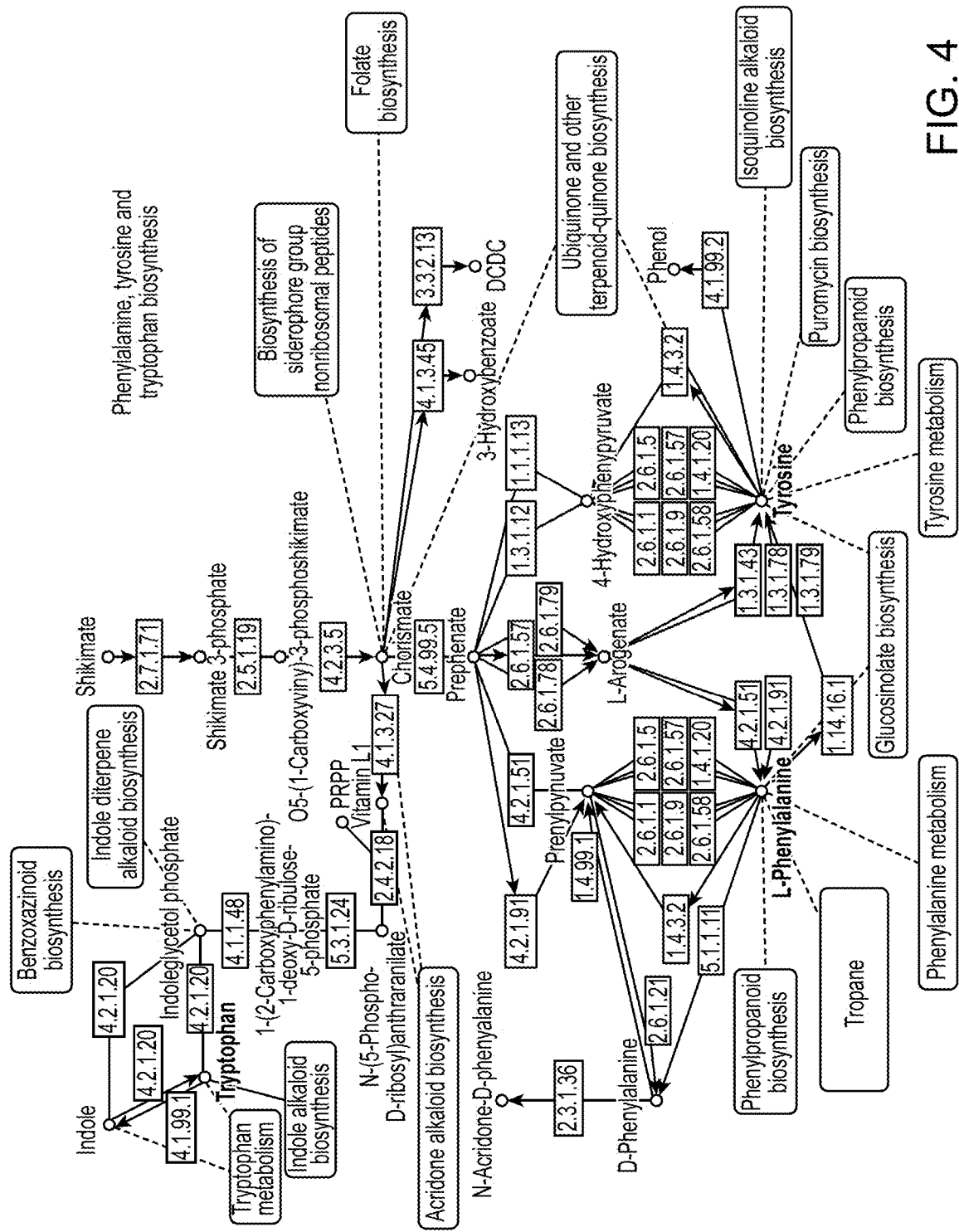
FIG. 4 is a diagram of the metabolic pathways of phenylalanine, tyrosine and tryptophan biosynthesis.
Figure 5C:
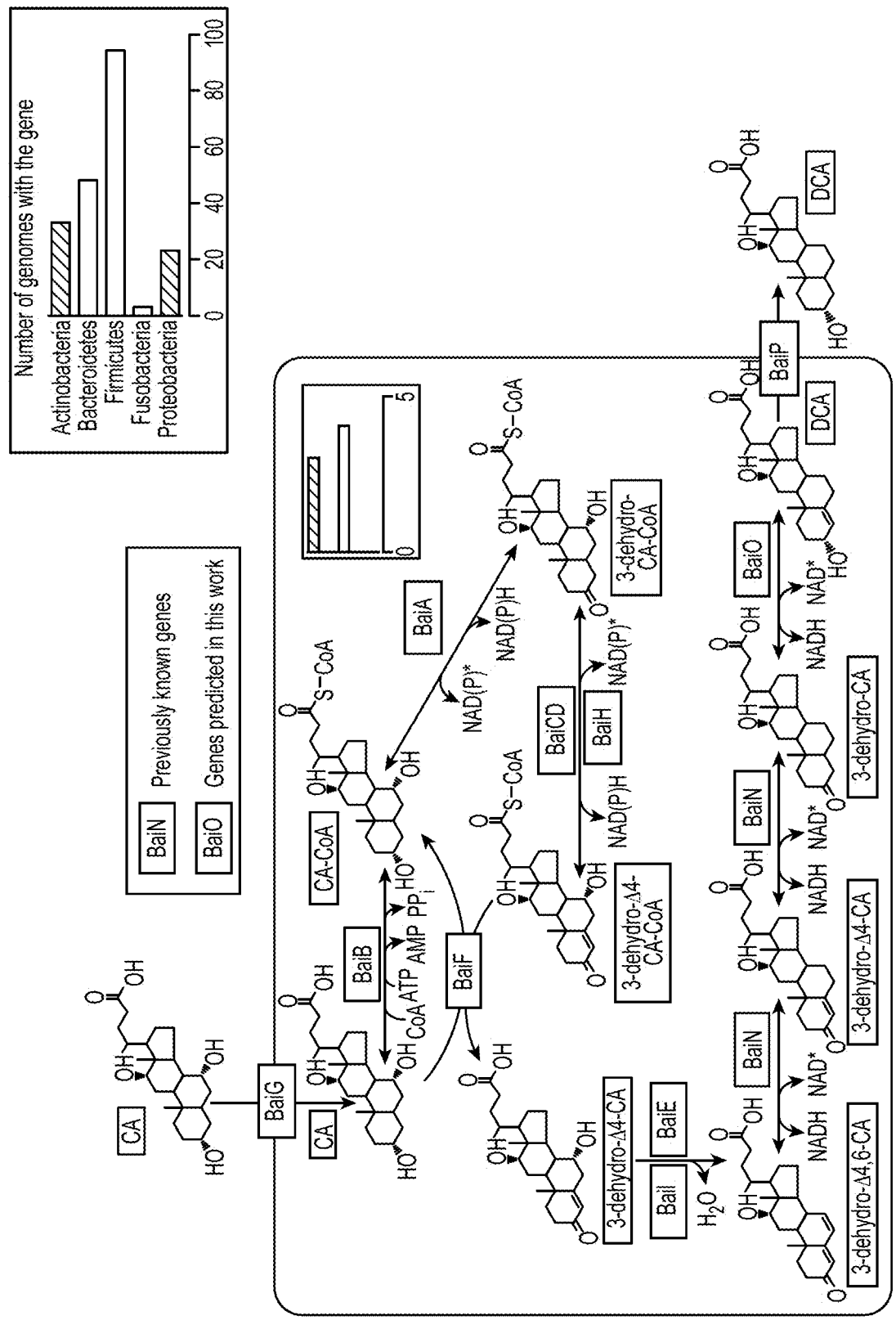
FIG. 5C is a diagram of the metabolic pathways of secondary acids, specifically the conversion of CA to Deoxycholic acid (DCA) via the bai pathway.
Figure 5D:
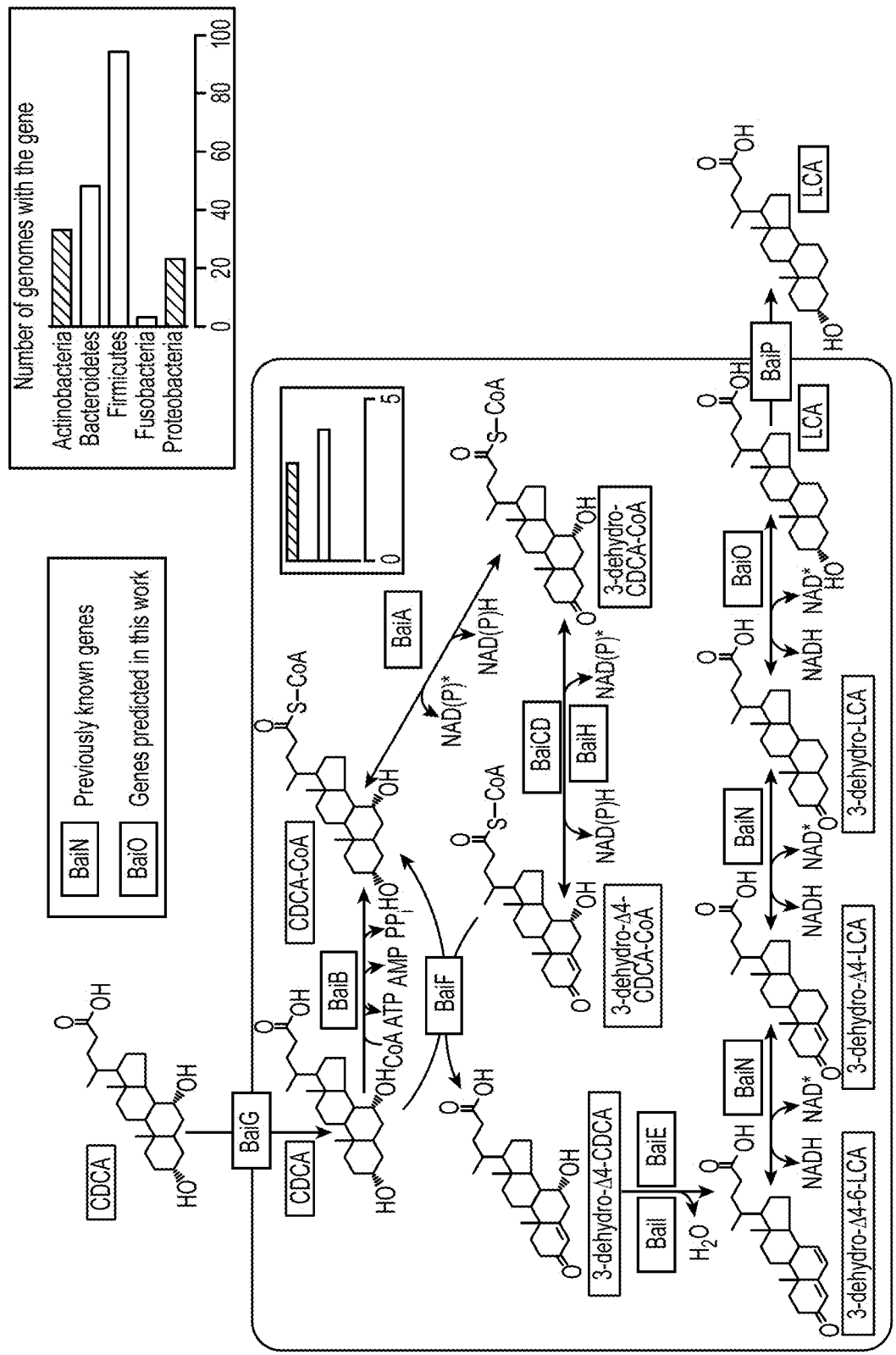
FIG. 5D is a diagram of the metabolic pathways of secondary acids, specifically the conversion of CDCA to Lithocholic acid (LCA) via the bai pathway.
Figure 5E:
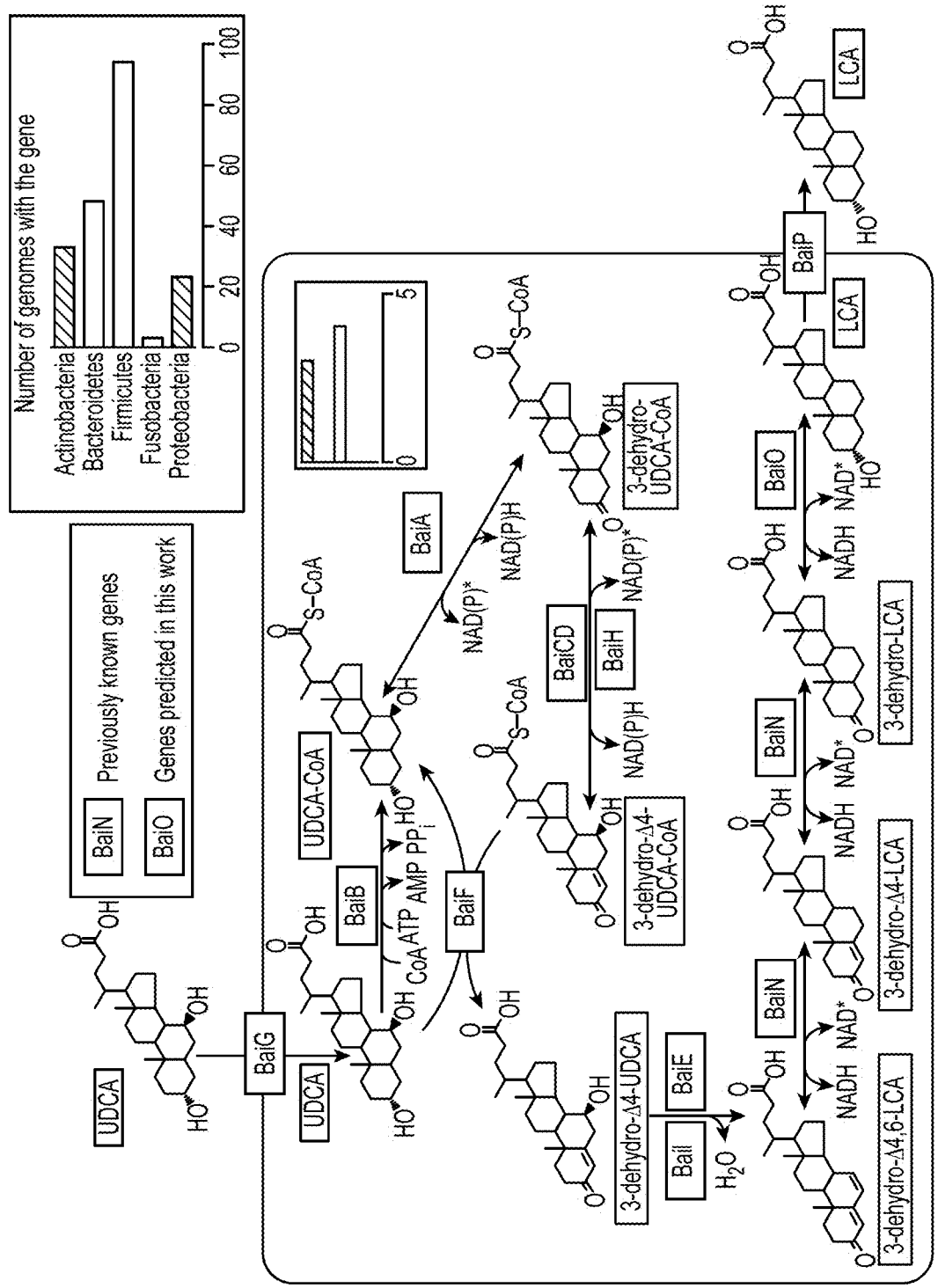
FIG. 5E is a diagram of the metabolic pathways of secondary acids, specifically the conversion of UDCA to Lithocholic acid (LCA) via the bai pathway.
Figure 8:
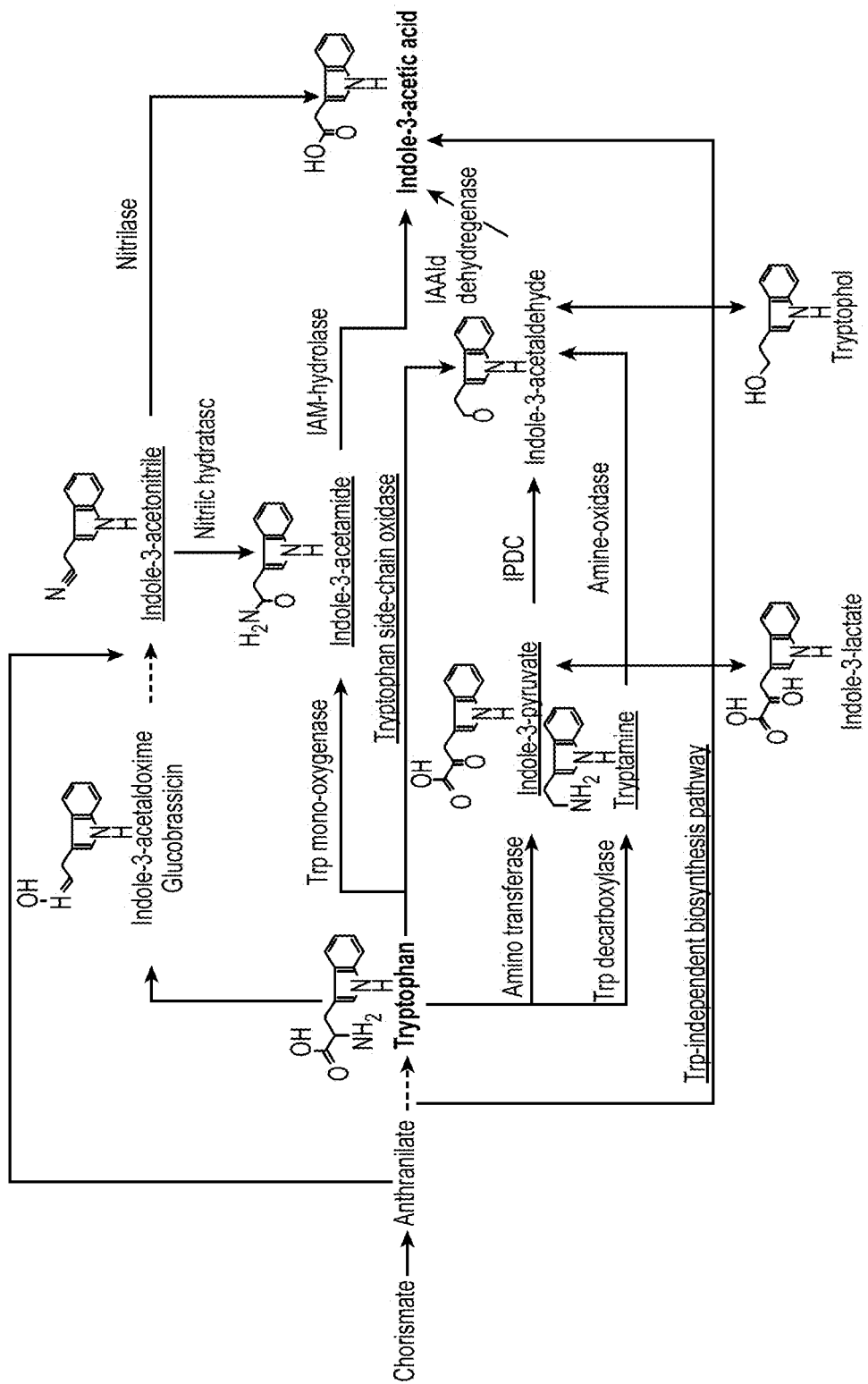
FIG. 8 is a diagram of the metabolic pathways of tryptophan and indole 3 acetic acid.
Figure 9:
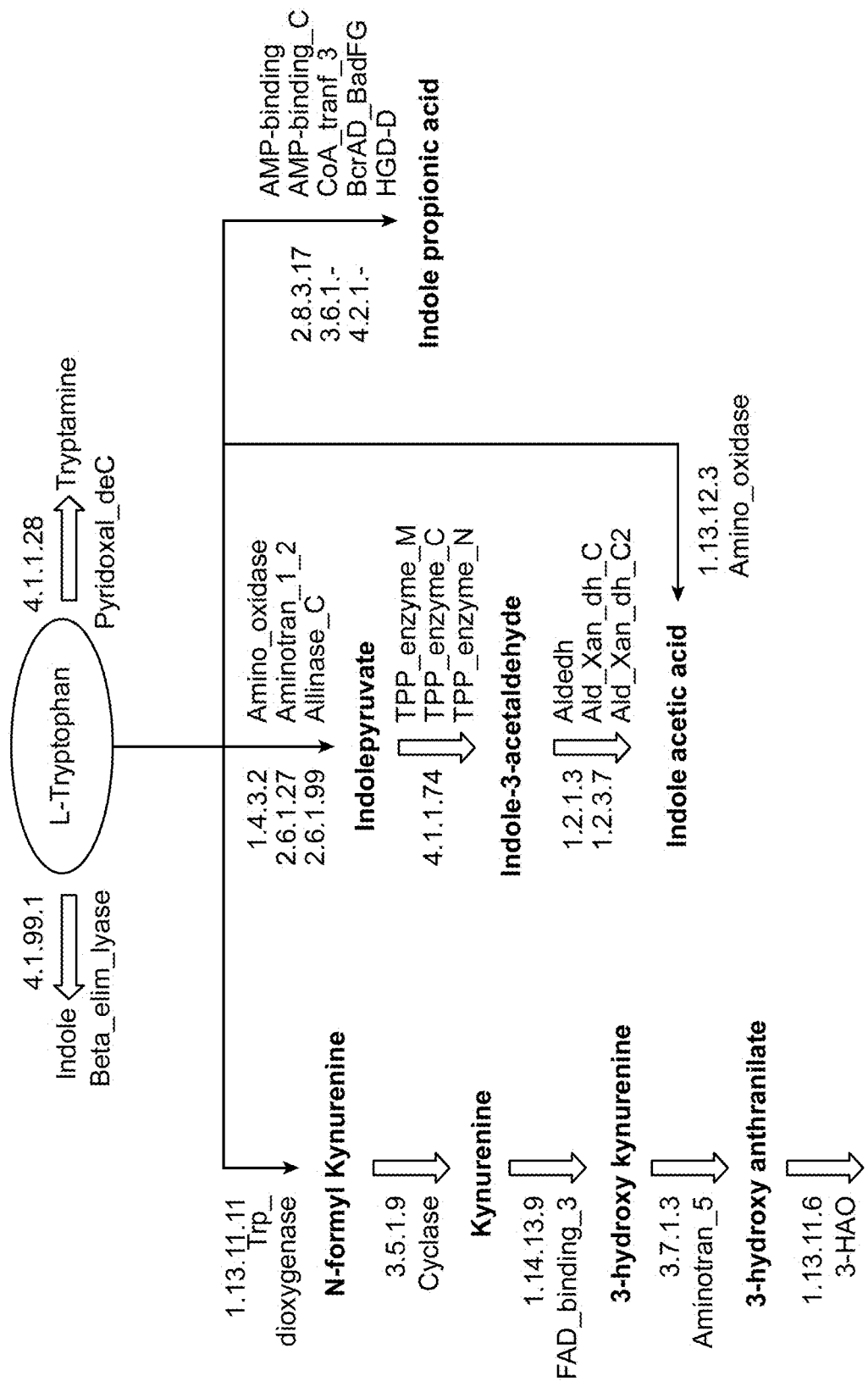
FIG. 9 is a diagram of the metabolic pathways of tryptophan and indole 3 acetic acid.
Figure 10:
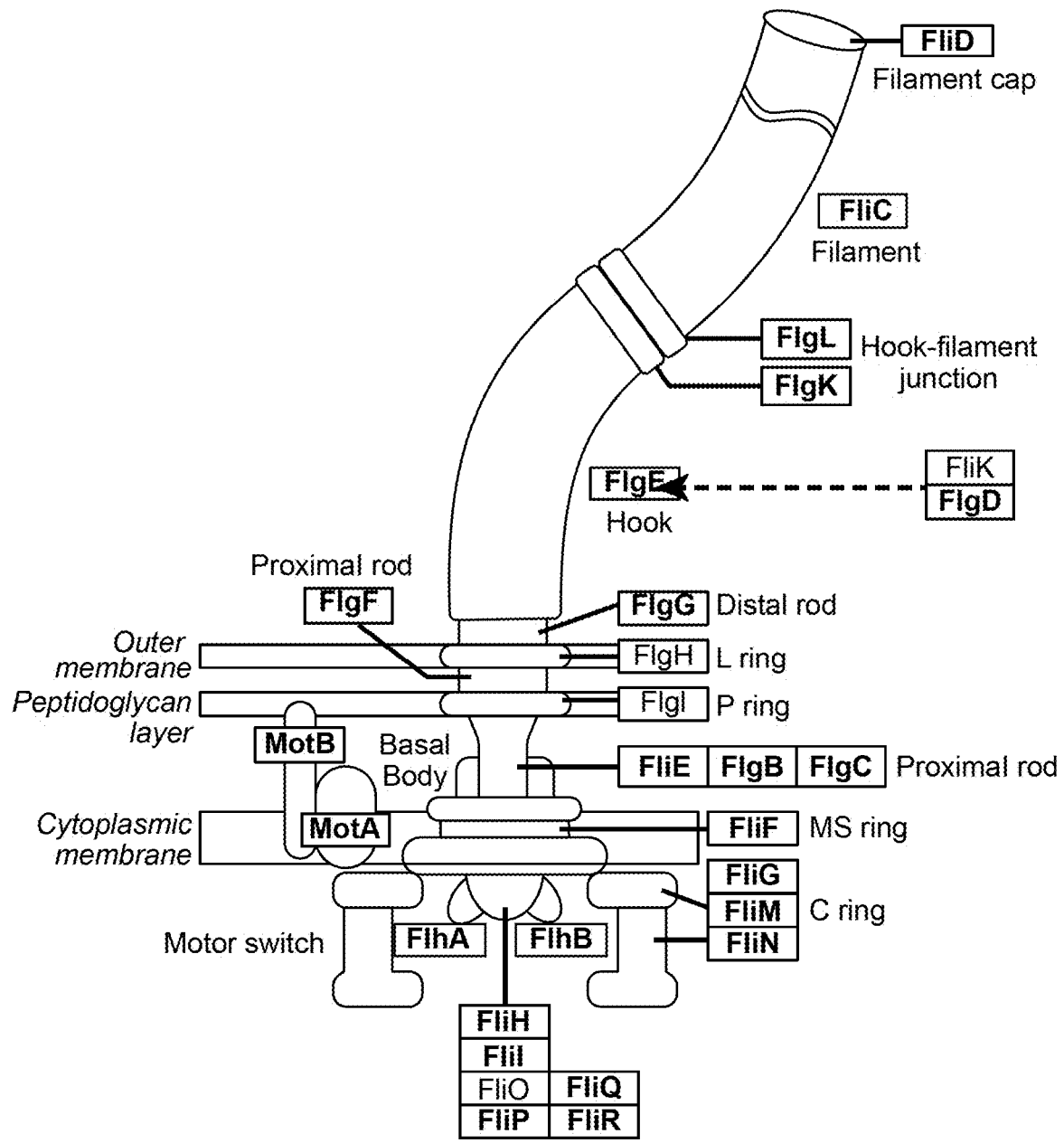
FIG. 10 is a diagram of the genes and proteins that comprise the flagellum.
Figure 11:
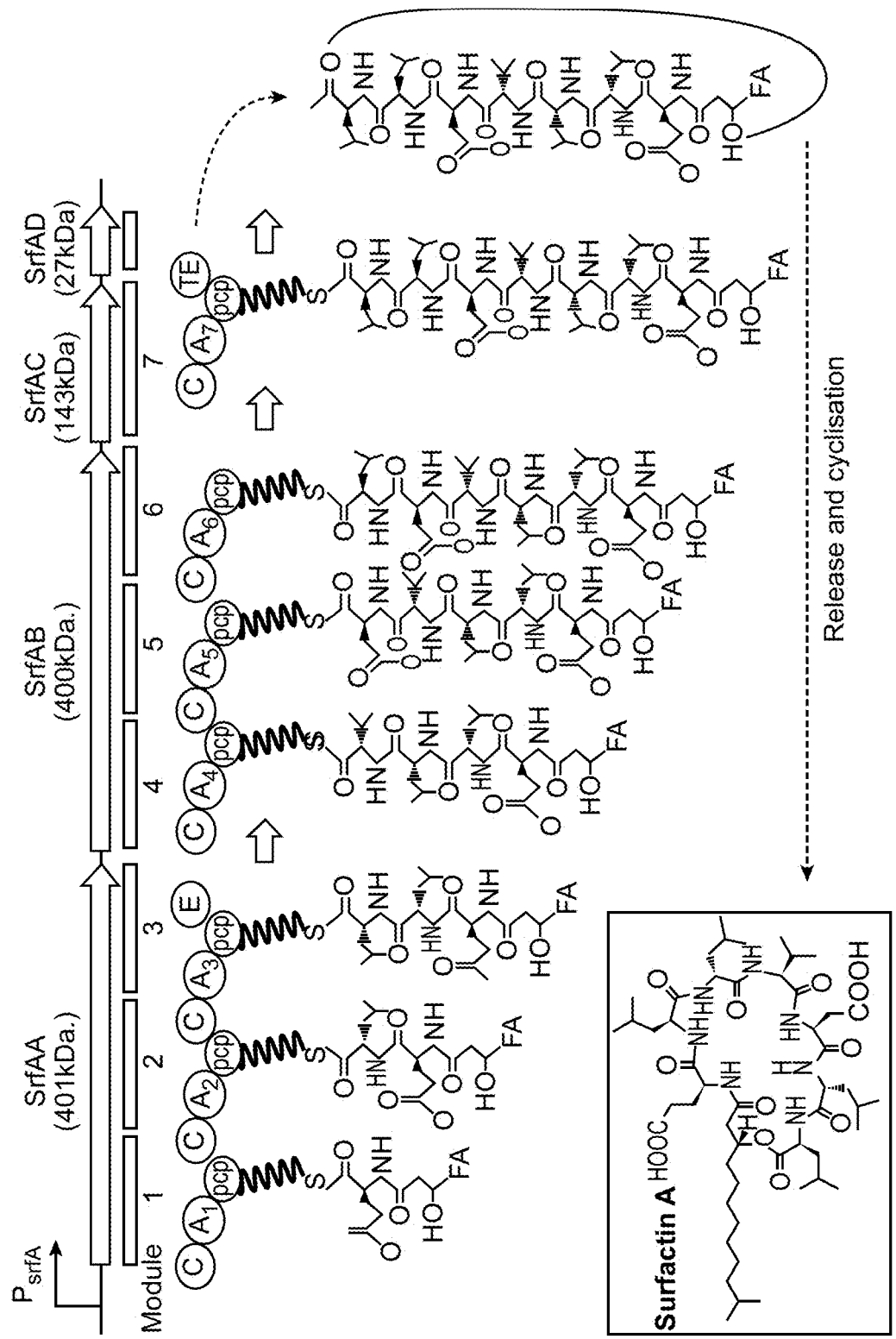
FIG. 11 is a diagram of the genes and chemical structure of Surfactin A (SEQ ID NOS 904-907 and 910, respectively, in order of appearance).
Figure 12:
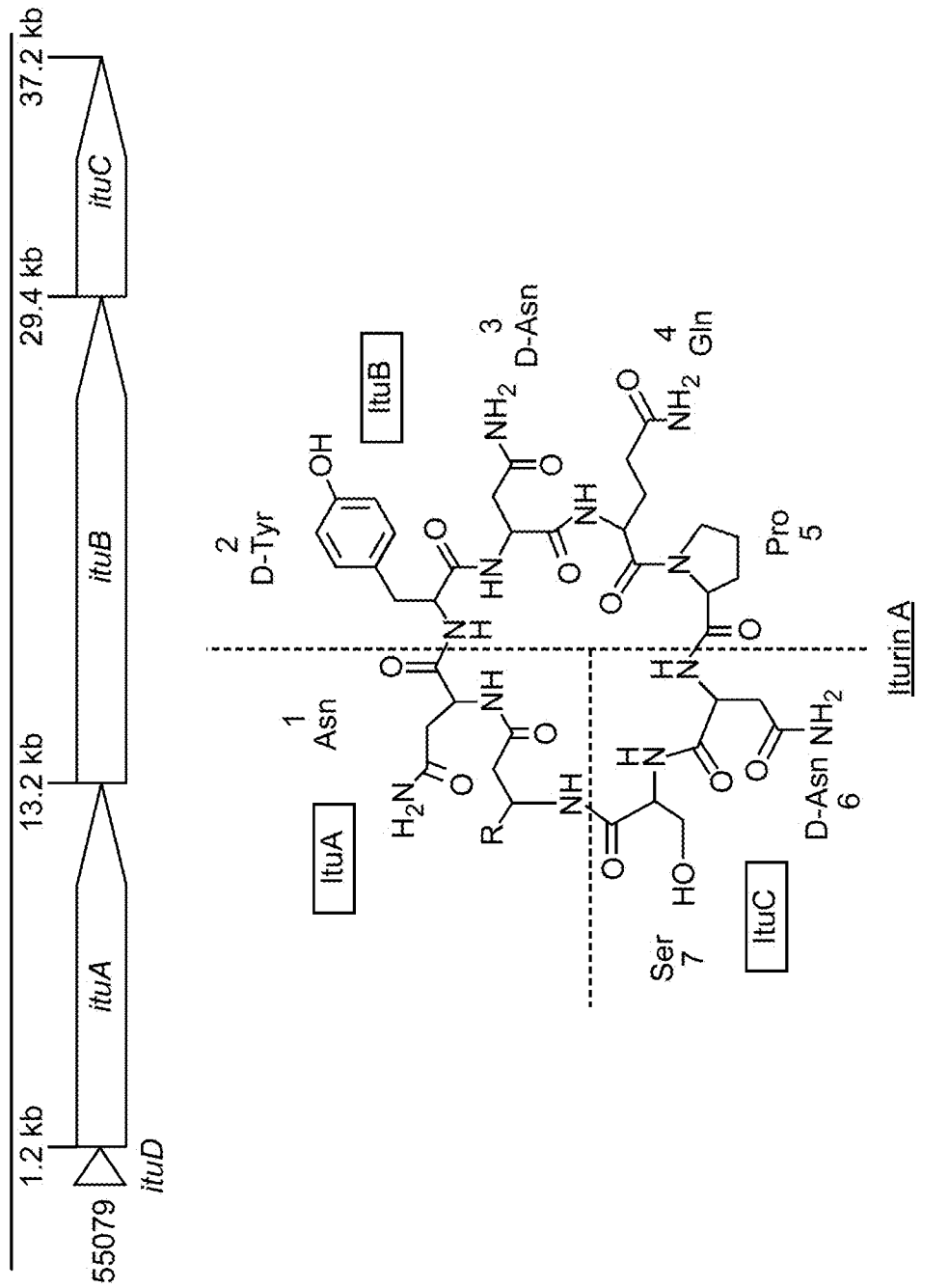
FIG. 12 (top) is a diagram of the organization and positions of the homologous gene clusters in *B. subtilis* RB14. The iturin operon was reported to be more than 38 kb long and composed of four open reading frames, ituD, ituA, ituB, and ituC. A diagram of the chemical structure of Iturin surfactant is also shown (bottom) (SEQ ID NO: 908).
Figure 13:
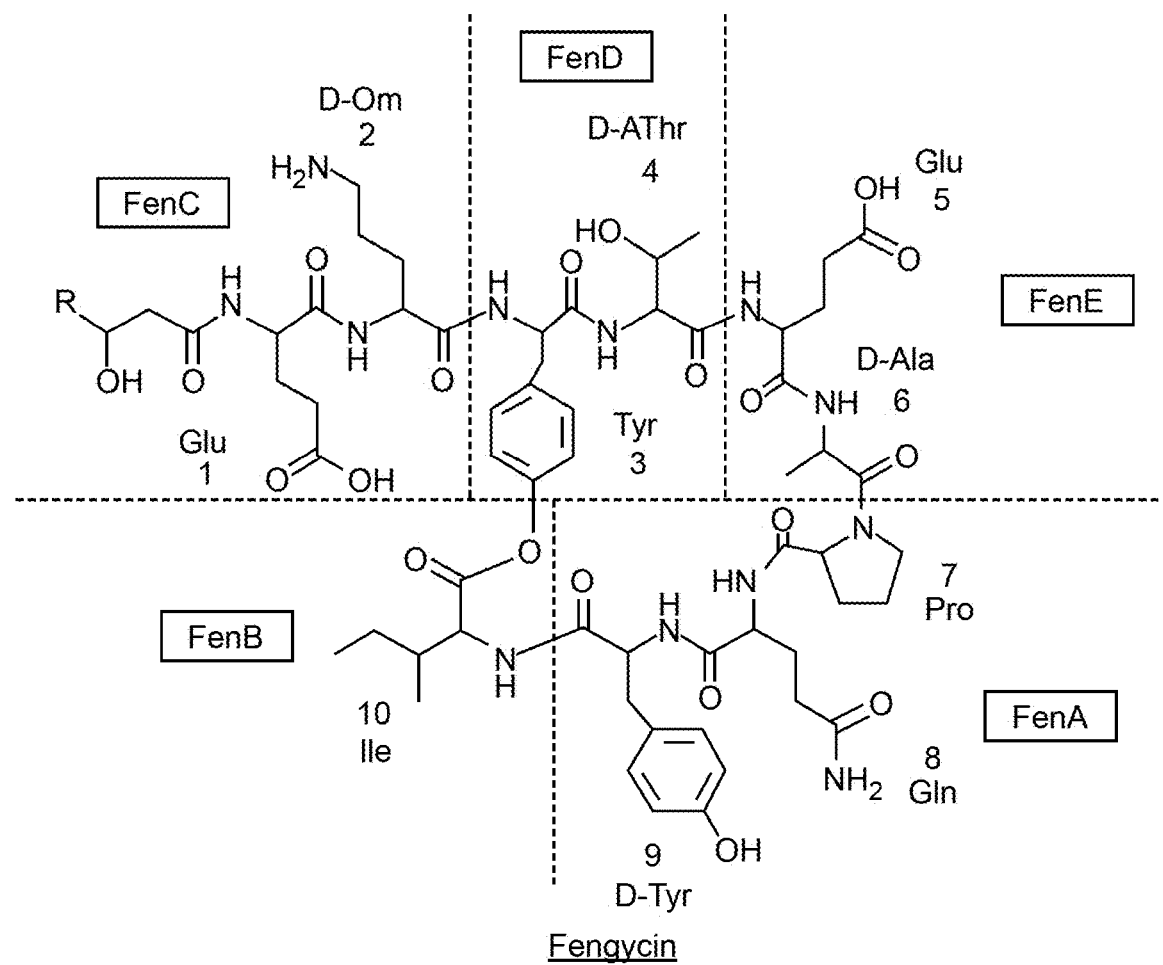
FIG. 13 is a diagram of the chemical structure of fengycin surfactant (SEQ ID NO: 909). This peptide is synthesized nonribosomally by five fengycin synthetases, which interlock in the order of FenC-FenD-FenE-FenA-FenB to form a complex.
Figure 14:
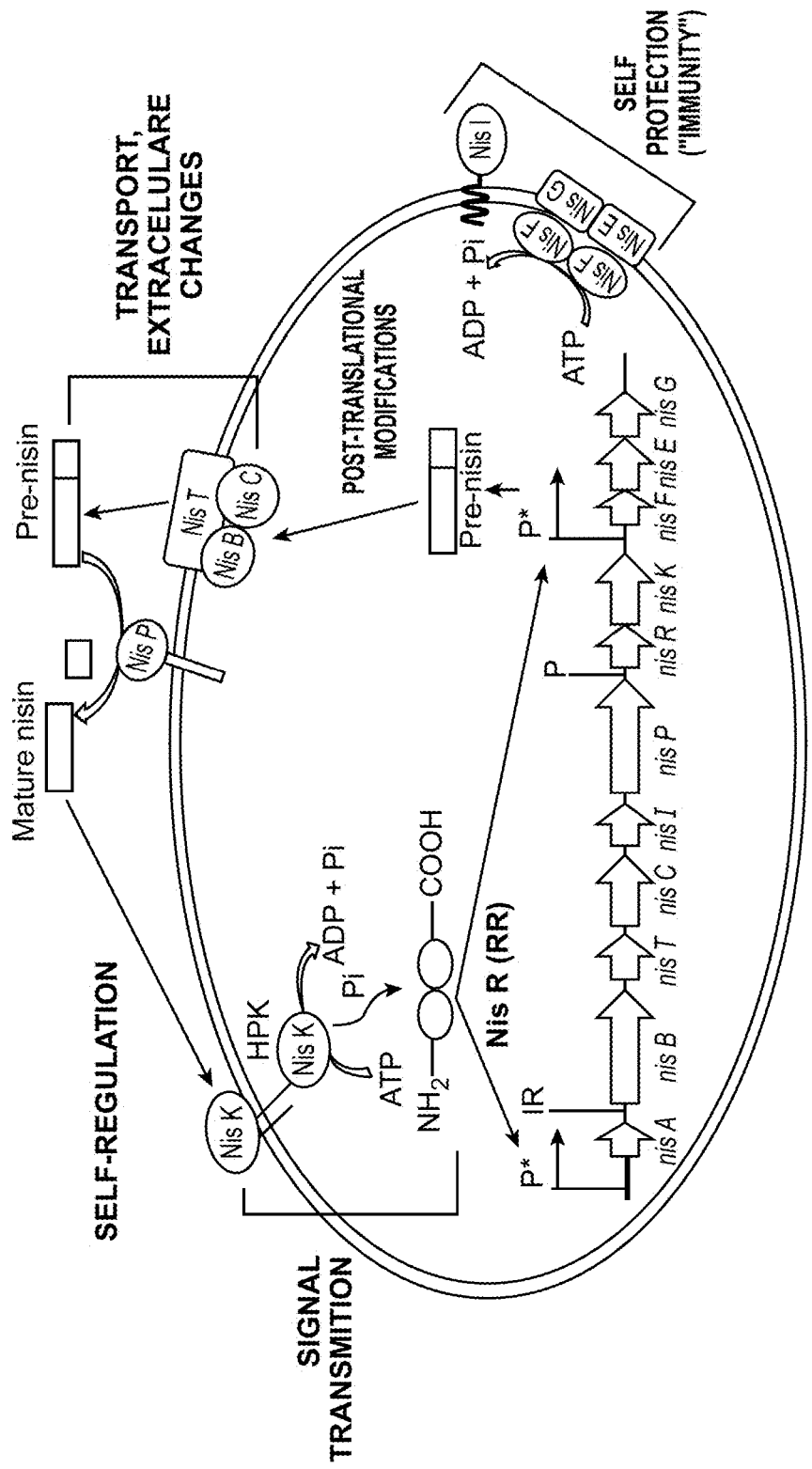
FIG. 14 is a diagram of the cellular regulation of Nisin surfactant.
Figure 15:
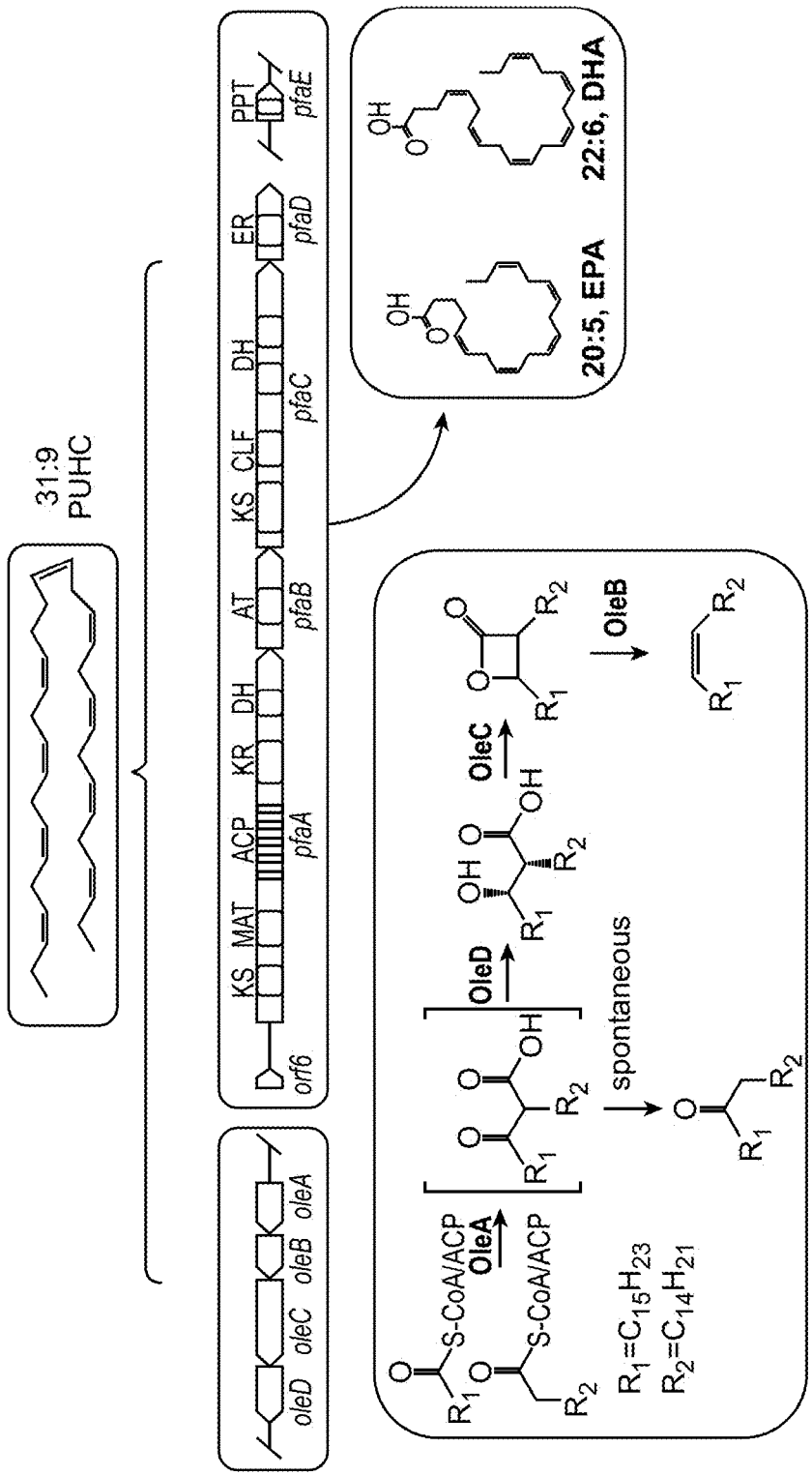
FIG. 15 is a diagram of the biosynthetic pathways of omega-3 polyunsaturated fatty acids, PUFA and PUHC. Domain designations within the Pfa synthase are; phosphopantetheinyl transferase (PPT), β-ketoacyl synthase (KS), malonyl-CoA:ACP transacylase (MAT), acyl-carrier protein (ACP), ketoacyl reductase (KR), dehydratase/isomerase (DH), acyltransferase (AT), chain-length factor (CLF), and enoyl reductase (ER). The Pfa synthase multienzyme complex.
Figure 16:
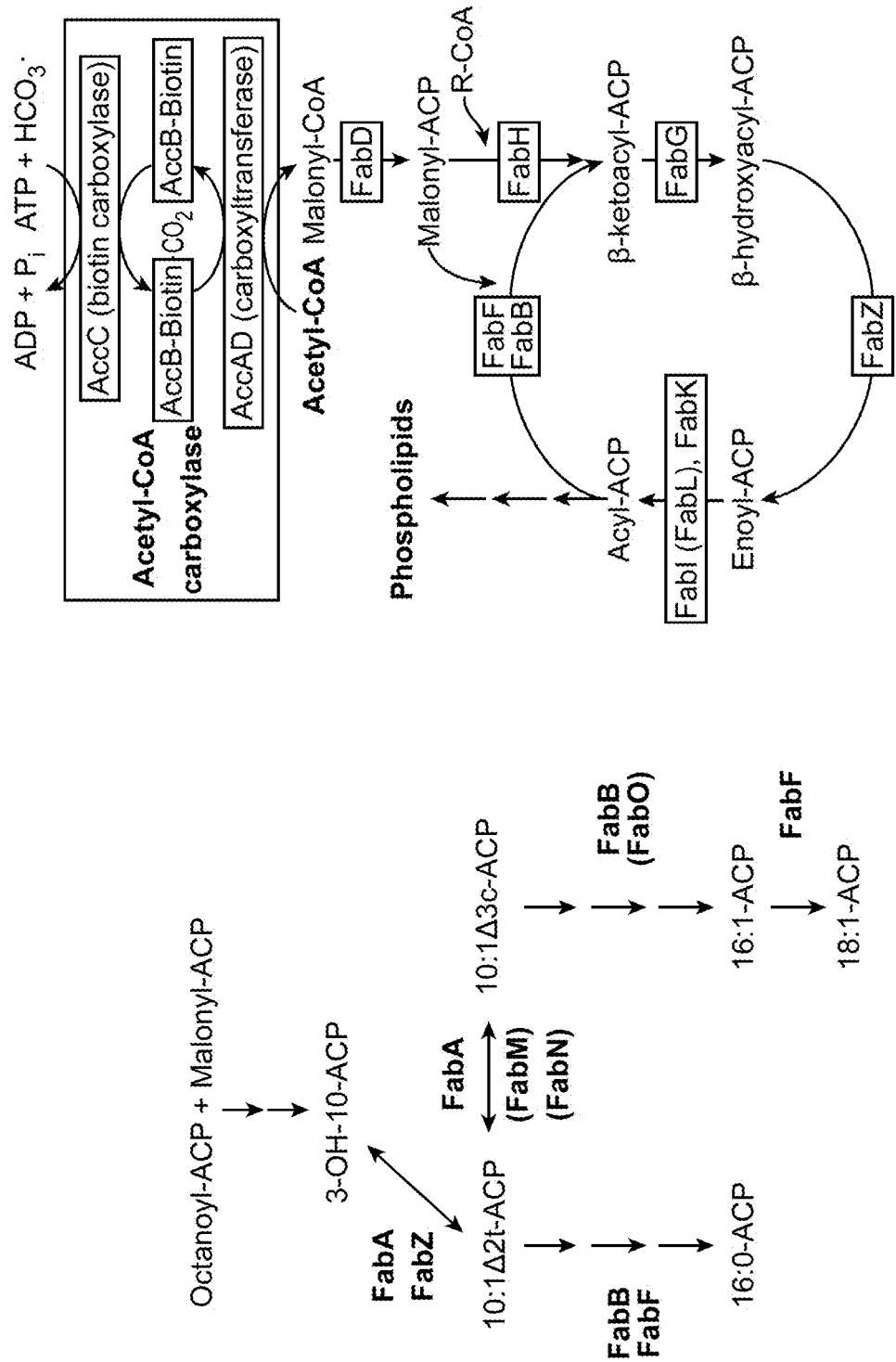
FIG. 16 are diagrams of biosynthetic pathways of type II fatty acids.

Terms used in the claims and specification are defined as set forth below unless otherwise specified.

As used herein, the term "derived from" includes microbes immediately taken from an environmental sample as well as microbes isolated from an environmental source and subsequently grown in pure culture. The term "derived from" also includes material isolated from the recited source, and materials obtained using the isolated materials (e.g., cultures of microorganisms made from microorganisms isolated from the recited source).

As used herein, the term "preventing" includes completely or substantially reducing the likelihood or occurrence or the severity of initial clinical or aesthetical symptoms of a condition.

As used herein, the term "about" includes variation of up to approximately +/−10% and that allows for functional equivalence in the product.

As used herein, the term "colony-forming unit" or "cfu" is an individual cell that is able to clone itself into an entire colony of identical cells.

As used herein all percentages are weight percent unless otherwise indicated.

As used herein, "viable organisms" are organisms that are capable of growth and multiplication. In some embodiments, viability can be assessed by numbers of colony-forming units that can be cultured. In some embodiments viability can be assessed by other means, such as quantitative polymerase chain reaction.

"Microbiome" refers to the genetic content of the communities of microbes that live inside and on the human body, or inside or outside a plant, both sustainably and transiently, including eukaryotes, archaea, bacteria, and viruses (including bacterial viruses (i.e., phage)), wherein "genetic content" includes genomic DNA, RNA such as ribosomal RNA, the epigenome, plasmids, and all other types of genetic information.

The term "microbial entity" as used herein, refers to the community of microorganisms that occur (sustainably or transiently) in and on a plant or an animal subject, typically a mammal such as a human, including eukaryotes, archaea, bacteria, and viruses (including bacterial viruses i.e., phage).

The term "metabolic signature" as used herein, refers to the ability of an organism to produce or utilize one or more metabolites.

The term "functional expression sequence" as used herein, refers to any polynucleotide (RNA or DNA) or amino acid sequence resulting in a functional polynucleotide (e.g., mRNA, tRNA rRNA) or protein, including fragments of protein that form functional binding domains or domains with a discrete activity (e.g., enzymatic activity) within the cell.

A "combination" of two or more bacteria includes the physical co-existence of the two bacteria, either in the same material or product or in physically connected products, as well as the temporal co-administration or co-localization of the two bacteria.

As used herein "heterologous" designates organisms to be administered that are not naturally present in the same proportions as in the therapeutic composition as in subjects to be treated with the therapeutic composition. These can be organisms that are not normally present in individuals in need of the composition described herein, or organisms that are not present in sufficient proportion in said individuals. These organisms can comprise a synthetic composition of organisms derived from separate plant sources or can comprise a composition of organisms derived from the same plant source, or a combination thereof.

The term "pharmaceutically acceptable delivery vehicle" as used herein, refers to any compound or device that is formulated with the microbial entities into a pharmaceutical composition described herein to improve delivery of the pharmaceutical composition to the subject to which the composition has been administered. Pharmaceutically acceptable delivery vehicles include excipients, liposomes, nanoparticles, and nanovectors.

The term "medical food" as used herein, refers to a food which is formulated to be consumed or administered enterally with or without the supervision of a physician and which is intended for the dietary management of a disease, state, disorder, or condition, or one or more symptoms thereof. Medical foods can be in solid, liquid or gel form.

The term "dietary supplement", as used herein refers to a substance that is not a conventional food and that is manufactured to be administered to a subject over a period of time, wherein the substance is an addition to the subject's diet and is effective to produce a desired effect when administered to the subject over a period of time. In certain embodiments, the desired effect is treating, ameliorating, preventing, or managing one or more symptoms of a disease, disorder, state, or condition in the subject.

The term "foodstuff" as used herein, refers to a nutritional composition for oral administration that is in solid, liquid or gel form. A medical food can also be a foodstuff The term "utilizes a metabolite" as used herein, refers to capability of a microbial entity described herein to metabolize a metabolite into a different form, either by catabolism or anabolism.

The term "anti-inflammatory product" as used herein, refers to any substance that has an effect (either direct or indirect) on a subject in contact with the product that results in reduction of inflammation, or any detectable markers of inflammation known in the art.

The term "pro-inflammatory cytokines" as used herein, refers to small proteins that regulate the activity of blood cells such as immune system cells and are involved in the up-regulation of inflammatory reactions. Pro-inflammatory cytokines can be produced by activated macrophages or other immune cells, endothelial cells and epithelial cells.

The term "immune health" as used herein, refers to the functions and activity of the immune system and cells associated with the immune system of a healthy subject. As used herein, the term "improving immune health" refers to modulating the activity and/or function of the immune system so as to increase the immune system's ability to detect foreign antigens, pathogens, and/or abnormal cells (such as but not limited to cancer cells and infected cells), and/or refers to modulating the immune system's activity and/or function in a subject exhibiting abnormally increased immune system activity/immune response relative to healthy subjects, such as conditions or diseases related to increased inflammation (such as, but not limited to, Alzheimer's disease, cancer, asthma, heart disease, type II diabetes, rheumatoid arthritis) and/or conditions or diseases related to increased immune response (e.g., autoimmune disease).

The term "ameliorating" refers to any therapeutically beneficial result in the treatment of a disease state, e.g., an immune system disorder disease state, including prophylaxis, lessening in the severity or progression, remission, or cure thereof.

The term "in situ" refers to processes that occur in a living cell growing separate from a living organism, e.g., growing in tissue culture.

The term "in vivo" refers to processes that occur in a living organism.

The term "mammal" as used herein includes both humans and non-humans and include but is not limited to humans, non-human primates, canines, felines, murines, bovines, equines, and porcines.

The term "sufficient amount" means an amount sufficient to produce a desired effect, e.g., an amount sufficient to modulate inflammation.

The term "therapeutically effective amount" is an amount that is effective to ameliorate a symptom of a disease.

Abbreviations used in this application include the following: rDNA refers to ribosomal DNA, HDAC refers to histone deacetylase, IL-10 refers to Interleukin 10, IL-6 refers to Interleukin 6, TNFα, refers to Tumor Necrosis Factor Alpha, IFN-γ, refers to Interferon Gamma, and TLR refers to Toll Like Receptor.

It must be noted that, as used in the specification and the appended claims, the singular forms "a," "an" and "the" include plural referents unless the context clearly dictates otherwise.

This disclosure has several advantages, such as providing for new pharmaceutical compositions, dietary supplements, medical foods and solid food stuff, comprising new combinations of live microbe populations for the treatment, prevention, and/or enabling dietary management of immune system disorders and conditions related to inflammation, including both pathogen assisted conditions and conditions that are independent of pathogens. Included with the present disclosure are methods for use of the pharmaceutical composition, dietary supplements, medical foods and solid food stuff products, and methods for selecting microbial entities to formulate same.

Compounds

Nucleic Acids

The term percent of "identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent of "identity" can exist over a region of the sequence being compared, e.g., over a functional domain, or, alternatively, exist over the full length of the two sequences to be compared.

For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., infra).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information (www.ncbi.nlm.nih.gov/).

Compositions

Microbial Entities

Described herein are compositions such as pharmaceutical compositions, medical foods and solid food stuff comprising a combination of two or more microbial entities.

Bacterial Entities

Described herein are compositions comprising bacterial entities comprising bacterial species. In certain embodiments, the bacterial entity comprises bacterial species comprising: a 16S rDNA gene sequence that is at least 97% identical to a 16S rDNA sequence set forth in SEQ ID NO: 1-233 selected from Table 4. In certain embodiments, the bacterial entity comprises a bacterial species comprising: an 16S rDNA sequence that is at least 80%, 85%, 90%, 91%, 92%, 93%, 94%, 95%, 96%, 97%, 98% or at least 99% identical to a 16S rDNA sequence set forth in SEQ ID NO: 1-233 selected from Table 4.

In certain embodiments, the bacterial entity comprises bacterial species comprising: a first genome; wherein the first genome comprises at least one functional expression sequence at least about 30% identical to a functional expression sequence selected from Table 5 or Table 6. In certain embodiments, the first genome comprises at least one functional expression sequence at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, identical to a functional expression sequence selected from Table 5 or Table 6. The functional expression sequence can be a gene coding for a protein, an RNA (e.g., an rRNA, an mRNA), or a fragment of a protein (e.g., a binding domain, or an activation domain, or catalytic domain), or a fragment of a nucleic acid (e.g., a fragment of an mRNA coding for a protein domain).

In certain embodiments, disclosed herein are compositions for proving immune health comprising viable microbes, comprising:
  (v) a first microbial entity comprising a first bacterial population comprising *Lactobacillus brevis*;
  (vi) a second microbial entity comprising a second bacterial population comprising *Lactococcus lactis*;
  (vii) a third microbial entity comprising a third bacterial population comprising *Bacillus velenzensis*; and.
  (viii) a fourth microbial entity comprising a fourth bacterial population comprising *Lactobacillus harbinensis*.

In certain aspects, disclosed herein are compositions for improving immune health, comprising:
  (i) a first microbial entity comprising a first bacterial species comprising a 16S rDNA sequence that is at least 97% identical to a 16S rDNA sequence set forth in SEQ ID NO: 43;
  (ii) a second microbial entity comprising a second bacterial species comprising a 16S rDNA sequence that is at least 97% identical to a 16S rDNA sequence set forth in SEQ ID NO: 285;
  (iii) a third microbial entity comprising a third bacterial species comprising a 16S rDNA sequence that is at least 97% identical to a 16S rDNA sequence set forth in SEQ ID NO: 284; and
  (iv) a fourth microbial entity comprising a fourth bacterial species comprising a 16S rDNA sequence that is at least 97% identical to a 16S rDNA sequence set forth in SEQ ID NO: 286.

In certain embodiments, the bacterial entity comprises bacterial species comprising: a bacterial species capable of producing an enzyme having an amino acid sequence at least 60% identical to an enzyme selected from Table 5 or Table 6 or an enzyme capable of acting on the same substrate as an enzyme having an amino acid sequence at least 60% identical to an enzyme selected from Table 5 or Table 6. In certain embodiments, the bacterial species is capable of producing an enzyme having an amino acid sequence at least 65%, at least 70%, at least 80%, at least 85%, at least 90%, at least 91%, at least 92%, at least 93%, at least 94%, at least 95%, at least 96%, at least 97%, at least 98%, or at least 99%, identical to an enzyme selected from Table 5 or Table 6. In certain embodiments, the bacterial species is capable of producing an enzyme capable of acting on the same substrate as an enzyme having an amino acid sequence at least 85%, at least 90%, at least 91%, at least 92%, at least 93%, at least 94%, at least 95%, at least 96%, at least 97%, at least 98%, or at least 99%, identical to an enzyme selected from Table 5 or Table 6.

In certain embodiments, the bacterial species comprises one or more features selected from the group consisting of: (i) capable of engrafting when administered to a subject, (ii) capable of having anti-inflammatory activity, (iii) not capable of inducing pro-inflammatory activity, (iv) capable of producing a secondary bile acid, (v) capable of producing a tryptophan metabolite, (vi) capable of restoring epithelial integrity as determined by a primary epithelial cell monolayer barrier integrity assay, (vii) capable of being associated with remission of an inflammatory bowel disease, (viii) capable of producing a short-chain fatty acid, (ix) capable of inhibiting a HDAC activity, (x) capable of producing a medium-chain fatty acid, (xi) capable of expressing catalase activity, (xii) capable of having alpha-fucosidase activity, (xiii) capable of inducing Wnt activation, (xiv) capable of producing a B vitamin, (xv) capable of modulating host metabolism of endocannabinoid, (xvi) capable of producing a polyamine and/or modulating a host metabolism of a polyamine, (xvii) capable of reducing fecal levels of a sphingolipid, (xviii) capable of modulating host production of kynurenine, (xix) capable of reducing fecal calprotectin level, (xx) not capable of activating a toll-like receptor pathway, (xxi) capable of activating a toll-like receptor pathway, (xxii) not capable of producing ursodeoxycholic acid, (xxiii) capable of not being associated with clinical non-remission of an inflammatory bowel disease, (xxiv) capable of inhibiting apoptosis of intestinal epithelial cells, (xxv) capable of inducing an increased anti-inflammatory IL-10/IL-6 cytokine ratio in macrophages, (xxvi) capable of not inducing pro-inflammatory IL-6, TNFα, IL-1b, IL-23 or IL-12 production or gene expression in macrophages, (xxvii) capable of downmodulating one or more genes induced in IFN-γ treated colonic organoids, (xxix) capable of producing IL-18, (xxx) capable of inducing the activation of antigen presenting cells, (xxxi) capable of reducing the expression of one or more inhibitory receptors on T cells, (xxxii) capable of increasing expression of one or more genes/proteins associated with T cell activation and/or function, (xxxiii) capable of enhancing the ability of CD8+ T cells to kill tumor cells, (xxxiv) capable of enhancing the efficacy of an immune checkpoint inhibitor therapy, (xxxv) capable of reducing colonic inflammation, (xxxvi) capable of promoting the recruitment of CD8+ T cells to tumors, and (xxxvii) combinations thereof. In certain embodiments, the not activating a toll-like receptor pathway comprises no activation of TLR4 or TLR5. In certain embodiments, the activating a toll-like receptor pathway comprises activation of TLR2.

In certain embodiments, the one or more genes induced in IFN-γ treated colonic organoids, is selected from genes associated with inflammatory chemokine signaling, NF-κB signaling, TNF family signaling, type I interferon signaling, type II interferon signaling, TLR signaling, lymphocyte trafficking, Th17 cell differentiation, Th1 differentiation, Th2 differentiation, apoptosis, inflammasomes, autophagy, oxidative stress, MHC class I and II antigen presentation, complement, mTor, nod-like receptor signaling, PI3K signaling, and combinations thereof. In certain embodiments, the one or more inhibitory receptors on T cells is selected from TIGIT, TIM-3, LAG-3, and combinations thereof. In certain embodiments, the one or more genes or proteins associated with T cell activation and/or function is selected from CD45RO, CD69, IL-24, TNF-α, perforin, IFN-γ, and combinations thereof.

In certain embodiments, the first bacterial species is capable of producing indole-containing compounds. In certain embodiments, the indole containing compound is selected from indole, indole acetic acid (IAA), and indole propionic acid (IPA). In certain embodiments, the bacterial species is capable of producing bacteriocins and antibacterial peptides. In certain embodiments, the bacterial species is capable of producing neurotransmitters selected from serotonin, gamma-aminobutyric acid (GABA), dopamine, and combinations thereof. In certain embodiments, the bacterial species is capable of producing IFNγ, IL-12, TNF-α, IL-17, IL-6, or combinations thereof. In certain embodiments, first bacterial species is capable of producing a biosurfactant that reduces pro-inflammatory cytokines such as IL-1β, iNOS, and/or TNF-α. In certain embodiments, bacterial species metabolizes human produced primary bile acids into secondary bile acids. In certain embodiments, the primary bile acid is cholic acid, chenodeoxycholic acid, or combinations thereof. In certain embodiments, the secondary bile acid inhibits FXR and/or activates TGR5. In certain embodiments, the bacterial species produce more omega-3 fatty acids compared to omega-6 fatty acids. In certain embodiments, bacterial species comprises one or more bacteria that are capable of producing a metabolite selected from Tables 5 or 7.

Fungal Entities

Described herein are compositions comprising fungal entities comprising fungal species. In certain embodiments, the composition described herein comprises at least one fungal species comprising an 18S rDNA or ITS (Internal Transcribed Spacer) sequence that is at least 97% identical to a 18S rDNA or ITS sequence set forth in SEQ ID NO 1-233 selected from Table 4. In certain embodiments, the composition described herein comprise at least one fungal species comprising an 18S rDNA or ITS sequence that is at least 80%, 85%, 90%, 91%, 92%, 93%, 94%, 95%, 96%, 97%, 98% or at least 99% identical to a 18S rDNA or ITS sequence set forth in SEQ ID NO: 1-233 selected from Table 4.

In certain embodiments, the composition described herein comprise at least one fungal species comprising a genome comprising a functional expression sequence selected from at least about 30% identical to a functional expression sequence selected from Table 5 or Table 6. In certain embodiments, at least one fungal species comprising a genome comprising a functional expression sequence selected from at least 35%, at least 40%, at least 45%, at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, or at least 99% identical to a functional expression sequence selected from Table 5 or Table 6.

In certain embodiments, the composition described herein comprise at least one fungal species capable of producing a metabolite, or has a functionality selected from Table 5 or Table 7.

Compositions Comprising Bacterial and Fungal Entities

Disclosed herein are compositions (e.g., pharmaceutical compositions, medical foods or solid food stuff) comprising at least one bacterial entity and at least one fungal entity. In certain embodiments, the composition comprises: composition comprising a population of viable microbes, comprising: (i) a first microbial entity comprising a first bacterial species comprising: (a) an 16S rDNA sequence that is at least 97% identical to a 16S rDNA sequence set forth in SEQ ID NO: 1-233 selected from Table 4; (b) a first genome; wherein the first genome comprises at least one functional expression sequence at least about 30% identical to a functional expression sequence selected from Table 5 or Table 6; or (c) a bacterial species capable of producing an enzyme having an amino acid sequence at least 80% identical to an enzyme selected from Table 5 or Table 6 or an enzyme capable of acting on the same substrate as an enzyme having an amino acid sequence at least 80% identical to an enzyme selected from Table 5 or Table 6; (ii) a second microbial entity comprising a first fungal species comprising: (a) an 18S rDNA or ITS sequence that is at least 97% identical to a 18S rDNA or ITS sequence set forth in SEQ ID NO: 1-233 selected from Table 4; (b) a genome comprising a functional expression sequence selected from at least about 30% identical to a functional expression sequence selected from Table 5 or Table 6; or (c) a metabolic signature or functionality selected from Table 5 or Table 7.

In certain embodiments, the compositions described herein comprise at least one additional microbial entity. In certain embodiments, the compositions described herein comprise 3, 4, 5, 6, 7, 8, 9, 10, 11, 12, 13, 14, 15, 16, 17, 18, 19, 20 or more microbial entities.

In certain embodiments, the composition is formulated in an oral administration form comprising between $1\times10^6$ and $1\times10^{12}$ cfu/administration of each of the bacterial entity and the fungal entity. In certain embodiments, the composition comprises at least $1\times10^6$, at least $1\times10^7$, at least $1\times10^8$, at least $1\times10^9$, at least $1\times10^{10}$, at least $1\times10^{11}$ cfu/administration of the bacterial entity. In certain embodiments, the composition comprises at least $1\times10^6$, at least $1\times10^7$, at least $1\times10^8$, at least $1\times10^9$, at least $1\times10^{10}$, at least $1\times10^{11}$ cfu/administration of the fungal entity.

In certain embodiments the bacterial entity and the fungal entity synergize to produce an anti-inflammatory effect in a mammalian host. In certain embodiments, the anti-inflammatory effect in a mammalian host is caused by the production at least one anti-inflammatory metabolite by either the bacterial entity, the fungal entity or both the bacterial and fungal entities.

In certain embodiments, administering an effective amount of the composition to a human subject reduces the level and/or activity of at least one inflammatory cytokine from Table 8 relative to a level and/or activity of the inflammatory cytokine in the serum of the human subject; or a tissue of the subject, prior to administering the pharmaceutical composition to the subject.

In certain embodiments, administering an effective amount of the pharmaceutical composition to a human subject treats, prevents, reduces the severity, and/or enables the dietary management of at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, or combinations thereof. In certain embodiments, the human subject has an altered Th17 activity, In certain embodiments, administering an effective dose of the pharmaceutical composition to a human subject treats, prevents, or reduces the severity of at least one symptom in the subject of a rheumatic disease selected from rheumatoid arthritis, spondyloarthritis, and psoriasis. In certain embodiments, administering an effective dose of the pharmaceutical composition to a human subject treats, prevents, or reduces the severity of at least one symptom in the subject of periodontal disease. In certain embodiments administering an effective dose of the pharmaceutical composition to a human subject treats, prevents, or reduces the severity of at least one symptom in the subject of gastritis. In certain embodiments the gastritis is *H. pylori*-associated gastritis.

Pharmaceutically Acceptable Delivery Vehicles

The microbial entities of the invention can be formulated in pharmaceutical compositions. These compositions can comprise, in addition to one or more of the microbial entities described herein and a pharmaceutically acceptable delivery vehicle. In certain embodiments the pharmaceutically acceptable delivery vehicle is an excipient.

In some embodiments the composition comprises at least one carbohydrate. A "carbohydrate" refers to a sugar or polymer of sugars. The terms "saccharide," "polysaccharide," "carbohydrate," and "oligosaccharide" can be used interchangeably. Most carbohydrates are aldehydes or ketones with many hydroxyl groups, usually one on each carbon atom of the molecule. Carbohydrates generally have the molecular formula $CnH2nOn$. A carbohydrate can be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments, the composition comprises at least one lipid. As used herein a "lipid" includes fats, oils, triglycerides, cholesterol, phospholipids, fatty acids in any form including free fatty acids. Fats, oils and fatty acids can be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments, the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments, the composition comprises at least one supplemental vitamin. The at least one vitamin can be fat-soluble or water soluble vitamins. Suitable vitamins include but are not limited to vitamin C, vitamin A, vitamin E, vitamin B12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments, the composition comprises at least one dietary supplement. Suitable examples are well known in the art and include herbs, botanicals, and certain hormones. Non limiting examples of dietary supplements include ginko, gensing, and melatonin.

In some embodiments the composition comprises an excipient. Non-limiting examples of suitable excipients include a tastant, a flavorant, a buffering agent, a preservative, a stabilizer, a binder, a compaction agent, a lubricant, a dispersion enhancer, a disintegration agent, a flavoring agent, a sweetener, a coloring agent.

In some embodiments the excipient is a buffering agent. Non-limiting examples of suitable buffering agents include sodium citrate, magnesium carbonate, magnesium bicarbonate, calcium carbonate, and calcium bicarbonate.

In some embodiments the excipient comprises a preservative. Non-limiting examples of suitable preservatives include antioxidants, such as alpha-tocopherol and ascorbate, and antimicrobials, such as parabens, chlorobutanol, and phenol.

In some embodiments the composition comprises a binder as an excipient. Non-limiting examples of suitable binders include starches, pregelatinized starches, gelatin, polyvinylpyrolidone, cellulose, methylcellulose, sodium carboxymethylcellulose, ethylcellulose, polyacrylamides, polyvinyloxoazolidone, polyvinylalcohols, C12-C18 fatty acid alcohol, polyethylene glycol, polyols, saccharides, oligosaccharides, and combinations thereof.

In some embodiments, the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments, the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments, the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, micro-crystalline cellulose, alginates, sodium starch glycolate, gums such as agar, guar, locust bean, karaya, pecitin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments, the excipient comprises a flavoring agent. Flavoring agents incorporated into the outer layer can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; *eucalyptus*; vanilla; citrus oil such as lemon oil, orange oil, grape and grapefruit oil; and fruit essences including apple, peach, pear, strawberry, raspberry, cherry, plum, pineapple, and apricot.

In some embodiments, the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2, 2-dioxide, particularly the potassium salt (acesulfame-K), and sodium and calcium salts thereof.

In some embodiments, the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

In certain embodiments, the pharmaceutically acceptable delivery vehicle comprises a liposome.

In certain embodiments, the pharmaceutically acceptable delivery vehicle comprises a nanoparticle. In certain embodiments, the nanoparticle is a nanovector. In certain embodiments, the nanovector comprises an amphiphillic polymer. In certain embodiments, the delivery vehicle comprises fruit and/or vegetable powder or extract(s).

The weight fraction of the excipient or combination of excipients in the formulation of the pharmaceutical composition is usually about 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the amino acids in the composition.

The precise nature of one or more pharmaceutically acceptable delivery vehicles, excipients, carriers, fillers or other material can depend on whether the composition is a pharmaceutical composition, a medical food, or a solid food stuff and the oral administration form.

Oral Administration Forms

In one aspect provided herein are methods and compositions formulated for oral delivery to a subject in need thereof. In an embodiment, a composition is formulated to deliver a composition comprising combinations of microbial entities disclosed herein to a subject in need thereof. In another embodiment, a pharmaceutical composition is formulated to deliver a composition comprising a combinations of microbial entities to a subject in need thereof. In another embodiment a composition is formulated to deliver a composition comprising prebiotic and a probiotic to a subject in need thereof. Compositions for oral administration can be in tablet, capsule, powder or liquid form.

In an embodiment, a composition is administered in solid, semi-solid, micro-emulsion, gel, or liquid form. Examples of such administration forms include tablet forms disclosed in U.S. Pat. Nos. 3,048,526, 3,108,046, 4,786,505, 4,919,939, and 4,950,484; gel forms disclosed in U.S. Pat. Nos. 4,904, 479, 6,482,435, 6,572,871, and 5,013,726; capsule forms disclosed in U.S. Pat. Nos. 4,800,083, 4,532,126, 4,935,243, and 6,258,380; or liquid forms disclosed in U.S. Pat. Nos. 4,625,494, 4,478,822, and 5,610,184; each of which is incorporated herein by reference in its entirety.

Forms of the compositions that can be used orally include tablets, push-fit capsules made of gelatin, as well as soft, sealed capsules made of gelatin and a plasticizer, such as glycerol or sorbitol. Tablets can be made by compression or molding, optionally with one or more accessory ingredients including freeze-dried plant material serving both as prebiotic and as a filler. Compressed tablets can be prepared by compressing in a suitable machine the active ingredient in a free-flowing form such as a powder or granules, optionally mixed with binders (e.g., povidone, gelatin, hydroxypropylmethyl cellulose), inert diluents, preservative, antioxidant, disintegrant (e.g., sodium starch glycolate, cross-linked povidone, cross-linked sodium carboxymethyl cellulose) or lubricating, surface active or dispersing agents. Molded tablets can be made by molding in a suitable machine a mixture of the powdered compound moistened with an inert liquid diluent. The tablets can optionally be coated or scored and can be formulated so as to provide slow or controlled release of the active ingredient therein. Tablets can optionally be provided with an enteric coating, to provide release in parts of the gut (e.g., colon, lower intestine) other than the stomach. All formulations for oral administration can be in forms suitable for such administration. The push-fit capsules can contain the active ingredients in admixture with filler such as lactose, binders such as starches, and/or lubricants such as talc or magnesium stearate and, optionally, stabilizers. In soft capsules, the active compounds (prebiotics or probiotics) can be dissolved or suspended in suitable liquids, such as fatty oils, liquid paraffin, or liquid polyethylene glycols. In addition, stabilizers can be added. Dragee cores are provided with suitable coatings. For this purpose, concentrated sugar solutions can be used, which can optionally contain gum arabic, talc, polyvinyl pyrrolidone, carbopol gel, polyethylene glycol, or titanium dioxide, lacquer solutions, and suitable organic solvents or solvent mixtures. Dyestuffs or pigments can be added to the tablets or Dragee coatings for identification or to characterize different combinations of active compound administrations.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water soluble carrier such as polyethylene glycol or an oil medium, for example peanut oil, liquid paraffin, or olive oil.

Oral liquid preparations can be in the form of, for example, aqueous or oily suspensions, solutions, emulsions syrups or elixirs, or can be presented as a dry product for reconstitution with water or other suitable vehicle before use. Such liquid preparations can contain conventional additives, such as suspending agents, for example sorbitol, methyl cellulose, glucose syrup, gelatin, hydroxyethyl cellulose, carboxymethyl cellulose, aluminum stearate gel or hydrogenated edible fats, emulsifying agents, for example lecithin, sorbitan monooleate, acacia; nonaqueous vehicles (which can include edible oils), for example almond oil, oily esters such as glycerine, propylene glycol, or ethyl alcohol; preservatives, for example methyl or propyl p-hydoxybenzoate or sorbic acid, and, if desired, conventional flavoring or coloring agents.

In an embodiment, a provided composition includes a softgel formulation. A softgel can contain a gelatin-based shell that surrounds a liquid fill. The shell can be made of gelatin, plasticiser (e.g., glycerin and/or sorbitol), modifier, water, color, antioxidant, or flavor. The shell can be made with starch or carrageenan. The outer layer can be enteric coated. In an embodiment, a softgel formulation can include a water or oil soluble fill solution, or suspension of a composition, for example, a prebiotic composition, covered by a layer of gelatin.

An enteric coating can control the location of a microbial entity described herein and how it is absorbed in the digestive system. For example, an enteric coating can be designed such that a composition comprising the microbial entity does not dissolve in the stomach but rather travels to the small intestine, where it dissolves. An enteric coating can be stable at low pH (such as in the stomach) and can dissolve at higher pH (for example, in the small intestine). Material that can be used in enteric coatings includes, for example, alginic acid, cellulose acetate phthalate, plastics, waxes, shellac, and fatty acids (e.g., stearic acid, palmitic acid). Enteric coatings are described, for example, in U.S. Pat. Nos. 5,225,202, 5,733,575, 6,139,875, 6,420,473, 6,455,052, and 6,569,457, all of which are herein incorporated by reference in their entirety. The enteric coating can be an aqueous enteric coating. Examples of polymers that can be used in enteric coatings include, for example, shellac (trade name EmCoat 120 N, Marcoat 125); cellulose acetate phthalate (trade name aquacoat CPD®, Sepifilm™ LP, Klucel, Aquacoat® ECD, and Metolose®); polyvinylacetate phthalate (trade name Sureteric®); and methacrylic acid (trade name Eudragit®).

In an embodiment, an enteric coated composition comprising a microbial entity is administered to a subject. In another embodiment, an enteric coated composition is administered to a subject. The stomach has an acidic environment that can kill microbial entities. An enteric coating can protect microbial entities as they pass through the stomach and small intestine.

Enteric coatings can be used to (1) prevent the gastric juice from reacting with or destroying the active substance, (2) prevent dilution of the active substance before it reaches the intestine, (3) ensure that the active substance is not released until after the preparation has passed the stomach, and (4) prevent live bacteria contained in the preparation from being killed because of the low pH-value in the stomach.

Enteric coatings can also be used for avoiding irritation of or damage to the mucous membrane of the stomach caused by substances contained in the oral preparation, and for counteracting or preventing formation or release of substances having an unpleasant odor or taste in the stomach. Finally, such coatings can be used for preventing nausea or vomiting on intake of oral preparations.

In an embodiment a composition comprising the microbial entities described herein is provided as a tablet, capsule, or caplet with an enteric coating. In an embodiment the enteric coating is designed to hold the tablet, capsule, or caplet together when in the stomach. The enteric coating is designed to hold together in acid conditions of the stomach and break down in non-acid conditions and therefore release the drug in the intestines.

Softgel delivery systems can also incorporate phospholipids or polymers or natural gums to entrap a composition, for example, a prebiotic composition, in the gelatin layer with an outer coating to give desired delayed/control release effects, such as an enteric coating. Formulations of softgel fills can be at pH 2.5-7.5. A softgel formulation can be sealed tightly in an automatic manner. A softgel formulation can easily be swallowed, allow for product identification using colors and several shapes, allow uniformity, precision and accuracy between administrations, be safe against adulteration, provide good availability and rapid absorption, and offer protection against contamination, light and oxidation. Furthermore, softgel formulations can avoid unpleasant flavors due to content encapsulation.

A composition comprising a softgel formulation can be in any of number of different sizes, including, for example, round, oblong, oval, tube, droplet, or suppositories.

In an embodiment a composition is provided in an administration form which comprises an effective amount of microbial entities and one or more release controlling excipients as described herein. Suitable modified release administration vehicles include, but are not limited to, hydrophilic or hydrophobic matrix devices, water-soluble separating layer coatings, enteric coatings, osmotic devices, multi-particulate devices, and combinations thereof. In an embodiment the administration form is a tablet, caplet, capsule or lollipop. In another embodiment, the administration form is a liquid, oral suspension, oral solution, or oral syrup. In yet another embodiment, the administration form is a gel capsule, soft gelatin capsule, or hard gelatin capsule.

In an embodiment, the administration form is a gelatin capsule having a size indicated in Table 1.

TABLE 1

Gel Cap Sizes Allowable For Human Consumption
Empty Gelatin Capsule Physical Specifications

| Size | Outer Diameter (mm) | Height or Locked Length (mm) | Actual Volume (ml) |
|---|---|---|---|
| 000 | 9.97 | 26.14 | 1.37 |
| 00 | 8.53 | 23.30 | 0.95 |
| 0 | 7.65 | 21.7 | 0.68 |
| 1 | 6.91 | 19.4 | 0.50 |
| 2 | 6.35 | 18.0 | 0.37 |

TABLE 1-continued

Gel Cap Sizes Allowable For Human Consumption
Empty Gelatin Capsule Physical Specifications

| Size | Outer Diameter (mm) | Height or Locked Length (mm) | Actual Volume (ml) |
|---|---|---|---|
| 3 | 5.82 | 15.9 | 0.3 |
| 4 | 5.31 | 14.3 | 0.21 |
| 5 | 4.91 | 11.1 | 0.13 |

Note:
sizes and volumes are approximate.

In certain embodiments, a composition comprising microbial entities is provided in effervescent administration forms. The compositions can also comprise non-release controlling excipients.

In certain embodiments, a composition comprising a microbial entities is provided in a administration form that has at least one component that can facilitate release of the prebiotic. In a further embodiment the administration form can be capable of giving a discontinuous release of the compound in the form of at least two consecutive pulses separated in time from 0.1 up to 24 hours. The compositions can comprise one or more release controlling and non-release controlling excipients, such as those excipients suitable for a disruptable semi-permeable membrane and as swellable substances.

In certain embodiments, the compositions described herein comprise a plant or plant extract, either in solid or liquid form.

In certain embodiments, a composition comprising microbial entities is provided in an enteric coated administration form. The composition can also comprise non-release controlling excipients.

In certain embodiments, a composition comprising microbial entities is provided in a administration form for oral administration to a subject in need thereof, which comprises one or more pharmaceutically acceptable excipients or carriers, enclosed in an intermediate reactive layer comprising a gastric juice-resistant polymeric layered material partially neutralized with alkali and having cation exchange capacity and a gastric juice-resistant outer layer.

In an embodiment, a composition comprising the microbial entities is provided in the form of enteric-coated granules, for oral administration. The compositions can further comprise cellulose, disodium hydrogen phosphate, hydroxypropyl cellulose, hypromellose, lactose, mannitol, and sodium lauryl sulfate.

In certain embodiments, a composition comprising microbial entities is provided in the form of enteric-coated pellets, for oral administration. The compositions can further comprise glyceryl monostearate 40-50, hydroxypropyl cellulose, hypromellose, magnesium stearate, methacrylic acid copolymer type C, polysorbate 80, sugar spheres, talc, and triethyl citrate.

In an embodiment, a composition comprising microbial entities is provided in the form of enteric-coated granules, for oral administration. The compositions can further comprise carnauba wax, crospovidone, diacetylated monoglycerides, ethylcellulose, hydroxypropyl cellulose, hypromellose phthalate, magnesium stearate, mannitol, sodium hydroxide, sodium stearyl fumarate, talc, titanium dioxide, and yellow ferric oxide.

In certain embodiments, a composition comprising microbial entities can further comprise calcium stearate, crospovidone, hydroxypropyl methylcellulose, iron oxide, mannitol, methacrylic acid copolymer, polysorbate 80, povidone, propylene glycol, sodium carbonate, sodium lauryl sulfate, titanium dioxide, and triethyl citrate.

The compositions provided herein can be in unit-administration forms or multiple-administration forms. Unit-administration forms, as used herein, refer to physically discrete units suitable for administration to human or non-human animal subject in need thereof and packaged individually. Each unit-administration can contain a predetermined quantity of an active ingredient(s) sufficient to produce the desired therapeutic effect, in association with other pharmaceutical carriers or excipients. Examples of unit-administration forms include, but are not limited to, ampoules, syringes, and individually packaged tablets and capsules. Unit-administration forms can be administered in fractions or multiples thereof. A multiple-administration form is a plurality of identical unit-administration forms packaged in a single container, which can be administered in segregated unit-administration form. Examples of multiple-administration forms include, but are not limited to, vials, bottles of tablets or capsules, or bottles of pints or gallons. In certain embodiments, the multiple administration forms comprise different pharmaceutically active agents. For example a multiple administration form can be provided which comprises a first administration element comprising a composition comprising a prebiotic and a second administration element comprising lactose or a probiotic, which can be in a modified release form.

In this example a pair of administration elements can make a single unit administration. In an embodiment, a kit is provided comprising multiple unit administrations, wherein each unit comprises a first administration element comprising a composition comprising a prebiotic and a second administration element comprising probiotic, lactose or both, which can be in a modified release form. In another embodiment the kit further comprises a set of instructions.

In an embodiment, compositions can be formulated in various administration forms for oral administration. The compositions can also be formulated as a modified release administration form, including immediate-, delayed-, extended-, prolonged-, sustained-, pulsatile-, controlled-, extended, accelerated-, fast-, targeted-, programmed-release, and gastric retention administration forms. These administration forms can be prepared according to known methods and techniques (see, Remington: The Science and Practice of Pharmacy, supra; Modified-Release Drug Delivery Technology, Rathbone et al., Eds., Drugs and the Pharmaceutical Science, Marcel Dekker, Inc.: New York, N.Y., 2002; Vol. 126, which is herein incorporated by reference in its entirety).

In an embodiment, the compositions are in one or more administration forms. For example, a composition can be administered in a solid or liquid form. Examples of solid administration forms include but are not limited to discrete units in capsules or tablets, as a powder or granule, or present in a tablet conventionally formed by compression molding. Such compressed tablets can be prepared by compressing in a suitable machine the three or more agents and a pharmaceutically acceptable carrier. The molded tablets can be optionally coated or scored, having indicia inscribed thereon and can be so formulated as to cause immediate, substantially immediate, slow, controlled or extended release of a composition comprising a prebiotic. Furthermore, administration forms of the invention can comprise acceptable carriers or salts known in the art, such as those described in the Handbook of Pharmaceutical Excipients, American Pharmaceutical Association (1986), incorporated by reference herein in its entirety.

In an embodiment, an effective amount of a composition comprising microbial entities is mixed with a pharmaceutical excipient to form a solid preformulation composition comprising a homogeneous mixture of compounds described herein. When referring to these compositions as "homogeneous," it is meant that the agents are dispersed evenly throughout the composition so that the composition can be subdivided into unit administration forms such as tablets, caplets, or capsules. This solid preformulation composition can then be subdivided into unit administration forms of the type described above comprising from, for example, 1 g to 20 mg of a prebiotic composition. A composition comprising microbial entities can be formulated, in the case of caplets, capsules or tablets, to be swallowed whole, for example with water.

The compositions described herein can be in liquid form. The liquid formulations can comprise, for example, an agent in water-in-solution and/or suspension form; and a vehicle comprising polyethoxylated castor oil, alcohol, and/or a polyoxyethylated sorbitan mono-oleate with or without flavoring. Each administration form comprises an effective amount of an active agent and can optionally comprise pharmaceutically inert agents, such as conventional excipients, vehicles, fillers, binders, disintegrants, pH adjusting substances, buffer, solvents, solubilizing agents, sweeteners, coloring agents, and any other inactive agents that can be included in pharmaceutical administration forms for oral administration. Examples of such vehicles and additives can be found in Remington's Pharmaceutical Sciences, 17th edition (1985).

The compositions (e.g., pharmaceutical composition, medical food or solid food stuff) described herein can be in a solid, semi-solid, liquid, or gel state at room temperature. The compositions described herein can be formulated for administration as an infant formula, an elderly nutritional formula, a prenatal nutrition formula, an athletic performance formula, a ready-to-use therapeutic food formula, or an athletic recovery formula.

Manufacturing

The administration forms described herein can be manufactured using processes that are well known to those of skill in the art. For example, for the manufacture of tablets, an effective amount of a microbial entity described herein can be dispersed uniformly in one or more excipients, for example, using high shear granulation, low shear granulation, fluid bed granulation, or by blending for direct compression. Excipients include diluents, binders, disintegrants, dispersants, lubricants, glidants, stabilizers, surfactants and colorants. Diluents, also termed "fillers," can be used to increase the bulk of a tablet so that a practical size is provided for compression. Non-limiting examples of diluents include lactose, cellulose, microcrystalline cellulose, mannitol, dry starch, hydrolyzed starches, powdered sugar, talc, sodium chloride, silicon dioxide, titanium oxide, dicalcium phosphate dihydrate, calcium sulfate, calcium carbonate, alumina and kaolin. Binders can impart cohesive qualities to a tablet formulation and can be used to help a tablet remain intact after compression. Non-limiting examples of suitable binders include starch (including corn starch and pregelatinized starch), gelatin, sugars (e.g., glucose, dextrose, sucrose, lactose and sorbitol), celluloses, polyethylene glycol, waxes, natural and synthetic gums, e.g., acacia, tragacanth, sodium alginate, and synthetic polymers such as polymethacrylates and polyvinylpyrrolidone. Lubricants can also facilitate tablet manufacture; non-limiting examples thereof include magnesium stearate, calcium stearate, stearic acid, glyceryl behenate, and polyethylene glycol. Disintegrants can facilitate tablet disintegration after administration, and non-limiting examples thereof include starches, alginic acid, crosslinked polymers such as, e.g., crosslinked polyvinylpyrrolidone, croscarmellose sodium, potassium or sodium starch glycolate, clays, celluloses, starches, gums and the like. Non-limiting examples of suitable glidants include silicon dioxide, talc, and the like. Stabilizers can inhibit or retard drug decomposition reactions, including oxidative reactions. Surfactants can also include and can be anionic, cationic, amphoteric or nonionic. If desired, the tablets can also comprise nontoxic auxiliary substances such as pH buffering agents, preservatives, e.g., antioxidants, wetting or emulsifying agents, solubilizing agents, coating agents, flavoring agents, and the like.

In an embodiment, a softgel formulation is made with a gelatin mass for the outer shell, and a composition including one or more substances, for example microbial entities, for the capsule fill can be prepared. To make the gelatin mass, gelatin powder can be mixed with water and glycerin, heated, and stirred under vacuum. Additives, for example, flavors or colors, can be added to molten gelatin using a turbine mixer and transferred to mobile vessels. The gelatin mass can be kept in a steam-jacketed storage vessel at a constant temperature.

The encapsulation process can begin when the molten gel is pumped to a machine and two thin ribbons of gel are formed on either side of machine. These ribbons can then pass over a series of rollers and over a set of die that determine the size and shapes of capsules. A fill composition, for example a prebiotic and/or probiotic fill composition, can be fed to a positive displacement pump, which can dose the fill and inject it between two gelatin ribbons prior to sealing them together through the application of heat and pressure. To remove excess water, the capsules can pass through a conveyer into tumble dryers where a portion of the water can be removed. The capsules can then be placed on, for example, trays, which can be stacked and transferred into drying rooms. In the drying rooms, dry air can be forced over capsules to remove any excess moisture.

Release Formulations

Immediate-release formulations of an effective amount of a composition comprising microbial entities can comprise one or more combinations of excipients that allow for a rapid release of a pharmaceutically active agent (such as from 1 minute to 1 hour after administration). In an embodiment an excipient can be microcrystalline cellulose, sodium carboxymethyl cellulose, sodium starch glycolate, corn starch, colloidal silica, Sodium Laurel Sulphate, Magnesium Stearate, Prosolve SMCC (HD90), croscarmellose Sodium, Crospovidone NF, Avicel PH200, and combinations of such excipients.

"Controlled-release" formulations (also referred to as sustained release (SR), extended-release (ER, XR, or XL), time-release or timed-release, controlled-release (CR), or continuous-release) refer to the release of a prebiotic composition from a administration form at a particular desired point in time after the administration form is administered to a subject. Controlled-release formulations can include one or more excipients, including but not limited to microcrystalline cellulose, sodium carboxymethyl cellulose, sodium starch glycolate, corn starch, colloidal silica, Sodium Laurel Sulphate, Magnesium Stearate, Prosolve SMCC (HD90), croscarmellose Sodium, Crospovidone NF, or Avicel PH200. Generally, controlled-release includes sustained but otherwise complete release. A sudden and total release in the large intestine at a desired and appointed time or a release in the intestines such as through the use of an enteric coating are both considered controlled-release. Controlled-release can occur at a predetermined time or in a predetermined place within the digestive tract. It is not meant to include a passive, uncontrolled process as in swallowing a normal tablet. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; 5,733,556; 5,871,776; 5,902,632; and 5,837,284 each of which is incorporated herein by reference in its entirety.

In an embodiment, a controlled release administration form begins its release and continues that release over an extended period of time. Release can occur beginning almost immediately or can be sustained. Release can be constant, can increase or decrease over time, can be pulsed, can be continuous or intermittent, and the like. Generally, however, the release of at least one pharmaceutically active agent from a controlled-release administration form will exceed the amount of time of release of the drug taken as a normal, passive release tablet. Thus, for example, while all of at least one pharmaceutically active agent of an uncoated aspirin tablet should be released within, for example, four hours, a controlled-release administration form could release a smaller amount of aspirin over a period of six hours, 12 hours, or even longer. Controlled-release in accordance with the compositions and methods described herein generally means that the release occurs for a period of six hours or more, such as 12 hours or more.

In certain embodiments, a controlled release administration refers to the release of an agent, from a composition or administration form in which the agent is released according to a desired profile over an extended period of time. In an embodiment, controlled-release results in dissolution of an agent within 20-720 minutes after entering the stomach. In certain embodiments, controlled-release occurs when there is dissolution of an agent within 20-720 minutes after being swallowed. In certain embodiments, controlled-release occurs when there is dissolution of an agent within 20-720 minutes after entering the intestine. In certain embodiments, controlled-release results in substantially complete dissolution after at least 1 hour following administration. In certain embodiments, controlled-release results in substantially complete dissolution after at least 1 hour following oral administration. For example, controlled-release compositions allow delivery of an agent to a subject in need thereof over an extended period of time according to a predetermined profile. Such release rates can provide therapeutically effective levels of agent for an extended period of time and thereby provide a longer period of pharmacologic or diagnostic response as compared with conventional rapid release administration forms. Such longer periods of response provide for many inherent benefits that are not achieved with immediate-release administrations. When used in connection with the dissolution profiles discussed herein, the term "controlled-release" refers to wherein all or less than all of the total amount of a administration form, made according to methods and compositions described herein, delivers an active agent over a period of time greater than 1 hour.

In an aspect, controlled-release refers to delayed release of an agent, from a composition or administration form in which the agent is released according to a desired profile in which the release occurs after a period of time.

When present in a controlled-release oral administration form, the compositions described herein can be administered at a substantially lower daily administration level than immediate-release forms.

In an embodiment, the controlled-release layer is capable of releasing 30 to 40% of the one or more active agents (e.g., e.g., a microbial entity) contained therein in the stomach of a subject in need thereof in 5 to 10 minutes following oral administration. In another embodiment, the controlled-release layer is capable of releasing 90% of the one or more active agents (e.g., a microbial entity) is released in 40 minutes after oral administration.

In some embodiments, the controlled-release layer comprises one or more excipients, including but not limited to silicified microcrystalline cellulose (e.g., HD90), croscarmellose sodium (AC-Di-Sol), hydroxyl methyl propyl cellulose, magnesium stearate, or stearic acid. In an embodiment, a controlled release formulation weighs between 100 mg to 3 g.

Pharmaceutical carriers or vehicles suitable for administration of the compounds provided herein include all such carriers known to those skilled in the art to be suitable for the particular mode of administration. In addition, the compositions can one or more components that do not impair the desired action, or with components that supplement the desired action, or have another action.

In certain embodiments, an effective amount of the microbial entity is formulated in an immediate release form. In this embodiment, the immediate-release form can be included in an amount that is effective to shorten the time to its maximum concentration in the blood. By way of example, certain immediate-release pharmaceutical preparations are taught in United States Patent Publication US 2005/0147710A1 entitled, "Powder Compaction and Enrobing," which is incorporated herein in its entirety by reference.

The administration forms described herein can also take the form of pharmaceutical particles manufactured by a variety of methods, including but not limited to high-pressure homogenization, wet or dry ball milling, or small particle precipitation (nano spray). Other methods to make a suitable powder formulation are the preparation of a solution of active ingredients and excipients, followed by precipitation, filtration, and pulverization, or followed by removal of the solvent by freeze-drying, followed by pulverization of the powder to the desired particle size.

In a further aspect the administration form can be an effervescent administration form. Effervescent means that the administration form, when mixed with liquid, including water and saliva, evolves a gas. Some effervescent agents (or effervescent couple) evolve gas by means of a chemical reaction which takes place upon exposure of the effervescent disintegration agent to water or to saliva in the mouth. This reaction can be the result of the reaction of a soluble acid source and an alkali monocarbonate or carbonate source. The reaction of these two general compounds produces carbon dioxide gas upon contact with water or saliva. An effervescent couple (or the individual acid and base separately) can be coated with a solvent protective or enteric coating to prevent premature reaction. Such a couple can also be mixed with previously lyophilized particles (such as a prebiotic). The acid sources can be any which are safe for human consumption and can generally include food acids, acid and hydrite antacids such as, for example: citric, tartaric, amalic, fumeric, adipic, and succinics. Carbonate sources include dry solid carbonate and bicarbonate salt such as, preferably, sodium bicarbonate, sodium carbonate, potassium bicarbonate and potassium carbonate, magnesium carbonate and the like. Reactants which evolve oxygen or other gasses and which are safe for human consumption are also included. In an embodiment citric acid and sodium bicarbonate are used.

In certain aspects, the administration form can be in a candy form (e.g., matrix), such as a lollipop or lozenge. In an embodiment, an effective amount of a prebiotic is dispersed within a candy matrix. In an embodiment, the candy matrix comprises one or more sugars (such as dextrose or sucrose). In certain embodiments, the candy matrix is a sugar-free matrix. The choice of a particular candy matrix is subject to wide variation. Conventional sweeteners such as sucrose can be utilized, or sugar alcohols suitable for use with diabetic patients, such as sorbitol or mannitol can be employed. Other sweeteners, such as the aspartame, can also be easily incorporated into a composition in accordance with compositions described herein. The candy base can be very soft and fast dissolving, or can be hard and slower dissolving. Various forms will have advantages in different situations.

A candy mass composition comprising an effective amount of the microbial entities can be orally administered to a subject in need thereof so that an effective amount of the microbial entities will be released into the subject's mouth as the candy mass dissolves and is swallowed. A subject in need thereof includes a human adult or child.

In an embodiment, a candy mass is prepared that comprises one or more layers which can comprise different amounts or rates of dissolution of the microbial entity. In an embodiment a multilayer candy mass (such as a lollipop) comprises an outer layer with a concentration of the microbial entity differing from that of one or more inner layers. Such a drug delivery system has a variety of applications.

The choices of matrix and the concentration of the drug in the matrix can be important factors with respect to the rate of drug uptake. A matrix that dissolves quickly can deliver drug into the subject's mouth for absorption more quickly than a matrix that is slow to dissolve. Similarly, a candy matrix that contains the prebiotic in a high concentration can release more of the prebiotic in a given period of time than a candy having a low concentration. In an embodiment a candy matrix such as one disclosed in U.S. Pat. No. 4,671,953 or US Application Publication No. 2004/0213828 (which are herein incorporated by reference in their entirety) is used to deliver the prebiotic.

The administration forms described herein can also take the form of pharmaceutical particles manufactured by a variety of methods, including but not limited to high-pressure homogenization, wet or dry ball milling, or small particle precipitation (e.g., nGimat's NanoSpray). Other methods useful to make a suitable powder formulation are the preparation of a solution of active ingredients and excipients, followed by precipitation, filtration, and pulverization, or followed by removal of the solvent by freeze-drying, followed by pulverization of the powder to the desired particle size. In an embodiment the pharmaceutical particles have a final size of 3-1000 µM, such as at most 3, 4, 5, 6, 7, 8, 9, 10, 20, 30, 40, 50, 60, 70, 80, 90, 100, 150, 200, 250, 300, 350, 400, 450, 500, 550, 600, 650, 700, 750, 800, 850, 900, 950, 1000 µM. In certain embodiments, the pharmaceutical particles have a final size of 10-500 µM. In another embodiment the pharmaceutical particles have a final size of 50-600 µM. In another embodiment, the pharmaceutical particles have a final size of 100800 µM.

In an embodiment, an oral administration form (such as a powder, tablet, or capsule) is provided comprising a prebiotic composition comprising 0.7 g of FOS, GOS, or other FOS, GOS, or other appropriate polysaccharide, 0.2 g of lactose, 0.01 g of glucose, 0.01 g of galactose, 0.1-0.2 g of a binder, 0.1-0.2 g of a dispersant, 0.1-0.2 g of a solubilizer, wherein the FOS, GOS, or other FOS, GOS, or other appropriate polysaccharide are composed of 1-25% disaccharides, 1-25% trisaccharides, 1-25% tetrasaccharides, and 1-25% pentasaccharides. The oral administration form can be in the form of a powder, capsule, or tablet. Suitable amounts of binders, dispersants, and solubilizers are known in the art for preparation of oral tablets or capsules.

In certain embodiments, an oral administration form (such as a powder, tablet or capsule) is provided comprising microbial entities comprising 1-99.9% by weight of FOS, GOS, or other FOS, GOS, or other appropriate polysaccharide 0.5-20% by weight of lactose, 0.1-2% by weight of glucose, 0.1-2% by weight of galactose, 0.05-2% by weight of a binder, 0.05-2% by weight of a dispersant, 0.05-2% by weight of a solubilizer, wherein the FOS, GOS, or other FOS, GOS, or other appropriate polysaccharide are composed of 1-25% by weight disaccharides, 1-25% by weight trisaccharides, 1-25% by weight tetrasaccharides, and 1-25% by weight pentasaccharides.

In certain embodiments, an oral administration form (such as a powder, tablet, or capsule) is provided comprising microbial entities comprising 1, 10, 20, 30, 40, 50, 60, 70, 80, 90, 95, 99.5, 100% by weight of FOS, GOS, or other FOS, GOS, or other appropriate polysaccharide 0, 5, 10, 15, or 20% by weight of lactose, 0.1, 0.5, 1, or 2% by weight of glucose, 0.1, 0.5, 1, or 2% by weight of galactose, 0.05, 0.1, 0.5, 1, or 2% by weight of a binder, 0.05, 0.1, 0.5, 1, or 2% by weight of a dispersant, 0.05, 0.1, 0.5, 1, or 2% by weight of a solubilizer, wherein the FOS, GOS, or other FOS, GOS, or other appropriate polysaccharide are composed of 1, 5, 10, 15, 20, or 25% by weight disaccharides, 1, 5, 10, 15, 20, or 25% by weight trisaccharides, 1, 5, 10, 15, 20, or 25% by weight tetrasaccharides, and 1, 5, 10, 15, 20, or 25% by weight pentasaccharides.

In certain embodiments, an oral administration form is provided comprising a composition comprising microbial entities, wherein the oral administration form is a syrup. The syrup can comprise 1%, 5%, 10%, 15%, 20%, 25%, 30%, 35%, 40%, 45%, 50%, 55%, 60%, 65%, 70%, 75%, 80%, or 85% solid. The syrup can comprise 15%, 20%, 25%, 30%, 35%, 40%, 45%, or 50% liquid, for example, water. The syrup can comprise a composition comprising microbial entities. The syrup can be, for example, 1-96%, 10-96%, 20-96%, 30-96%, 40-96%, 50-96%, 60-96%, 70-96%, 80-96%, or 90-96% microbial entities. The syrup can be, for example, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, or 96% microbial entities. In an embodiment, a composition comprises FOS, GOS, or other FOS, GOS, or other appropriate polysaccharide.

In an embodiment, the softgel capsule is 0.25 mL, 0.5 mL, 1.0 mL, 1.25 mL, 1.5 mL, 1.75 mL, or 2.0 mL. In another embodiment, a softgel capsule comprises 0.1 g to 2.0 g of prebiotic composition. In another embodiment, a softgel capsule comprises 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, or 2.0 g of a prebiotic composition. In certain embodiments, a softgel capsule comprises FOS, GOS, or other FOS, GOS, or other appropriate polysaccharide and inulin or FOS.

In certain embodiments, the composition is delivered in a gelatin capsule containing an amount of FOS, GOS, or other FOS, GOS, or other appropriate polysaccharide within the ranges listed in Table 2. In certain embodiments, the number of pills taken per day is within the ranges listed in Table 2.

TABLE 2

Exemplary GOS administration Units
Exemplary GOS Composition
Administrations in Gel Caps

| Size | GOS/Pill (g) | # pills per day |
|---|---|---|
| 000 | 1-2 | 1-15 |
| 00 | 0.6-1.5 | 1-25 |
| 0 | 0.4-1.1 | 1-38 |
| 1 | 0.3-0.8 | 1-50 |
| 2 | 0.25-0.6 | 1-60 |
| 3 | 0.2-0.5 | 1-75 |
| 4 | 0.14-0.3 | 1-837 |

In certain embodiments, a composition is provided that does not contain a preservative. In another embodiment, a composition is provided that does not contain an antioxidant. In another embodiment, a composition is provided that does not contain a preservative or an antioxidant. In an embodiment, a composition comprising FOS, GOS, or other FOS, GOS, or other appropriate polysaccharide does not contain a preservative or an antioxidant.

In certain embodiments, a composition is formulated as a viscous fluid. In another embodiment, a composition is formulated such that its water content is low enough that it does not support microbial growth. In an embodiment, this composition is an intermediate-moisture food, with a water activity between 0.6 and 0.85; in another embodiment this composition is a low-moisture food, with a water activity less than 0.6. Low-moisture foods limit microbial growth significantly and can be produced by one of ordinary skill in the art. For example, these products could be produced similarly to a liquid-centered cough drop. In another embodiment, a prebiotic composition is formulated as a viscous fluid without a preservative in a gel capsule. In an embodiment, a composition comprising FOS, GOS, or other FOS, GOS, or other appropriate polysaccharide is a viscous fluid. In an embodiment, a composition comprises a high percentage of FOS, GOS, or other FOS, GOS, or other appropriate polysaccharide that does not support microbial growth. In certain embodiments, the composition comprises FOS, GOS, or other FOS, GOS, or other appropriate polysaccharide and inulin or FOS.

In certain embodiments, an oral administration form is provided comprising a composition comprising microbial entities, wherein the oral administration form is a softgel. In an embodiment the softgel comprises a syrup. In an embodiment the syrup comprises a composition comprising microbial entities. In an embodiment the composition comprises FOS, GOS, or other FOS, GOS, or other appropriate polysaccharide. In another embodiment the composition comprises more than 80% FOS, GOS, or other FOS, GOS, or other appropriate polysaccharide. In an embodiment, the composition comprises between 80-99.9% FOS, GOS, or other. In an embodiment, the composition comprises more than 80% FOS, GOS, or other FOS, GOS, or other appropriate polysaccharide. In an embodiment, the composition comprises 80, 81, 82, 83, 84, 85, 86, 87, 88, 89, 90, 91, 92, 93, 94, 95, 96, 97, 98, 99, or 99.9% FOS, GOS, or other FOS, GOS, or other appropriate polysaccharide.

In an embodiment a FOS, GOS, or other FOS, GOS, or other appropriate polysaccharide composition is formulated for delivery in a soft gel capsule. In an embodiment a FOS, GOS, or other FOS, GOS, or other appropriate polysaccharide composition formulated for delivery in a soft gel capsule is a high percentage FOS, GOS, or other FOS, GOS, or other appropriate polysaccharide composition, such as a 90-100% FOS, GOS, or other FOS, GOS, or other appropriate polysaccharide composition (e.g., 90, 91, 92, 93, 94, 95, 96, 97, 98, 99 or 100% FOS, GOS, or other FOS, GOS, or other appropriate polysaccharide composition by weight). In another embodiment a FOS, GOS, or other FOS, GOS, or other appropriate polysaccharide composition formulated for delivery in a soft gel capsule comprises 95% FOS, GOS, or other FOS, GOS, or other appropriate polysaccharide. In another embodiment a FOS, GOS, or other FOS, GOS, or other appropriate polysaccharide composition formulated for delivery in a soft gel capsule comprises 96% FOS, GOS, or other FOS, GOS, or other appropriate polysaccharide. In another embodiment, the FOS, GOS, or other FOS, GOS, or other appropriate polysaccharide composition is formulated such that its water content is low enough that it does not support microbial growth. In another embodiment, the FOS, GOS, or other FOS, GOS, or other appropriate polysaccharide composition is formulated as a viscous fluid without a preservative in a gel capsule. In another embodiment, the FOS, GOS, or other FOS, GOS, or other appropriate polysaccharide composition is formulated as a viscous fluid without an antioxidant in a gel capsule. In another embodiment the soft gel capsule comprises 0.1-2 g of a FOS, GOS, or other FOS, GOS, or other appropriate polysaccharide composition.

In certain embodiments, a composition described can be formulated as described, in U.S. Pat. No. 6,750,331, which is herein incorporated by reference in its entirety. A composition can be formulated to comprise an oligosaccharide, a foaming component, a water-insoluble dietary fiber (e.g., cellulose or lignin), or a neutralizing component. In an embodiment, a composition comprises a prebiotic fiber. In an embodiment, a composition can be in the form of a chewable tablet.

In an embodiment, a foaming component can be at least one member selected from the group consisting of sodium hydrogen carbonate, sodium carbonate, and calcium carbonate. In an embodiment, a neutralizing component can be at least one member selected from the group consisting of citric acid, L-tartaric acid, fumaric acid, L-ascorbic acid, DL-malic acid, acetic acid, lactic acid, and anhydrous citric acid. In an embodiment, a water-insoluble dietary fiber can be at least one member selected from the group consisting of crystalline cellulose, wheat bran, oat bran, cone fiber, soy fiber, and beet fiber. The formulation can contain a sucrose fatty acid ester, powder sugar, fruit juice powder, and/or flavoring material.

Formulations of the provided invention can include additive components selected from various known additives. Such additives include, for example, saccharides (excluding oligosaccharides), sugar alcohols, sweeteners and like excipients, binders, disintegrators, lubricants, thickeners, surfactants, electrolytes, flavorings, coloring agents, pH modifiers, fluidity improvers, and the like. Specific examples of the additives include wheat starch, potato starch, corn starch, dextrin and like starches; sucrose, glucose, fructose, maltose, xylose, lactose and like saccharides (excluding oligosaccharides); sorbitol, mannitol, maltitol, xylitol and like sugar alcohols; calcium phosphate, calcium sulfate and like excipients; starch, saccharides, gelatin, gum arabic, dextrin, methyl cellulose, polyvinylpyrrolidone, polyvinyl alcohol, hydroxypropylcellulose, xanthan gum, pectin, gum tragacanth, casein, alginic acid and like binders and thickeners; leucine, isoleucine, L-valine, sugar esters, hardened oils, stearic acid, magnesium stearate, talc, macrogols and like lubricants; CMC, CMC-Na, CMC-Ca and like disintegrators; polysorbate, lecithin and like surfactants; aspartame, alitame and like dipeptides; silicon dioxide and like fluidity improvers; and *stevia*, saccharin, and like sweeteners. The amounts of these additives can be properly selected based on their relation to other components and properties of the preparation, production method, etc.

In an embodiment, a FOS, GOS, or other FOS, GOS, or other appropriate polysaccharide composition is a chewable oral administration formulation. In an embodiment the chewable formulation can comprises between 1-99.9% FOS, GOS, or other FOS, GOS, or other appropriate polysaccharide. In an embodiment, a FOS, GOS, or other FOS, GOS, or other appropriate polysaccharide composition comprises 80% FOS, GOS, or other FOS, GOS, or other appropriate polysaccharide 5% L-ascorbic acid, 2% anhydrous citric acid, 3% sodium hydrogencarbonate, 3% calcium carbonate, 2% sucrose fatty acid, 3% fruit juice powder, and 2% potassium carbonate.

In an embodiment, a FOS, GOS, or other FOS, GOS, or other appropriate polysaccharide composition comprises 85% FOS, GOS, or other FOS, GOS, or other appropriate polysaccharide, 5% L-ascorbic acid, 3% sodium hydrogencarbonate, 2% sodium carbonate, 2% sucrose fatty acid ester, 2% fruit juice powder, and 1% potassium carbonate.

In an embodiment, a FOS, GOS, or other FOS, GOS, or other appropriate polysaccharide composition comprises 90% FOS, GOS, or other FOS, GOS, or other appropriate polysaccharide, 2% L-ascorbic acid, 1% anhydrous citric acid, 2% sodium hydrogencarbonate, 2% sodium carbonate, 2% sucrose fatty acid ester, and 1% potassium carbonate.

In an embodiment, a FOS, GOS, or other FOS, GOS, or other appropriate polysaccharide composition comprises 95% FOS, GOS, or other FOS, GOS, or other appropriate polysaccharide, 2% L-ascorbic acid, 1% sodium hydrogencarbonate, and 2% fruit juice powder. In another embodiment, a FOS, GOS, or other FOS, GOS, or other appropriate polysaccharide composition comprises 95% FOS, GOS, or other FOS, GOS, or other appropriate polysaccharide and 5% of L-ascorbic acid, anhydrous citric acid, sodium hydrogencarbonate, calcium carbonate, sucrose fatty acid, fruit juice powder, or potassium carbonate.

In an embodiment, a FOS, GOS, or other FOS, GOS, or other appropriate polysaccharide composition comprises 95% FOS, GOS, or other FOS, GOS, or other appropriate polysaccharide and 5% of L-ascorbic acid, anhydrous citric acid, sodium hydrogencarbonate, calcium carbonate, sucrose fatty acid, fruit juice powder, and potassium carbonate.

The microbial entities according to the present invention that is to be given to an individual, administration is preferably in a "therapeutically effective amount" that is sufficient to show benefit to the individual. A "prophylactically effective amount" can also be administered, when sufficient to show benefit to the individual. The actual amount administered, and rate and time-course of administration, will depend on the nature and severity of protein aggregation disease being treated. Prescription of treatment, e.g. decisions on administration etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

Medical Foods

An alternate embodiment of the present disclosure is a formulation as a medical food. The consuming public has come to understand that foods possess more than basic nutrition (protein, carbohydrate, fat, etc.). For example, 95% of consumers agree that "certain foods have health benefits that go beyond basic nutrition and may reduce the risk of disease or other health concerns." More than 50% of consumers believe that foods can replace the use of drugs. Replacing the use of drugs may have the benefit of reducing the incidence of adverse side effects suffered by patients following a pharmaceutical drug treatment regimen. In fact, medical foods are assumed to be generally safe, as people have historically consumed these foods safely in non-medical contexts.

The compositions of the invention may be administered under the supervision of a medical specialist, or may be self-administered. Medical foods could take the form of nutritional shakes or other liquids or meal replacements. Medical foods of the present invention could also take the form of a powder capable of being consumed upon addition to suitable food or liquid. Medical foods could also take the form of a pill, tablet or capsule.

A medical food formulation of the present disclosure could confer benefits of a synthetic composition of microbes isolated from nutritionally beneficial plants, as well as the benefits of prebiotics, or other nutritionally beneficial inclusions, but not consumed to obtain nutrition from them but rather to provide a metabolic function different than a foodstuff. For example, medical foods of the disclosure may also include at least one vitamin, or vitamin precursor, Preferred vitamins possess antioxidant properties and include vitamins A, C and E, and/or their biochemical precursors. Another embodiment of the medical foods of the invention also includes at least one trace element, preferably selected from the group consisting of zinc, manganese and selenium. Medical foods of the disclosure also may include at least One additional antioxidant selected from the group consisting of carotenoids, N-acetylcysteine and L-glutamine, it is known to those of skill in the art how to construct medical foods containing these elements.

Medical foods of the present disclosure would include effective concentration of microbial entities deemed useful for the indication and effective concentrations of any vitamin, prebiotic, or other beneficial additive not consumed to obtain nutrition but to add a therapeutic benefit mediated by the production of SCFA or other immuno-stimulant molecules when passing through the GI tract.

In some embodiments, the composition comprising the microbial entities is a solid foodstuff. Suitable examples of a solid foodstuff include without limitation a food bar, a snack bar, a cookie, a brownie, a muffin, a cracker, a biscuit, a cream or paste, an ice cream bar, a frozen yogurt bar, and the like. In some embodiments, the compositions disclosed herein are incorporated into a therapeutic food. In some embodiments, the medical food is a ready-to-use food that optionally contains some or all essential macronutrients and micronutrients. In some embodiments, the compositions disclosed herein are incorporated into a supplementary food that is designed to be blended into an existing meal. In some embodiments, the supplemental food contains some or all essential macronutrients and micronutrients. In some embodiments, compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

Typically, the dietary supplements and medical foods of the present disclosure are consumed at least once daily, and preferably administered two times per day, preferably once in the morning and once in the afternoon. A typical administration regime for the dietary supplements or medical foods will continue for four to eight weeks. Depending on such factors as the medical condition being managed and the response of the patient, the administration regime may be extended. A medical food of the present invention will typically be consumed in two servings per day as either a meal replacement or as a snack between meals.

Anyone perceived to be at risk of a immune system disorder or other indication described herein can potentially benefit from ingesting the compositions of the disclosure. It is believed to be possible to effectively ameliorate symptoms and conditions associated with immune system disorders and other indications described herein with natural compounds, which do not show any severe side effects. Furthermore, the present methods are expected to be well-tolerated, for example without causing any discomfort or nausea, and simple to apply.

In certain aspects, described herein are medical foods comprising:
(i) a first microbial entity of the pharmaceutical compositions described herein;
(ii) a second microbial entity of the pharmaceutical compositions described herein;
and
(iii) an excipient.

In certain embodiments, the medical food further comprises a metabolite selected from Table 5 or Table 7. In certain embodiments, the first microbial entity comprises one or more bacteria that are capable of producing a metabolite selected from Table 5 or Table 7. In certain embodiments, the first microbial entity comprises one or more fungi that are capable of producing a metabolite selected from Table 5 or Table 7. In certain embodiments, the first microbial entity utilizes a metabolite produced by the second microbial entity. In certain embodiments, the first microbial entity utilizes a metabolite selected from Table 5 or Table 7. In certain embodiments, the medical food further comprises a metabolite produced by the first microbial entity, produced by the second microbial entity, or combinations thereof.

In certain embodiments, the medical food further comprises a prebiotic fiber. In certain embodiments, the medical food further comprises at least one additional microbial entity.

In certain embodiments, the medical food is formulated in an oral administration form comprising between $1 \times 10^6$ and $1 \times 10^{12}$ cfu/administration of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production of at least one anti-inflammatory metabolite by either the first microbial entity, the second microbial entity or both the first and the second microbial entities. In certain embodiments, administering an effective amount of the medical food to a human subject reduces the level and/or activity of at least one inflammatory cytokine from Table 8 relative to a level and/or activity of the inflammatory cytokine in the serum of the human subject; or a tissue of the subject, prior to administering the medical food to the subject.

In certain embodiments, administering an effective amount of the medical food to a human subject enables the dietary management of at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, or combinations thereof. In certain embodiments, the human subject has an altered Th17 activity.

In certain embodiments, administering an effective amount of the medical food to a human subject enables the dietary management of at least one symptom in the subject of a rheumatic disease selected from rheumatoid arthritis, spondyloarthritis, and psoriasis.

In certain embodiments, administering an effective amount of the medical food to a human subject enables the dietary management of at least one symptom in the subject of periodontal disease.

In certain embodiments, administering an effective amount of the medical food to a human subject enables the dietary management of at least one symptom in the subject of gastritis. In certain embodiments, the gastritis is *H. pylori*-associated gastritis.

In certain aspects, described herein is a solid food stuff comprising:
(i) a first microbial entity of the pharmaceutical compositions described herein;
(ii) a second microbial entity of the pharmaceutical compositions described herien;
and
(iii) an excipient.

In certain embodiments, the solid food stuff further comprises a metabolite selected from Table 5 or Table 7. In certain embodiments, the solid stuff further comprises a metabolite produced by the first bacterial entity, produced by the first fungal entity, or combinations thereof. In certain embodiments, the solid food stuff further comprises a prebiotic fiber. In certain embodiments, the solid food stuff further comprises at least one additional microbial entity. In certain embodiments, the solid food stuff is formulated in an oral administration form comprising between $1 \times 10^6$ and $1 \times 10^{12}$ cfu/administration of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production at least one anti-inflammatory metabolite by either the first microbial entity, the second microbial entity, or both the first and the second microbial entities.

In certain embodiments, administering an effective amount of the solid food stuff to a human subject reduces the level and/or activity of at least one inflammatory cytokine from Table 8 relative to a level and/or activity of the inflammatory cytokine in the serum of the human subject; or a tissue of the subject, prior to administering the solid food stuff to the subject.

In certain embodiments, administering an effective amount of the solid food stuff to a human subject enables the dietary management of at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and combinations thereof. In certain embodiments, the human subject has an altered Th17 activity.

In certain embodiments, administering an effective amount of the solid food stuff to a human subject enables the dietary management of at least one symptom in the subject of a rheumatic disease selected from rheumatoid arthritis, spondyloarthritis, and psoriasis.

In certain embodiments, administering an effective amount of the solid food stuff to a human subject enables the dietary management of at least one symptom in the subject of periodontal disease.

In certain embodiments, administering an effective amount of the solid food stuff to a human enables the dietary management of at least one symptom in the subject of gastritis. In certain embodiments, the gastritis is *H. pylori*-associated gastritis.

Dietary Supplements

In certain aspects, described herein are dietary supplements comprising:
(i) a first microbial entity of the pharmaceutical compositions described herein;
(ii) a second microbial entity of the pharmaceutical compositions described herein;
and
(iii) an excipient.

In certain embodiments, the dietary supplement further comprises a metabolite selected from Table 5 or Table 7. In certain embodiments, the first microbial entity comprises one or more bacteria that are capable of producing a metabolite selected from Table 5 or Table 7. In certain embodiments, the first microbial entity comprises one or more fungi that are capable of producing a metabolite selected from Table 5 or Table 7. In certain embodiments, the first microbial entity utilizes a metabolite produced by the second microbial entity. In certain embodiments, the first microbial entity utilizes a metabolite selected from Table 5 or Table 7. In certain embodiments, the dietary supplement further comprises a metabolite produced by the first microbial entity, produced by the second microbial entity, or combinations thereof. In certain embodiments, the dietary supplement further comprises a prebiotic fiber. In certain embodiments, the dietary supplement further comprises at least one additional microbial entity. In certain embodiments, the dietary supplement is formulated in an oral administration form comprising between $1\times10^6$ and $1\times10^{12}$ cfu/administration of each of the first microbial entity and the second microbial entity.

In certain embodiments, the first microbial entity and the second microbial entity synergize to produce an anti-inflammatory effect in a mammalian host. In certain embodiments, the anti-inflammatory effect in a mammalian host is caused by the production of at least one anti-inflammatory metabolite by either the first microbial entity, the second microbial entity or both the first and the second microbial entities. In certain embodiments, administering an effective amount of the dietary supplement to a human subject reduces the level and/or activity of at least one inflammatory cytokine from Table 8 relative to a level and/or activity of the inflammatory cytokine in the serum of the human subject; or a tissue of the subject, prior to administering the dietary supplement to the subject.

In certain embodiments, administering an effective amount of the dietary supplement to a human subject reduces and/or prevents at least one symptom in the subject of an immune system disorder. In certain embodiments, the immune system disorder is selected from allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, or combinations thereof. In certain embodiments, the human subject has an altered Th17 activity.

In certain embodiments, administering an effective amount of the dietary supplement to a human subject reduces and/or prevents at least one symptom in the subject of a rheumatic disease selected from rheumatoid arthritis, spondyloarthritis, and psoriasis.

In certain embodiments, administering an effective amount of the dietary supplement to a human subject reduces and/or prevents at least one symptom in the subject of periodontal disease.

In certain embodiments, administering an effective amount of the dietary supplement to a human subject reduces and/or prevents at least one symptom in the subject of gastritis. In certain embodiments, the gastritis is *H. pylori*-associated gastritis.

Methods of Use

Methods for Improving Immune Health

In certain aspects, described herein are methods of improving immune health in a subject, the method comprising administering to the subject an effective amount of the pharmaceutical composition, medical food, dietary supplement or solid food stuff described herein. In certain embodiments, the method modulates the level and/or activity of an inflammatory cytokine in a subject. In certain embodiments, the modulating the level and or activity of an inflammatory cytokine, comprises reducing the level and/or activity of at least one inflammatory cytokine from Table 8. In certain embodiments, the level and/or activity of the at least one inflammatory cytokine from Table 8 is reduced in the serum or select tissue of subject after administration of the pharmaceutical composition, medical food, dietary supplement or solid food stuff compared to a level and/or activity of the at least one inflammatory cytokine from Table 8 prior to administration of the pharmaceutical composition, medical food, dietary supplement or solid food stuff. In certain embodiments, the inflammatory cytokine is selected from the group consisting of IFNγ, IL-12, TNF-α, IL-17, IL-6, IL-1β, IL-10, and combinations thereof. In certain embodiments, the level and/or activity of the at least one inflammatory cytokine in the serum or select tissue of a human subject after the administration of the effective amount of the pharmaceutical composition, medical food, dietary supplement or solid food stuff. In certain embodiments, the method causes an anti-inflammatory effect in the subject. In certain embodiments, the anti-inflammatory effect is caused by the production of at least one anti-inflammatory metabolite by either the first microbial entity, the second microbial entity or both the first and the second microbial entities. In certain embodiments, the method prevents, reduces the severity of, and/or enables the dietary management of an immune system disorder. In certain embodiments, the immune system disorder is selected from the group consisting of allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and combinations thereof.

In certain embodiments, the first microbial entity and the second microbial entity synergize to produce an anti-inflammatory effect in a mammalian host. In certain embodiments, the anti-inflammatory effect in a mammalian host is caused by the production at least one anti-inflammatory metabolite by either the first microbial entity, the second microbial entity or both the first and the second microbial entities. In certain embodiments, administering an effective dose of the pharmaceutical composition to a human subject reduces the level and/or activity of at least one inflammatory cytokine from Table 8 relative to a level and/or activity of the inflammatory cytokine in the serum of the human subject; or a tissue of the subject, prior to administering the pharmaceutical composition to the subject.

In certain aspects, disclosed herein are methods of improving immune health, comprising administering to a subject an effective amount of a composition comprising viable microbes disclosed herein. In certain embodiments, the method of improving immune health comprises administering to a human subject an effective amount of a composition comprising viable microbes, comprising:
 (ix) a first microbial entity comprising a first bacterial population comprising *Lactobacillus brevis*;
 (x) a second microbial entity comprising a second bacterial population comprising *Lactococcus lactis*;
 (xi) a third microbial entity comprising a third bacterial population comprising *Bacillus velenzensis*; and.
 (xii) a fourth microbial entity comprising a fourth bacterial population comprising *Lactobacillus harbinensis*.

In certain aspects, disclosed herein are methods of improving immune health, comprising administering to a human subject an effective amount of a composition comprising viable microbes, comprising:
 (xiii) a first microbial entity comprising a first bacterial population comprising *Lactobacillus brevis*;
 (xiv) a second microbial entity comprising a second bacterial population comprising *Lactococcus lactis*;
 (xv) a third microbial entity comprising a third bacterial population comprising *Bacillus velenzensis*; and.
 (xvi) a fourth microbial entity comprising a fourth bacterial population comprising *Lactobacillus harbinensis*.

In certain aspects, disclosed herein are methods of improving immune health, comprising administering to a human subject an effective amount of a composition comprising:
 (i) a first microbial entity comprising a first bacterial species comprising a 16S rDNA sequence that is at least 97% identical to a 16S rDNA sequence set forth in SEQ ID NO: 43;
 (ii) a second microbial entity comprising a second bacterial species comprising a 16S rDNA sequence that is at least 97% identical to a 16S rDNA sequence set forth in SEQ ID NO: 224;
 (iii) a third microbial entity comprising a third bacterial species comprising a 16S rDNA sequence that is at least 97% identical to a 16S rDNA sequence set forth in SEQ ID NO: 221; and
 (iv) a fourth microbial entity comprising a fourth bacterial species comprising a 16S rDNA sequence that is at least 97% identical to a 16S rDNA sequence set forth in SEQ ID NO: 198.

Methods of Reducing Inflammation

In certain aspects, described herein are methods of reducing inflammation in a subject in need thereof, comprising administering to the subject and effective amount of a composition comprising viable microbes described herein. In certain embodiments, the method modulates the level and/or activity of an inflammatory cytokine in a subject. In certain embodiments, the modulating the level and or activity of an inflammatory cytokine, comprises reducing the level and/or activity of at least one inflammatory cytokine from Table 8. In certain embodiments, the level and/or activity of the at least one inflammatory cytokine from Table 8 is reduced in the serum or select tissue of subject after administration of the pharmaceutical composition, medical food, dietary supplement or solid food stuff compared to a level and/or activity of the at least one inflammatory cytokine from Table 8 prior to administration of the pharmaceutical composition, medical food, dietary supplement or solid food stuff. In certain embodiments, the inflammatory cytokine is selected from the group consisting of IFNγ, IL-12, TNF-α, IL-17, IL-6, IL-1β, IL-10, and combinations thereof. In certain embodiments, the level and/or activity of the at least one inflammatory cytokine in the serum or select tissue of a human subject after the administration of the effective amount of the pharmaceutical composition, medical food, dietary supplement or solid food stuff. In certain embodiments, the method causes an anti-inflammatory effect in the subject. In certain embodiments, the anti-inflammatory effect is caused by the production of at least one anti-inflammatory metabolite by either the first microbial entity, the second microbial entity or both the first and the second microbial entities. In certain embodiments, the method prevents, reduces the severity of, and/or enables the dietary management of an immune system disorder. In certain embodiments, the immune system disorder is selected from the group consisting of allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, and combinations thereof.

In certain embodiments, the first microbial entity and the second microbial entity synergize to produce an anti-inflammatory effect in a mammalian host. In certain embodiments, the anti-inflammatory effect in a mammalian host is caused by the production at least one anti-inflammatory metabolite by either the first microbial entity, the second microbial entity or both the first and the second microbial entities. In certain embodiments, administering an effective dose of the pharmaceutical composition to a human subject reduces the level and/or activity of at least one inflammatory cytokine from Table 8 relative to a level and/or activity of the inflammatory cytokine in the serum of the human subject; or a tissue of the subject, prior to administering the pharmaceutical composition to the subject.

In certain embodiments, the method of inhibiting inflammation comprises: administering to a human subject an effective amount of a composition comprising:
 (i) a first microbial entity comprising a first bacterial species comprising a 16S rDNA sequence that is at least 97% identical to a 16S rDNA sequence set forth in SEQ ID NO: 43
 (ii) a second microbial entity comprising a second bacterial species comprising a 16S rDNA sequence that is at least 97% identical to a 16S rDNA sequence set forth in SEQ ID NO: 224;
 (iii) a third microbial entity comprising a third bacterial species comprising a 16S rDNA sequence that is at least 97% identical to a 16S rDNA sequence set forth in SEQ ID NO: 221; and
 (iv) a fourth microbial entity comprising a fourth bacterial species comprising a 16S rDNA sequence that is at least 97% identical to a 16S rDNA sequence set forth in SEQ ID NO: 198.

In certain embodiments, the method results in higher circulating levels of at least one anti-inflammatory marker and/or lower circulating levels of at least one inflammation-associated marker in the human subject. In certain embodiments, the human subject has lower circulating levels of at least one anti-inflammatory marker and/or higher circulating levels of at least one inflammation-associated marker prior to administration of the composition.

Immune System Disorders

In certain embodiments, described herein are methods of treating, preventing or reducing the severity and/or enabling the dietary management of at least one symptom of an immune system disorder, comprising administering to a human subject an effective amount of a composition composition (e.g., pharmaceutical composition, medical food, dietary supplement, or solid foodstuff) described herein.

In certain embodiments, the immune system disorder is the immune system disorder is selected from the group consisting of allergic rhinitis, allergic conjunctivitis, allergic bronchial asthma, atopic eczema, anaphylaxis, insect sting, drug allergy, food allergy, asthma, eczema, a disorder or condition associated with a pathological Th17 activity, aging-associated inflammation, and combinations thereof.

In certain embodiments, the first microbial entity and the second microbial entity synergize to produce an anti-inflammatory effect in a mammalian host. In certain embodiments, the anti-inflammatory effect in a mammalian host is caused by the production at least one anti-inflammatory metabolite by either the first microbial entity, the second microbial entity or both the first and the second microbial entities. In certain embodiments, administering an effective dose of the pharmaceutical composition to a human subject reduces the level and/or activity of at least one inflammatory cytokine from Table 8 relative to a level and/or activity of the inflammatory cytokine in the serum of the human subject; or a tissue of the subject, prior to administering the pharmaceutical composition to the subject. In certain embodiments, the methods described herein further comprise administering an effective amount of one or more immunosuppressive agents and/or anti-inflammatory agents known in the art in combination with a pharmaceutical composition, medical food, dietary supplement, or food stuff described herein.

Reduction of Inflammatory Cytokines

In certain embodiments, described herein are methods of reducing the level and/or activity of at least one inflammatory cytokine comprising administering an effective amount to a human subject an effective amount of a composition composition (e.g., pharmaceutical composition, medical food, dietary supplement, or solid foodstuff) described herein. In certain embodiments, described herein are methods of reducing the level and/or activity of at least one inflammatory cytokine associated with aging comprising administering an effective amount to a human subject an effective amount of a composition (e.g., a pharmaceutical composition, medical food, dietary supplement, or food stuff) described herein. In certain embodiments, described herein are methods of treating or preventing inflammation or a condition associated with inflammation comprising administering an effective amount to a human subject an effective amount of a composition (e.g., a pharmaceutical composition, medical food or food stuff) described herein. In certain embodiments, the inflammatory cytokine is one from Table 8 In certain embodiments, the inflammatory cytokine is reduced in the serum or select tissue of the human subject after administration of a composition (e.g., a pharmaceutical composition, medical food, dietary supplement, or food stuff) compared to a level and/or activity of the at least one inflammatory cytokine from Table 8 prior to administration of the composition (e.g., pharmaceutical composition, medical food, or food stuff). In certain embodiments, the methods described herein further comprise administering an effective amount of one or more immunosuppressive agents and/or anti-inflammatory agents known in the art in combination with a pharmaceutical composition, medical food, dietary supplement, or food stuff described herein.

Rheumatic Disease

In certain embodiments, described herein are methods of treating or preventing and/or enabling the dietary management of at least one symptom of a rheumatic disease comprising administering an effective amount to a human subject an effective amount of a composition (e.g., pharmaceutical composition, medical food, dietary supplement, or solid foodstuff) described herein. In certain embodiments, the rheumatic disease is rheumatoid arthritis, spondyloarthritis, or psoriasis. In certain embodiments, the rheumatic disease is rheumatoid arthritis. In certain embodiments, the symptom of rheumatic disease is selected from synovial hyperplasia, articular cartilage damage, damage to the metaphyseal bone, or combinations thereof. In certain embodiments, the methods described herein further comprise administering an effective amount of one or more additional agents known in the art for treating, preventing, reducing the severity of one or more symptoms of, and/or enabling the dietary management of at least one symptom of a rheumatic disease. In certain embodiments, the methods described herein further comprise administering an effective amount of methotrexate in combination with an effective amount of a pharmaceutical composition, medical food, dietary supplement, or solid foodstuff described herein. In certain embodiments, the methotrexate is administered, before, simultaneously, or after the administration of the pharmaceutical composition, medical food, dietary supplement, or solid foodstuff described herein.

Periodontal Disease

In certain embodiments, described herein are methods of treating, preventing, and/or enabling the dietary management of periodontal disease comprising administering to a human subject an effective amount of a composition (e.g., pharmaceutical composition, medical food, dietary supplement, or solid foodstuff) described herein. In certain embodiments, the compositions described herein can be administered by local administration in the form of a gel, mouthwash, lozenge, paste, medical food or food stuff for the treatment or prevention of periodontal disease. In certain embodiments, the methods described herein further comprise administering an effective amount of one or more additional agents known in the art for treating, preventing, reducing the severity of one or more symptoms of, and/or enabling the dietary management of at least one symptom of a periodontal disease. In certain embodiments, the one or more additional agents known in the art for treating, preventing, reducing the severity of one or more symptoms of, and/or enabling the dietary management of at least one symptom of a periodontal disease is administered, before, simultaneously, or after the administration of the pharmaceutical composition, medical food, dietary supplement, or solid foodstuff described herein.

Gastritis

In certain embodiments, described herein are methods of treating or preventing and/or enabling the dietary management of gastritis comprising administering to a human subject an effective amount of a composition (e.g., pharmaceutical composition, medical food, dietary supplement, or solid foodstuff) described herein. In certain embodiments, the gastritis is *H. pylori*-associated gastritis. In certain embodiments, the methods described herein further comprise administering an effective amount of one or more additional agents known in the art for treating, preventing, reducing the severity of one or more symptoms of, and/or enabling the dietary management of at least one symptom of gastritis. In certain embodiments, the one or more additional agents known in the art for treating, preventing, managing one or more symptoms of, and/or enabling the dietary management of at least one symptom of a gastritis is administered, before, simultaneously, or after the administration of the pharmaceutical composition, medical food, dietary supplement, or solid foodstuff described herein.

Osteoarthritis

In some embodiments, compositions and methods disclosed herein can be used to treat or prevent, and/or enable the dietary management of osteoarthritis. In certain embodiments, described herein are methods of treating or preventing osteoarthritis comprising administering to a human subject an effective amount of a composition (e.g., pharmaceutical composition, medical food, dietary supplement, or solid foodstuff) described herein.

As used herein, the term "osteoarthritis" (abbreviated as "OA"), refers to the disease also known as osteoarthritis and degenerative joint disease, characterized by inflammation and damage to, or loss of cartilage in any joint or joints, and joint pain. Clinical standards for diagnosing osteoarthritis in subjects including mammalian subjects such as canines and humans are well known and include for example swelling or enlargement of joints, joint tenderness or pain, decreased range of motion in joints, visible joint deformities such as bony growths, and crepitus. Symptoms can be identified by clinical observation and history, or imaging including MRI and X-ray. Criteria for diagnosing the presence or absence of OA and severity or degree of OA include but are not limited to the ACR Criteria for knee OA (R. Altman et al., Development of criteria for the classification and reporting of osteoarthritis: Classification of osteoarthritis of the knee: Diagnostic and Therapeutic Criteria Committee of the American Rheumatism Association. Arthritis Rheum. August 29(8):1039-1049(1986)), functional status criteria according to WOMAC (N. Bellamy et al., 1988, Validation study of WOMAC: a health status instrument for measuring clinically important patient relevant outcomes to antirheumatic drug therapy in patients with osteoarthritis of the hip or knee. J Rheumatol 15:1833-1840), and radiological standards for evaluating OA disease severity according to the Kellgren and Lawrence method for knee OA (Kellgren, J. H. and J. S. Lawrence, Radiological assessment of osteoarthrosis. Ann Rheum Dis 16:494-502).

In some embodiments, the condition to be treated is osteoarthritis. In some embodiments, the condition to be treated is osteoarthritis, and treating the condition further involves administration of any one or combination of known anti-osteoarthritis medications or treatments. These include, but are not limited to, surgery, analgesics, non-steroidal anti-inflammatory drugs (aspirin, celecoxib, diclofenac, diflunisal, etodolac, ibuprofen, indomethacin, ketoprofen, ketorolac, nabumetone, naproxen, oxaprozin, piroxicam), menthol, weight loss regimens, physical exercise, acupuncture, narcotics (Codeine, Fentanyl, Hydrocodone, hydroporphone, meperidine, methadone, oxycodone), and physical therapy.

In certain embodiments, the methods described herein further comprise administering an effective amount of one or more additional agents known in the art for treating, preventing, reduction of the severity one or more symptoms of and/or enabling the dietary management of at least one symptom of osteoarthritis.

In certain embodiments, the anti-osteoarthritis medications or treatments or additional agent known in the art for treating, preventing, reduction of the severity one or more symptoms of and/or enabling the dietary management of at least one symptom of osteoarthritis are administered or performed, before, simultaneously, or after the administration of the pharmaceutical composition, medical food, dietary supplement, or solid foodstuff described herein.

Aging-Associated Inflammation

In certain embodiments, described herein is a method for treating, preventing, reducing the severity, or enabling the dietary management of at least one symptom associated with aging-associated inflammation, comprising administering to a human subject an effective amount of the pharmaceutical composition, medical food, or solid food stuff described herein. In certain embodiments, the symptom of aging-associated inflammation is selected from frailty, chronic pain, sarcopenia, impaired mobility, walking speed, cognitive processing speed, or executive functioning.

In certain aspects, described herein is a method of modulating the level and/or activity of an inflammatory cytokine related to human aging in a human subject, comprising administering to the human subject an effective amount of the pharmaceutical composition, medical food or solid food stuff described herein. In certain embodiments, the modulating the level and or activity of an inflammatory cytokine related to human aging, comprises reducing the level and/or activity of at least one inflammatory cytokine from Table 8. In certain embodiments, the level and/or activity of the at least one inflammatory cytokine from Table 8 is reduced in the serum or select tissue of the human subject after administration of the pharmaceutical composition, medical food, or solid food stuff compared to a level and/or activity of the at least one inflammatory cytokine from Table 8 prior to administration of the pharmaceutical composition, medical food, or solid food stuff. In certain embodiments, the inflammatory cytokine is selected from the group consisting of IFNγ, IL-12, TNF-α, IL-17, IL-6, IL-1β, IL-10, and combinations thereof. In certain embodiments, the level and/or activity of the at least one inflammatory cytokine related to human aging is reduced in the serum or select tissue of the human subject after the administration of the effective amount of the pharmaceutical composition, medical food, or solid food stuff In certain aspects, described herein is a method of reducing the level of at least one biomarker associated with aging-associated inflammation in a human subject, comprising administering to the human subject an effective amount of the pharmaceutical composition, medical food, or solid food stuff described herein. In certain embodiments, the at least one biomarker associated with aging-associated inflammation is selected from the group consisting of IL-6, TNF-α, C-Reactive Protein (CRP), C-X-C Motif Chemokine Ligand 10 (CXCL10), C-X3-C Motif Chemokine Ligand 1 (CX3CL1), Insulin Like Growth Factor (IGF) 1 (IGF-1), IGF binding proteins, Insulin, and Hemoglobin Subunit Alpha 1 (HbA1C). In certain embodiments, the biomarker associated with aging-associated inflammation is a biomarker disclosed in Tsai, Y. et al. Bioscience of Microbiota, Food and Health Vol. 40 (1), 1-11, 2021, hereby incorporated by reference in its entirety. In certain embodiments, the level of the at least one biomarker associated with aging-associated inflammation is reduced in the serum or select tissue of the human subject after administration of the pharmaceutical composition, medical food, or solid food stuff compared to a level and/or activity of the at least one biomarker associated with aging-associated inflammation prior to administration of the pharmaceutical composition, medical food, or solid food stuff. In certain embodiments, the methods described herein further comprise administering an effective amount of one or more additional agents known in the art for treating, preventing, reduction of the severity one or more symptoms of and/or enabling the dietary management of at least one symptom of aging-associated inflammation. In certain embodiments, the one or more additional compositions known in the art for treating, preventing, reduction of the severity and/or enabling the dietary management of at least one symptom of aging-associated inflammation is administered, before, simultaneously, or after the administration of the pharmaceutical composition, medical food, dietary supplement, or solid foodstuff described herein.

Combination Therapy

A composition can be administered alone or in combination with other treatments, either simultaneously or sequentially dependent upon the condition to be treated. In some embodiments, the compositions of the present disclosure can be used in combination with an agent known in the art for the treatment, prevention and/or reduction of the severity of one or more symptoms of an immune system disorder or a condition associated with inflammation. In certain embodiments, the compositions of the present disclosure are used in combination with one or more immunosuppressive agents known in the art. In certain embodiments, the compositions of the present disclosure are used in combination with an agent known in the art for reduction of an inflammatory cytokine. In certain embodiments, the compositions of the present disclosure are used in combination with for an agent known in the art for the treatment, prevention and/or reduction of the severity of one or more symptoms of rheumatoid arthritis. In certain embodiments, the compositions of the present disclosure are used in conjunction with methotrexate. In certain embodiments, the compositions of the present disclosure are used in combination with an agent known in the art for the treatment, prevention and/or reduction of the severity of one or more symptoms of periodontal disease. In certain embodiments, the composition of the present disclosure are used in combination with an agent known in the art for the treatment, prevention and/or reduction of the severity of one or more symptoms of gastritis. In certain embodiments, the compositions of the present disclosure are used in combination with an agent known in the art for the treatment, prevention and/or reduction of the severity of one or more symptoms of pathogen associated gastritis (e.g., *H. pylori*-induced gastritis). In certain embodiments, the compositions of the present disclosure are used in combination with an agent known in the art for the treatment, prevention and/or reduction of the severity of one or more symptoms of osteoarthritis. In certain embodiments, the compositions of the present disclosure are used in combination with an agent known in the art for the treatment, prevention and/or reduction of the severity of one or more symptoms of aging-associated inflammation. In certain embodiments, the compositions of the present disclosure are used in combination with an agent known in the art for the treatment, prevention and/or reduction of the severity of one or more symptoms of psoriasis. In certain embodiments, the compositions of the present disclosure are used in combination with an agent known in the art for the treatment, prevention and/or reduction of the severity of one or more symptoms of psoriatic arthritis.

Methods of Selecting Microbial Entities

In certain embodiments, described herein are methods for selecting a microbial entity for a pharmaceutical composition, medical food, dietary supplement or solid foodstuff for treating, preventing, reducing the severity of, at least one symptom of an immune system disorder comprising a viable microbial population, the method comprising: (i) providing a library of whole-genome or cDNA transcriptome sequences of microbial candidates of different species; and (ii) generating a gene-of-interest database for orthologous genes-of-interest from the different species, wherein the gene-of-interest is selected from genes involved in the metabolism or biogenesis of short chain fatty acid (propionate and butyrate), indole (indole-3-acetic acid and indole propionic acid), Gamma-aminobutyric acid (GABA), surfactants (surfactin, nisin, fengycin, and iturin), dopamine, secondary bile acids, exopolysaccharide proteins (EPS), omega 3 fatty acids, and combinations thereof.

In certain aspects, described herein are methods of selecting a microbial entity for a pharmaceutical composition, medical food, dietary supplement, or solid foodstuff comprising a viable microbial population for treating, preventing or reducing the severity of at least one symptom of aging-associated inflammation in a human subject, modulating the level and/or activity of an inflammatory cytokine related to human aging in a human subject, and/or reducing the level of at least one biomarker associated with aging-associated inflammation in a human subject, the method comprising:

(i) providing a library of whole-genome or cDNA transcriptome sequences of microbial candidates of different species; and (ii) generating a gene-of-interest database for orthologous genes-of-interest from the different species, wherein the gene-of-interest is selected from genes involved in the metabolism or biogenesis of short chain fatty acid (propionate and butyrate), indole (indole-3-acetic acid and indole propionic acid), Gamma-aminobutyric acid (GABA), surfactants (surfactin, nisin, fengycin, and iturin), dopamine, secondary bile acids, exopolysaccharide proteins (EPS), omega 3 fatty acids, and combinations thereof.

Methods of Formulating Microbial Entities

In certain aspects, described herein are methods of formulating a composition (e.g., a pharmaceutical composition, medical food, dietary supplement or solid food stuff) comprising a viable microbial population for treating, preventing, reducing the severity, and/or enabling dietary management of at least one symptom of an immune system disorder, the method comprising: (i) identifying immunomodulatory functions of interest; and (ii) screening in silico for genes-of-interest to identify microbes with the capacity to produce identified functions of interest using libraries of whole-genome or cDNA transcriptome sequences of the microbial candidates of different species; and (iii) selecting at least two microbial entity candidates of different species with immunomodulatory function; and (iv) culturing the at least two microbial entities in vitro and detecting formation or activity of an anti-inflammatory product/function in each; and (v) culturing the at least two microbial entities in combination in vitro, collecting supernatants from the cultures, and treating activated immune cells in vitro with the supernatants and detecting reduction in inflammatory cytokine production.

In certain aspects, described herein are methods of formulating a composition (e.g., a pharmaceutical composition, medical food, dietary supplement or solid food stuff) comprising a viable microbial population for treating, preventing, reducing the severity of and/or enabling dietary management of at least one symptom of a rheumatic disease, the method comprising: (i) identifying immunomodulatory functions of interest; and (ii) screening in silico for genesof-interest to identify microbes with the capacity to produce identified functions of interest using libraries of whole-genome or cDNA transcriptome sequences of the microbial candidates of different species; and (iii) selecting at least two microbial entity candidates of different species with immunomodulatory function; and (iv) culturing the at least two microbial entities in vitro and detecting formation or activity of an anti-inflammatory product/function in each; and (v) culturing the at least two microbial entities in combination in vitro, collecting supernatants from the cultures, and treating activated immune cells in vitro with the supernatants and detecting reduction in inflammatory cytokine production.

In certain aspects, described herein are methods of formulating a a composition (e.g., a pharmaceutical composition, dietary supplement or nutritional food stuff) comprising a viable microbial population for treating, preventing or reducing the severity, and/or enabling the dietary management of at least one symptom of an periodontal disease, the method comprising: (i) identifying immunomodulatory functions of interest; and (ii) screening in silico for genes-of-interest to identify microbes with the capacity to produce identified functions of interest using libraries of whole-genome or cDNA transcriptome sequences of the microbial candidates of different species; and (iii) selecting at least two microbial entity candidates of different species with immunomodulatory function; and (iv) culturing the at least two microbial entities in vitro and detecting formation or activity of an anti-inflammatory product/function in each; and (v) culturing the at least two microbial entities in combination in vitro, collecting supernatants from the cultures, and treating activated immune cells in vitro with the supernatants and detecting reduction in inflammatory cytokine production.

In certain aspects, described herein are methods of formulating a composition (e.g., a pharmaceutical composition, dietary supplement or nutritional food stuff) comprising a viable microbial population for treating, preventing or reducing the severity, and/or enabling the dietary management of at least one symptom of gastritis, the method comprising: (i) identifying immunomodulatory functions of interest; and (ii) screening in silico for genes-of-interest to identify microbes with the capacity to produce identified functions of interest using libraries of whole-genome or cDNA transcriptome sequences of the microbial candidates of different species; and (iii) selecting at least two microbial entity candidates of different species with immunomodulatory function; and (iv) culturing the at least two microbial entities in vitro and detecting formation or activity of an anti-inflammatory product/function in each; and (v) culturing the at least two microbial entities in combination in vitro, collecting supernatants from the cultures, and treating activated immune cells in vitro with the supernatants and detecting reduction in inflammatory cytokine production. In certain embodiments, the gastritis is *H. pylori*-associated gastritis.

In certain aspects, described herein are methods of formulating a pharmaceutical composition, medical food, dietary supplement, or solid food stuff comprising a viable microbial population for treating, preventing or reducing the severity of at least one symptom of aging-associated inflammation in human subject, modulating the level and/or activity of an inflammatory cytokine related to human aging in a human subject, and/or reducing the level of at least one biomarker associated with aging-associated inflammation in a human subject, the method comprising:

(i) selecting at least two microbial entity candidates of different species with immunomodulatory function; and
(ii) identifying genes-of-interest that indicate synergistic functions of the at least two microbial entities in silico using predictive modeling of libraries of whole-genome or cDNA transcriptome sequences of the microbial candidates of different species; and/or
(iii) culturing the at least two microbial entities in combination in vitro and detecting formation of an anti-inflammatory product.

EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences*, 18th Edition (Easton, Pa.: Mack Publishing Company, 1990); Carey and Sundberg *Advanced Organic Chemistry* $3^{rd}$ *Ed*. (Plenum Press) Vols A and B (1992).

Example 1: Microbe Isolation, Bacteria and Fungi

Plant-based and fermented foods are rich sources of diverse microbes. A microbial library was developed that contains microbes from these sources as they represent an untapped potential source of novel beneficial microbes. Vegetables typically eaten raw and fermented foods were selected for isolation of microbes of interest. The materials were sourced at the point of distribution in supermarkets selling both conventional and organic farmed vegetables, either washed and ready to eat or without washing. The samples were divided into 50 g portions, thoroughly rinsed with tap water and blended for 30 seconds on use of a coarse and then a fine sieve followed by filtration through a 40 win sieve. The sieved samples from each food source were stored with a cryoprotectant, for example 10% DMSO, as Solarea Bio plants (SBPs).

For DNA extraction, the cell suspension containing the plant microbiota, chloroplasts and plant cell debris was centrifuged at slow speed for removing plant material and the resulting supernatant was centrifuged at high speed to pellet microbial cells. The pellet resuspended in a buffer containing a proprietary plant cell lysis buffer consisting of chelating agents such as EDTA or Versetene EDTA-based chelating agents to remove divalent ions and a suitable non-ionic detergent such as Tween-20, Tween 80, Triton X, and washed then with PBS. DNA was extracted using the MagaZorb DNA extraction kit (Promega). DNA quality and concentration were measured using Nanodrop and Picogreen fluorescent quantification. DNA libraries were built using the Nextera XT library preparation kit (Illumina)

and DNA sequencing was performed using an Illumina HiSeqX instrument using a 2×150 bp flow cell. Raw paired-end reads were processed for quality control with Solexa QA 56 for trimming and removing of Illumina adaptors using a Phred score >20 and minimum fragment length of 50 bp. Taxonomic annotation at the species level of the microbial community for each sample was metagenome using k-mer analysis with kraken2 (Table 3). SBPs were sampled and inoculated into media that would facilitate the growth of certain types of organisms to generate Solarea Bio enrichments (SBEs). As examples, cultivation with plant filtrates or acetate enriched broth can enrich for microbes capable of growth on plant substrates or low pH-tolerant microbes.

The sieved samples were also diluted and plated onto media that is non-selective, such as tryptic soy agar, or plated on media that is selective for a given microbial type. For example, fungi can be isolated from a sample by plating on a medium such as potato dextrose agar with added chlorotetracycline to prevent bacterial growth. Likewise, bacteria can be isolated away from yeast by added selective agents such as cycloheximide to the medium.

Single colonies were then selected and purified by sequential streak isolations or single cell sorting by FACS to generate Solarea Bio isolates (SBIs). These isolates were then assigned a preliminary identification by 16S rDNA or ITS sequencing (Table 4) for bacteria or fungi respectively, before in depth sequencing analysis.

Example 2: Sequencing: Genomic, RNA, Protein

The highest throughput method of determining microbial therapeutic potential begins with bioinformatic analyses. Through sequencing of isolated microbial candidates, it is possible to identify microbes with potentially beneficial phenotypes.

Whole-genome sequencing: whole-genome sequencing was performed using the Oxford Nanopore and Illumina systems. Microbes grown in pure culture were centrifuged at 4000×rpm for 10 min to remove supernatant. Genomic DNA was isolated from microbial pellets via column-based commercial genomic isolation kits, such as the Zymo Quick-DNA miniprep plus kit. DNA quality and concentration were measured using Nanodrop and Picogreen fluorescent quantification. DNA libraries were built using the Nextera Flex library preparation kit (Illumina) and the Nanopore Genomic DNA by Ligation kit (SQK-LSK110). DNA sequencing was performed using an Illumina MiSeq instrument using a 2×250 bp flow cell and the MinION Oxford Nanopore device. Illumina raw paired-end reads were processed for quality control with Solexa QA (Cox et al. 2010) for trimming and removing of Illumina adaptors using a Phred score >20 and minimum fragment length of 50 bp. Quality-filtered reads were de novo assembled using IDBA-UD (Peng et al. 2012) with pre-corrections and the percent of contamination and genome completeness were assessed based on recovery of lineage-specific marker genes using CheckM (Parks et al. 2015). Nanopore raw sequencing data was converted into a nucleic acid sequence through the "guppy_basecaller" command line software. Library barcodes were removed, and individual reads were separated by source through the "porechop" demultiplexing tool (https://github.com/rrwick/Porechop). Following demultiplexing, assembly of contigs was preformed through the "flye" assembly tool v1.8 (Kolmogorov et al. 2019) and assembly polish using Medaka v0.12.1 (https://github.com/nanoporetech/medaka). Error correction of the assembled contigs was performed using the Illumina sequencing reads with Pilon v1.23 (https://github.com/broadinstitute/pilon).

RNA sequencing: RNA transcripts from microbial candidates described above may also be sequenced. Microbes grown in pure culture are pelleted as above and the resulting pellet undergoes RNA extraction to isolate the total cellular RNA. RNA isolation is performed using a column-based commercial RNA isolation kit, such as the Zymo Research Quick RNA Microprep kit. Isolated RNA is then treated with DNAse to remove potential contaminating genomic DNA. Following DNAse inactivation at 65° C., the isolated RNA undergoes reverse transcriptase reactions, utilizing universal random primers to produce cDNA of specific products. These cDNA products are sequenced through Nanopore or Illumina based sequencing, as above.

Example 3: Annotation of Genomes

Once a microbial genome has been sequenced it is possible to determine its capacity to produce potentially therapeutic metabolites and compounds. Genome annotation was performed to determine the microbe's taxonomy and gene content. To determine the genes, present within each individual genome, the command line software tool, prokka, was used. The assembled contig information derived from genomic sequencing is input into prokka, which initially identifies the locations of all protein coding sequences, after which coding sequences are annotated as specific genes based on a database of all non-fragment Uniprot entries that have transcript evidence (Apeweiler et al., 2004). identified. To identify specific genes-of-interest that may not be annotated due to low homology, the BLAST+ command line application was used. A genes-of-interest database was constructed, which contains orthologous genes-of-interest from different species. A non-comprehensive list of genes within this database is included in Table 5. Genes-of-interest have included the gene pathways involved in short chain fatty acid (propionate and butyrate) biogenesis, indole (indole-3-acetic acid and indole propionic acid), Gamma-aminobutyric acid (GABA), surfactants (surfactin, nisin, fengycin, and iturin), dopamine, secondary bile acids, exopolysaccharide proteins (EPS), and omega 3 fatty acids biosynthesis.

Example 4: Identification of Enzymes Involved in Production of Immunomodulatory Compounds Microbes including bacteria and fungi are known to produce compounds with immunomodulatory and anti-inflammatory properties including but not limited to short chain fatty acids (SCFA), indoles and indole derivatives, anti-microbial compounds, neurotransmitters such as GABA, serotonin, and dopamine, extracellular polymeric substances (EPS), biosurfactants, secondary bile acids, and polyunsaturated fatty acids. To screen for these compounds in silico, enzyme commission (EC) numbers and amino acid reference sequences were identified for each potential biosynthetic pathway for the production of compounds of interest (Table 5). The genes-of-interest database was blasted against the amino acid sequences from the genomes with a 60% identity and 60% query aligned region threshold to identify potential homologs (Table 6).

Example 5: Expression Levels

The presence of genes associated with a beneficial metabolite offer significant predictive power for identifying potentially therapeutic microbes. However, it is important to determine the expression levels of these genes to confirm that the beneficial metabolite will actually be produced. Gene expression levels will be determined by quantitative reverse transcriptase polymerase chain reaction (qRT-PCR).

qRT-PCR is a standard laboratory technique wherein gene expression is quantified by direct measurement of RNA levels. Microbes grown in pure culture under a variety of conditions and media types. These pure cultures are pelleted by centrifugation at 4000×rpm for 10 min and the resulting pellet undergoes RNA extraction to isolate the total cellular RNA as described in Example 2. Additionally, RNA is DNAse treated as in Example 2. The isolated RNA undergoes reverse transcriptase reactions, utilizing universal random primers, to produce complementary DNA (cDNA) of the entire transcriptome. cDNA is then amplified through qPCR using primers specific to the gene-of-interest from Table 5 qPCR directly quantifies the amount of cDNA and thereby the starting quantity of the RNA transcript-of-interest, determining its expression levels.

Example 6: Measurement of Microbially Produced Compounds

The levels of microbially produced metabolites was examined in vitro. Individual microbes are grown in pure culture, after which the microbially conditioned supernatant were examined for different metabolites including short chain fatty acids, indole derivatives, antimicrobial compounds, and neurotransmitters. Additionally, the ability of microbes to produce extracellular polymeric substances was examined.

Short chain fatty acid quantification: Short chain fatty acids (SCFA) including acetate, propionate, and butyrate, are produced as a result of anaerobic bacterial fermentation of dietary fibers within the intestine and especially within the colon (Macfarlane et al., 2003). SCFAs have different modes of action on both local and systemic regulation of the immune system. SCFAs regulate and improve the intestinal barrier function by upregulation of the expression of tight junctions (Caffaratti et al., 2021). SCFAs also play an important role in T-cell functioning via regulation of G-protein-coupled receptors (GPCRs) and inhibition of histone deacetylase (HDAC) (Caffaratti et al., 2021). One of the most well described and potent anti-inflammatory properties of SCFAs is their capacity to promote regulatory T cells (Tregs) which suppress the activity of effector T cells (Postler et al., 2017). SCFA also inhibit the production of proinflammatory cytokines including TNF-α, IL-6, and IL-1β from intestinal macrophages to reduce local and systemic inflammation (Caffaratti et al., 2021). To measure short chain fatty acid production microbes were grown in pure culture under anaerobic conditions. The microbially conditioned supernatant was then examined by gas chromatography (GC) for the presence of acetate, butyrate, and propionate as previously described (Scortichini et al., 2020). Results for short chain fatty acid production from a selection of examined organisms can be found in Table 7.

Indole derivatives: In the intestine, tryptophan (Trp) can be metabolized into indole derivatives by the intestinal microbiota that can act as ligands for the aryl hydrocarbon receptor (AhR) in host cells to impact the immune response (Caffaratti et al., 2021, Postler et al., 2017). Indole derivatives including but not limited to indole, indole acetic acid (IAA), and indole propionic acid (IPA) can modulate the production of IL-22, an important mediator of intestinal homeostasis, as well as suppress the activation of NF-κB and proinflammatory cytokine production while simultaneously increase the production of or anti-inflammatory cytokines to reduce inflammation in the host (Gao et al., 2018). For example, in vitro studies have demonstrated the ability of indole to reduce TNF-α mediated activation of NF-κB, expression of the proinflammatory cytokine IL-8, and induce the production of the anti-inflammatory cytokine IL-10 in HCT-8 cells (Bansal et al., 2010). Thus, screening for microbes that produce indole metabolites will lead to the discovery of microbes with probiotic potential. To detect the presence of indole derivatives from microbes, conditioned supernatant was examined by both Kovacs and Salkowski tests, two standard biochemical tests that are commonly used to identify the presence of indole-containing compounds (Sethi et al., 2021). Results for indole derivative production from a selection of examined organisms can be found in Table 7.

Antimicrobial compounds: Antimicrobial compounds such as bacteriocins and antibacterial peptides serve multiple purposes including reducing pathogenic microbes associated with disease pathology and reducing the inflammatory response (Jenab et al., 2020). Bacteriocins such as microcin have been shown to increase the production of anti-inflammatory cytokines in intestinal cell lines co-treated with pathogenic *E. coli* and downregulating TNF through NF-κB inhibition (Yu et al., 2018). Further, bacteriocins produced by *Lactobacillus rhamnosus* with antibacterial effect showed significant inhibitory effects on *S. aureus* biofilm formation and decreased the level of the proinflammatory mediators, C Reactive Protein (CRP) and IL-6, in the serum following surgery (Zhou et al., 2017). The ability of potentially therapeutic microbes to produce of antimicrobial compounds, such as bacteriocins, will be determined in screening assays. Briefly, supernatant, conditioned by potentially therapeutic microbes, was incubated with potentially pathogenic microbes, for example: *Klebsiella pneumoniae* and *Porphyromonas gingivalis*. The growth of the potential pathogens was overtime through measurement of optical density. Through this system the production of antimicrobial compound by individual microbes was determined as previously described (Vijayakumar et al., 2015). Results for antimicrobial compound production from a selection of examined organisms can be found in Table 7.

Neurotransmitters: Microbially produced neurotransmitters including serotonin, gamma-aminobutyric acid (GABA), and dopamine affect host physiology and immunity through various mechanisms. Serotonin is synthesized from tryptophan (Trp) through a two-stage enzymatic reaction involving Trp hydroxylase and aromatic amino acid decarboxylase. In humans, approximately 90% of serotonin is located in the enterochromaffin cells of the GI tract where it promotes intestinal peristalsis (Gao et al., 2018). In an anti-inflammatory role, serotonin has been shown to induce T-cell differentiation into Tregs as well as promoting inflammatory Th17 cells to differentiate into Tregs. Th17 cells are an inflammatory T-cell that secrete IL-17 and have been implicated in autoinflammatory diseases including but not limited rheumatoid arthritis (Further, serotonin has been shown to reduce the production of IL-17 from Th17 cells and increase the production of IL-10 from Tregs, promoting an anti-inflammatory environment (Wan et al., 2020). GABA is an inhibitory neurotransmitter in the central nervous system, but also exerts important functions in the immune system. GABA has been shown to macrophage mediated inflammation, and induce the production of Tregs. GABA has also been shown to decrease IL-1β mediated inflammation and increase production of tight junctions in epithelial cells, improving intestinal barrier function (Caffaratti et al., 2021, Jin et al., 2011). Dopamine, a catecholamine, is abundantly present within the human intestinal tract in part due to microbial production (Sandrini et al., 2015). The bacterium *Enterococci faecalis* has been shown to produce the neurotransmitter dopamine from the metabolite, L-3,4 dihydroxyphenylalanine (L-dopa) (Villageliú et al., 2018). Furthermore, dopamine is recognized as a potent immunomodulatory compound (Pinoli et al., 2017; Jenab et al., 2020). Dopamine reduces systemic inflammation through inhibition of the NLRP3 inflammasome, a proinflammatory signaling cascade, associated with robust secretion of proinflammatory mediators (Yan et al., 2015). Dopamine was found to reduce neutrophil mediated reactive oxygen species production, and even inhibit neutrophil activation by the highly potent activator N-formyl-methionyl-leucyl-phenylalanine (Yamazaki et al., 1989). Additionally, treatment with dopamine receptor agonists has been shown to reduce the levels of the pro-inflammatory cytokines IL-6 and IL-8 in serum (Alduri et al., 2010). To screen for microbes that produce these neurotransmitters, microbially conditioned supernatant is quantified via ELISA, as previously described (An et al., 2020). Alternatively, high performance liquid chromatography (HPLC) can be used to quantify neurotransmitter production by potentially therapeutic microbes as has been described previously (Reinhoud et al., 2013).

Extracellular polymeric substances: Extracellular polymeric substances (EPS) are a diverse group of polymers composed mainly of polysaccharides, proteins, and DNA, that have been shown to have potent immunomodulatory effects (Costa et al., 2018, Jin et al., 2019). EPS producing strains have a variety of or health benefits for their hosts including anti-inflammatory, antioxidant, antitumor, and stress-tolerant effects (Jin et al., 2019). EPS from *Bacillus subtilis* has been shown to induce an anti-inflammatory M2 macrophage response to prevent T-cell mediated diseases (Paynich et al., 2017). EPS from *Bifidobacterium longum* decreases IFNγ, IL-12, TNF-α, IL-17, and IL-6 production and protects against the T-cell transfer model of colitis (Hsieh et al., 2020). EPS from *Faecalibacterium prausnitzii* decreases IFNγ and IL-12 while increasing IL-10 secretion through TLR-2 to attenuate the DSS model of colitis (Hsieh et al., 2020). These are just a few examples of the anti-inflammatory capabilities of microbially produced EPS. To screen for microbially produced EPS, microbes were grown on media containing the carbohydrate indicating dyes congo red or aniline blue. The presence of colorimetric changes within the microbial colony and the surrounding media indicates the presence of extracellular polymeric substances as demonstrated previously (Ruhmann et al., 2015). Results for EPS production from a selection of examined organisms can be found in Table 7.

Biosurfactants: Biosurfactants are a class of amphipathic molecule produced by microbes. In nature these substances improve nutrient solubility, which improves nutrient acquisition and absorption. In addition to their benefit to microbes biosurfactants have several features that make them potentially desirable compounds for probiotics (Jenab et al., 2020). Biosurfactants have been shown to have anti-inflammatory properties. The biosurfactant produced by *Bacillus licheniformis* VS16 has been shown to reduce the expression of pro-inflammatory cytokines, such as TNF-α and IL-1β, while also increasing the expression of the anti-inflammatory cytokines IL-10 and TGF-β (Giri et al., 2017). Additionally, surfactin, a biosurfactant produced by *Bacillus subtilis* has been shown to reduce the expression of the pro-inflammatory mediators IL-1β, iNOS, and TNF-α in LPS stimulated macrophages (Zhang et al., 2015).

Biosurfactant production by microbes are determined through two methods: blood agar lysis and lipid droplet spreading assays (Morikawa et al., 2000; Mulligan et al., 1984). Pure microbial cultures are grown on sheep blood agar. Agar will be checked daily for signs of hemolysis. Hemolysis indicates the potential presence of a biosurfactant (Mulligan et al., 1984). A lipid droplet spreading assay is utilized to confirm biosurfactant production by that microbe. A hemolysin positive microbial strain is grown in pure liquid culture. 10 µL of microbe-conditioned supernatant is applied to 40 mL of water overlain with a 10 µL layer of mineral oil. The presence of biosurfactants within the supernatant results in a zone of clearance around the applied supernatant. The diameter of clearance produced by this technique linearly correlates to the quantity of biosurfactant within the supernatant (Morikawa et al., 2000).

Secondary bile acids: Bile acids are sterol compounds produced by the human body to assist in the solubilization of lipids and other hydrophobic nutrients within the gastrointestinal tract. Select microbes have been shown to metabolize the human produced primary bile acids, cholic and chenodeoxycholic acid, into secondary bile acids, including but not limited to lithocholic and deoxycholic acid (Heinken et al., 2019). Secondary bile acids have been shown to have anti-inflammatory properties (Fiorucci et al., 2018). Anti-inflammatory properties/effects in a human subject include, but are not limited to reduction in symptoms of acute inflammation such as fever, fatigue, headaches, etc. and symptoms of chronic inflammation, such as, but not limited to, gastrointestinal complications (e.g., diarrhea or constipation), weight gain, weight loss, fatigue, persistent infection, cancer and/or stroke. Secondary bile acids are known to signal through both the FXR and TGR5 receptors. These receptors result in powerful immunoregulatory responses. FXR knockout mice have been shown to have increased expression of pro-inflammatory cytokines: IL-1β, IL-2, IL-6, TNF-α, and IFNγ (Fiorucci et al., 2018; Vavassori et al., 2009). Additionally, TGR5 agonism has been shown to reduce proinflammatory cytokine expression by IFNγ stimulated macrophages (Yoneno et al., 2013). Furthermore, it has been shown that FXR signaling reduces synthesis of the pro-inflammatory mediator prostaglandin E2, while bile acid signaling through TGR5 reduces activation of the NLRP3 inflammasome, a signaling cascade that would otherwise result in further inflammatory signals.

To determine and quantify microbial production of secondary bile acids signaling pathway induction and liquid chromatography-linked mass spectrometry (LC-MS) is utilized. Pure microbial culture is grown in liquid media in the presence of primary bile acids. Microbially-conditioned supernatants are then filtered to remove organisms. FXR- and TGR5-expressing epithelial cells are then incubated with supernatants. To determine FXR/TGR5 activation, and thus the presence of secondary bile acids, qRT-PCR, as previously described. Using primers specific to FXR/TGR5-controlled genes, such as the intestinal bile acid binding protein (IBABP) gene for FXR and caudal-type homeobox 2 (CDX2) for TGR5, the downstream signaling events and thus presence of secondary bile acids is determined (Wang et al., 2008; Ni et al., 2020). To differentiate and quantify secondary bile acids LC-MS is used. Microbes are grown in the presence of bile acids. The resulting supernatant is harvested and filtered. Supernatants are analyzed by LC-MS to identify and quantify any secondary bile acids that are produced by the microbe of interest.

Omega fatty acids: Omega-3 and omega-6 fatty acids are unsaturated fatty acids and precursor molecules for the eicosanoid family of immunomodulatory lipid mediators (Gutierrez S, 2019). This family of immunological signaling molecules includes prostaglandins and leukotrienes. These compounds are found in several forms which can be pro-inflammatory or anti-inflammatory. Omega-3 fatty acids, including eicosapentaenoic acid (EPA) and Docosahexaenoic acid (DHA) selectively induce the production of anti-inflammatory prostaglandins, while actively inhibiting the synthesis of the pro-inflammatory mediators prostaglandin E2 and leukotriene B4 (Kang et al., 2008). Conversely, omega-6 fatty acids, such as arachidonic acid, selectively induce the production of these same pro-inflammatory mediators. As such, the ratio of omega-3 to omega-6 fatty acids can be diagnostic in determining a microbe's inflammatory profile, where microbes that produce more omega-3 and less omega-6 acids are more anti-inflammatory (Bagga et al., 2003).

To detect, differentiate, and quantify omega fatty acids GC-FID is used. Pure microbial culture is cultivated in liquid culture. Microbial supernatant is collected and filtered to remove microbes. This supernatant is then analyzed by GC, which has the capability to detect, differentiate, and quantify the omega-3 and omega-6 fatty acids within the sample.

Example 7: In Vitro Testing of Single Organisms for Functionality

Following the in silico identification of organisms with therapeutic potential, it is vital to experimentally confirm the desired phenotypes. To develop probiotics with novel therapeutic potential, individual microbes are grown in pure culture. After which, these individual organisms are screened for the appropriate phenotype utilizing several culture-based assays. Microbes are screened directly for their ability to adhere to both mucus and mammalian epithelial cells. Microbially conditioned supernatant is examined for the presence of immunomodulating compounds.

Mucoadherence: Microbial adherence to the gastrointestinal tract is an important mechanism through which commensal microbes improve gut health. As all mucosal surfaces are covered in a layer of mucus, microbialmicrobe adherence to the mucus, hereafter referred to as mucoadherence, is the first important step in this process. It has been shown that probiotic mucoadherence competitively inhibits pathogen access to binding sites on mucosal surfaces (Walsham et al., 2016). Additionally, mucoadherence is thought to increase retention of probiotic microbes, increasing their potential to benefit the host (Han et al., 2021). To quantify mucoadherence, microbes were labeled with a live cell-compatible fluorescent dye, for example Sybr green. These microbes were then incubated in mucin conjugated plates. Total microbial fluorescence was measured via spectroscopy. Unbound bacteria were washed away and the fluorescence due to bound bacteria will be measured and used to calculate the percentage of total microbes that are bound to the mucin.

Epithelial adherence: In addition to mucoaherence the ability of microbes to bind to gut-derived epithelial cells was examined. Like mucoadherence, microbial adherence to epithelial cells has been shown to competitively inhibit epithelial adherence by pathogens, such as *Staphylococcus aureus, Escherichia coli*, and *Enterococcus faecium* (Monteagudo-Mera et al., 2019; Walsham et al., 2016; Zhang et al., 2015). Additionally, the close interaction between pro-biotic microbes and epithelial cells can induce immunological changes in the epithelial cell (Monteagudo-Mera et al., 2019). For example, it has been shown that *Lactobacillus rhamnosus* binding to epithelial cells is required to reduce IL-8 mRNA levels in Caco-2 cells, indicating that adherence is required for immunological modulation (Lebeer et al., 2012).

Caco-2 cells are gut-derived epithelial cells that have been used to study epithelial adherence by probiotic microbes (Grootaert et al., 2011) To determine the ability of microbes to bind to mammalian epithelial cells, microbes were incubated with confluent monolayers Caco-2 epithelial cells. Unbound microbes were then washed off. The epithelial cells were lysed, via a detergent-based lysis buffer, leaving viable bacteria. The surviving microbes were then quantified by plating, resulting in colony forming units (CFUs) bound to the monolayer, which was compared to the number of CFUs incubated in each well to determine the binding efficiency.

Immunomodulatory compounds: As described in Example 4 microbes were examined for their ability to produce metabolites known to be anti-inflammatory in the host. Strains that were positive for the production of these compounds are prioritized for testing of their anti-inflammatory functionality. To empirically test the immunomodulatory capacity of these prioritized strains in vitro, mammalian immune cells are treated with microbially conditioned supernatant. Human U937 cells are myelocyte lineage cells which can be differentiated into macrophage-like cells with ionophores, such as phorbol 12-myristate 13-acetate (PMA). PMA differentiated U937 macrophages are incubated with microbially conditioned supernatant. The subsequent immune response is analyzed by enzyme-linked immunosorbent assay (ELISA) and/or qRT-PCR to quantify the specific cytokines including but not limited to TNF-α, IL-1β, IL-2, IL-3, IL-4, IL-5, Th-6, IL-8, IL-9, IL-10, IL-12, IL-13, IL-15, IL-17, IL-22, IL-23, IL-27 IFNγ, G-CSF, GM-CSF, IP-10, KC, LIF, LIX, MCP-1 that are produced in response to the microbial supernatant. Through examination of the pro- and anti-inflammatory cytokines that are produced by these immune cells the effect of the microbes of interest on the immune system is discerned.

Specific immunomodulatory pathways are also examined. The aryl hydrocarbon receptor (AHR) is receptor found on epithelial cells of the gastrointestinal tract that is known to induce anti-inflammatory immune signaling in response to indole derivatives and other microbial metabolites (Postler et al., 2017). Utilizing an AHR reporter system activation of this signaling pathway is examined as previously described (Marinelli et al., 2018). Microbially conditioned supernatant is produced as described in Example 7. This supernatant is then incubated with HT29 human cells containing an AHR luciferase reporter system, wherein the luciferase gene is under the control of an AHR controlled promoter. Supernatant that stimulates AHR signaling induces expression of the luciferase reporter gene. Luciferase activity is measured spectroscopically to quantify AHR signaling induced by the supernatant.

Other immunomodulatory pathways that are examined are the Toll-Like Receptor (TLR) pathways. TLRs are immunological receptors that detect specific microbial molecular patterns. In response to stimulation by their ligands, these receptors can promote pro- and anti-inflammatory responses. Of specific interest are the TLR heterodimers TLR1/TLR2 and TLR2/TLR6 and the homodimers TLR4 and TLR5. It has been shown that the TLR2-based heterodimers can induce the production of the anti-inflammatory cytokine, IL-10, upon binding to microbial cell wall components (Cario E, 2004; Jang S, 2004; Saraiva M, 2010; Nguyen B, 2020). Additionally, while TLR4 and TLR5 are often thought of as pro-inflammatory receptors, studies have indicated that TLR4 activation can lead to secretion of IL-10 resulting in the maturation of regulatory T cells to control the inflammatory response (Higgins S, 2003. Furthermore, TLR5 signaling is critical for maintenance of the epithelial barrier within the gastrointestinal tract. TLR5 activation by commensal bacteria has been shown to inhibit general inflammation within the gut. The loss of TLR5 expression from intestinal epithelial cells has been shown to increase inflammation and epithelial permeability within the gastrointestinal tract (Vijay-Kumar et al., 2007, Chassaing et al., 2015). Reporter cell lines, such as the HEK-Blue TLR5 reporter line (Invivogen, San Diego, Ca), are used to demonstrate TLR signaling in response to microbial ligands. Microbes are grown in pure culture. These microbes or microbially-conditioned supernatant are used to treat human cells that contain a reporter gene has been placed under the control of a TLR controlled reporter. When the TLR becomes activated by a microbe or secreted microbial compound, the reporter gene is expressed producing a measurable result.

Example 8: DMA Formulation and In Vitro Testing of DMA Functionality

Microbes in nature generally interact with multiple other groups and form consortia that work in synergy, exchanging metabolic products and substrates resulting in thermodynamically favorable reactions as compared to the individual metabolism. For example, in the human colon, the process for plant fiber depolymerization, digestion and fermentation into butyrate is achieved by multiple metabolic groups working in concert. This type of synergy is reproduced in the DMA concept where strains are selected to be combined based on their ability to synergize to produce anti-inflammatory compounds when exposed to substrates such as plant fibers, tryptophan, or sucrose.

To experimentally describe the process of DMA validation the following method is applied to find candidates applicable for specific products:

Define a suitable habitat where microbes are with desirable attributes are abundant based on ecological hypotheses. For example, fresh vegetables are known to have anti-inflammatory effects when consumed in a whole-food plant-based diet, and therefore, it is likely they harbor microbes that can colonize the human gut.

Apply a selection filter to isolate and characterize only those microbes capable of a relevant function. For example, EPS production, mucoadherence and pathogen killing. In addition, strains need to be compatible with target therapeutic drugs.

Selected strains are then cultivated in vitro and their genomes sequenced at 100× coverage to assemble, annotate and use in predictive genome-wide metabolic models.

Predict microbial functions in silico and validate experimentally using the phenotypic methods described in Example 4.

Microbes with complementary or predicted synergistic functions are then combined. Drawing from the example strains in tables 6 and Y, a DMA could be assembled from microbes with complementary functions such as Paraclostridium benzoelyticum that produces abundant SCFAs but does not produce any other ant-inflammatory targets and *Exiguobacterium* sp., which produces IAA, inhibits pathogens, and produces EPS. Alternatively, microbes such as *Brevibacterium* sp. and *Exiguobacterium* sp. produce antipathogenic elements that could synergize to enhance pathogen killing. These two organisms belong to distinct phyla (actinobacteria and firmicutes respectively), meaning they likely harbor different antimicrobial products which may act via different, complementary mechanisms.

Test predicted synergistic combinations in the laboratory for validation. Single strains are grown to produce a biomass and the spent growth media removed after reaching late log or stationary phase. The washed cells are then combined in Defined Microbial Assemblages with 2-10 different strains per DMA and incubated using a culture media with prebiotic substances and precursors including but not limited to tryptophan, mono or oligosaccharides, fruit or vegetable powders that promote anti-inflammatory product formation.

Analyze the DMAs for their anti-inflammatory efficacy in the range of assays described in Examples 6 and 7 for synergistic effects produced by the combined assemblage as compared to the individual contributors.

Example 9: Preclinical Validation of DMA Efficacy

Aged Mice (Inflammaging)

Our lead candidate DMAs are evaluated for their therapeutic efficacy in a mouse model of aging-associated inflammation. All mice are group housed with 5 mice per cage in individually ventilated cages (IVCs) specifically designed for germ free husbandry. After an acclimation period, baseline samples of feces and blood are collected, and baseline measures of body mass are recorded. After baseline measures are recorded, 18-month-old C57bl/6J male and female are randomly divided into groups and administered by bi-daily oral gavage of water (negative control), or one of five test DMAs for a period of 6-weeks. Bi-weekly fecal samples are collected to monitor the functional and taxonomic composition of the gut microbiome over time. 1-week prior to sacrifice, fasted animals receive an oral gavage of FITC-dextran, and a blood sample will be collected 4-hours later to measure gut permeability. After the 6-week administration period, tissues are collected from each mouse for downstream analysis as follows, Metagenomic analysis of fecal pellets: DNA from the fecal pellets are extracted using the ZymoBIOMICS DNA isolation kit (Zymo Reserch, CA) and the concentration are estimated using the Qubit 2.0 dsDNA high sensitivity assay (Invitrogen, CA). DNA libraries are prepared using the Illumina Nextera Flex library kit and an equimolar volume of each library will be pooled and sequenced on an Illumina NovaSeq S1 instrument (NovaSeq Control Software v1.7.5) on a 2×150 bp paired end run. Raw sequencing reads are processed using Solexa QA v3.1.7.1 (Cox et al., 2010) for trimming and removing of adaptors using a Phred score >20 and a minimum fragment size of 50 bp. Mouse DNA removal from the metagenomes is performed by mapping reads to the mouse reference genome GRCm38p6 using Bowtie2 v 2.4.2, with default parameters (Langmead and Salzberg, 2012).

Taxonomic classification of the short-read metagenomes are based on marker genes identified using MetaPhlAn2 (Segata et al., 2012), and organism abundances are calculated at different classification levels (species, genus, family). Functional profiling of microbial community members is performed using HUMAnN2 (Franzosa et al., 2018) and reference pathways databases including UniRef90 and ChocoPhlAn. The abundance of metabolic pathways in the gut microbiome are estimated using the HUMAnN2 output.

Gut permeability analysis: Following FITC-dextran administration to fasted mice, blood will be retro-orbitally collected after 4 hours, and fluorescence intensity will be measured on fluorescence plates using an excitation wavelength of 493 nm and an emission wavelength of 518 nm as previously described (Thevaranjan et al., 2017).

Circulating pro- and anti-inflammatory cytokine analysis: Blood is collected from each mouse into EDTA treated tubes at the time of sacrifice, and plasma is separated from cells. Cells are saved for peripheral blood mononuclear cell (PBMC) analysis. Plasma samples are analyzed by ELISA or Multiplex assay for circulating inflammatory cytokine levels including but not limited to CRP, TNF-α, IL-1β, IL-2, IL-3, IL-4, IL-5. IL-6, IL-7, IL-8, IL-9, IL-10, IL-12, IL-13, IL-15, IL-21, IL-22, IL-23, IL-27 IPNγ. G-CSF, GM-CSF, IP-10, KC, LIF, LIX, MCP-1, M-CSF, MIG, MIP-1α, MIP-1β, MIP-2, MIP-3, RANTES, RANKL and VEGF as previously described (Schott et al., 2018), Peripheral blood mononuclear cell (PBA/IC) analysis: PBMC populations are analyzed by flow cytometry as previously described (Rao et al., 2012). Anticoagulant treated blood undergoes density gradient centrifugation in Ficol to isolate PBMC populations from granulocytes, erythrocytes, and platelets. After which, PBMCS are washed thoroughly and resuspended in FACS buffer. Following resuspension cells undergo Fc (Constant Fragment) blocking to obstruct antibody binding to cellular Fc receptors. Cell suspensions are then treated with unique fluorescent antibodies that are specific for immunophenotyping markers. For instance, CD3 antibodies and CD19 antibodies would be used to label T and B cells, respectively. Through this process T cells, T cell subsets, B cells, monocytes, dendritic cells, phagocyte subsets, natural killer cells and other cellular populations, as deemed relevant, are analyzed.

Bone marrow and splenic immune cell analysis: Bone marrow aspirates and spleens are collected for immune cell phenotyping by flow cytometry and RNAseq as previously described (Tyagi et al., 2018). Upon collection, samples are split in half and either flash frozen for RNA analysis or immediately processed for flow cytometry. Samples are processed for flow cytometry as described for PBMCs, with the addition that spleens are homogenized either mechanically or enzymatically prior to washing and resuspension in FACS buffer.

Colonic tissue isolation for RNA and protein analysis: Two cm sections of proximal colonic tissue and two cm sections of terminal ileum tissue are isolated, split in half, and flash frozen for RNA and protein evaluation of tight junctions and claudins, critical mediators of gut barrier integrity, as well as inflammatory cytokine levels including but not limited to TNF-α, IL-17, IFNγ and IL-1β. RNA is extracted and analyzed by qRT-PCR, and protein is extracted and evaluated by ELISA and/or western blot as previously described for the aforementioned proteins of interest (Li et al., 2016).

Rheumatoid Arthritis

Our lead candidate DMAs are evaluated for their therapeutic efficacy in a mouse model of rheumatoid arthritis (RA) called the collagen-induced arthritis model (CIA) as well as in a delayed type hypersensitivity model. For a prototypical CIA mouse model study, all mice are group housed with 3-5 mice per cage in individually ventilated cages (IVCs) specifically designed for germ free husbandry. Adult male and female DBA/1 mice are randomly allocated to experimental groups and allowed to acclimate for two weeks. After an acclimation period, baseline samples of feces and blood are collected, and baseline measures of body mass are recorded. On Day 0, animals are administered by subcutaneous injection with 100 microliters of an emulsion containing 100 micrograms of type II collagen (CID in incomplete's Freund's adjuvant supplemented with 4 mg/ml *Mycobacterium tuberculosis* H37Ra. On Day 21, animals are administered by subcutaneous injection with a booster emulsion containing 100 μg of type II collagen in incomplete Freund's adjuvant. Beginning from day −14 and continuing through day −45 (end of experiment), mice are administered by bi-daily oral gavage of water (negative control) or one of five test DMAs. From. Day −14 until the end of the experiment on Day 45, animals are weighed three times per week. From Day 21 until the end of the experiment, animals are scored three times per week for clinical signs of arthritis to include swelling of the hind- and front paws, radio-carpal (wrist) joints and tibio-tarsal (ankle) joints. At the end of the experiment on day 45, mice are euthanized, and tissues are collected from each mouse for downstream analysis as follows.

Circulating pro- and anti-inflammatory cytokine analysis: Blood is collected from each mouse into EDTA treated tubes at the time of sacrifice, and plasma is separated from cells. Cells are saved for peripheral blood mononuclear cell (PBMC) analysis. Plasma samples are analyzed by ELISA or Multiplex assay for circulating inflammatory cytokine levels including but not limited to CRP, TNF-α, IL-1β, IL-2, IL-3, IL-4, IL-5, IL-6, IL-7, IL-8, IL-9, IL-10, IL-12, IL-15, IL-17, IL-21, IL-22, IL-23, IL-27 IFNγ, G-CSF, GM-CSF, IP-10, KC, LIF, LIX, MCP-1, M-CSF, MIP-1α, MIP-1β, MIP-2, MIP-3, RANTES, RANKL and VEGF, as previously described (Schott et al., 2018), Peripheral blood mononuclear cell (PBMC) analysis: PBMC populations are analyzed by flow cytometry as previously described (Rao et al., 2012). Anticoagulant treated blood undergoes density gradient centrifugation in Ficol to isolate PBMC populations from granulocytes, erythrocytes, and platelets. After which, PBMCS are washed thoroughly and resuspended in FACS buffer. Following resuspension cells undergo Fc (Constant Fragment) blocking to obstruct antibody binding to cellular Fc receptors. Cell suspensions are then treated with unique fluorescent antibodies that are specific for immunophenotyping markers. For instance, CD3 antibodies and CD19 antibodies would be used to label T and B cells, respectively. Through this process T cells, T cell subsets, B cells, monocytes, dendritic cells, phagocyte subsets, natural killer cells and other cellular populations, as deemed relevant, are analyzed.

Bone marrow and splenic immune cell analysis: Bone marrow aspirates and spleens are collected for immune cell phenotyping by flow cytometry and RNAseq as previously described (Tyagi et al., 2018). Upon collection, samples are split in half and either flash frozen for RNA analysis or immediately processed for flow cytometry. Samples are processed for flow cytometry as described for PBMCs, with the addition that spleens are homogenized either mechanically or enzymatically prior to washing and resuspension in FACS buffer.

Colonic tissue isolation for RNA and protein analysis: Two cm sections of proximal colonic tissue and two cm sections of terminal ileum tissue are isolated, split in half, and flash frozen for RNA and protein evaluation of tight junctions and claudins, critical mediators of gut barrier integrity, as well as inflammatory cytokine levels including but not limited to TNF-α, IL-17, IFNγ and IL-1β. RNA is extracted and analyzed by qRT-PCR, and protein is extracted and evaluated by ELISA and/or western blot as previously described for the aforementioned proteins of interest (Li et al., 2016).

Metagenomic analysis of fecal pellets: DNA from the fecal pellets are extracted using the ZymoBIOMICS DNA isolation kit (Zymo Reserch, CA) and the concentration are estimated using the Qubit 2.0 dsDNA high sensitivity assay (Invitrogen, CA). DNA libraries are prepared using the Illumina Nextera Flex library kit and an equimolar volume of each library will be pooled and sequenced on an Illumina NovaSeq S1 instrument (NovaSeq Control Software v1.7.5) on a 2×150 bp paired end run. Raw sequencing reads are processed using Solexa QA v3.1.7.1 (Cox et al., 2010) for trimming and removing of adaptors using a Phred score >20 and a minimum fragment size of 50 bp. Mouse DNA removal from the metagenomes is performed by mapping reads to the mouse reference genome GRCm38p6 using Bowtie2 v 2.4.2, with default parameters (Langmead and Salzberg, 2012).

Taxonomic classification of the short-read metagenomes are based on marker genes identified using MetaPhlAn2 (Segata et al., 2012), and organism abundances are calculated at different classification levels (species, genus, family). Functional profiling of microbial community members is performed using HUMAnN2 (Franzosa et al., 2018) and reference pathways databases including UniRef90 and ChocoPhlAn. The abundance of metabolic pathways in the gut microbiome are estimated using the HUMAnN2 output.

Histopathology: At the end of the experiment, hind paws are stored in tissue fixative. Samples are transferred into decalcification solution, and tissue samples are processed, sectioned, and stained with Haematoxylin & Eosin. Sections are scored by a qualified histopathologist, blind to the experimental design, for signs of arthritis to include inflammation, articular cartilage damage and damage to the underlying metaphyseal bone. A detailed scoring system is used (see below). Data will be graphed (Mean±SEM). Raw and analysed data will be provided as well as representative pictures.

TABLE 9

Histopathology Scoring System

| Type | Grade | Description |
| --- | --- | --- |
| Inflammation | 0 | Normal Joint |
| Inflammation | 1 | Mild synovial hyperplasia with inflammation dominated by neutrophils. Low numbers of neutrophils and macrophages in joint space |
| Inflammation | 2 | Synovial hyperplasia with moderate to marked inflammation involving both neutrophils and macrophages. Neutrophils and macrophages in joint space; may be some necrotic tissue debris |
| Inflammation | 3 | Synovial hyperplasia with marked inflammation involving both neutrophils and macrophages. Loss of synoviocyte lining Inflammation may extend from synovium to surrounding tissue including muscle. Numerous neutrophils and macrophages in joint space, together with significant necrotic tissue debris |
| Articular cartilage damage | 0 | Normal joint |
| Articular cartilage damage | 1 | Articular cartilage shows only mild degenerative change Early pannus formation may be present peripherally. |
| Articular cartilage damage | 2 | Articular cartilage shows moderate degenerative change and focal loss. Pannus formation is present focally |
| Articular cartilage damage | 3 | Significant disruption and loss of articular cartilage with extensive pannus formation |
| Damage to the underlying metaphyseal bone | 0 | Normal joint |
| Damage to the underlying metaphyseal bone | 1 | No change to underlying metaphyseal bone |
| Damage to the underlying metaphyseal bone | 2 | May be focal necrosis or fibrosis of metaphyseal bone. |
| Damage to the underlying metaphyseal bone | 3 | Disruption or collapse of metaphyseal bone. Extensive inflammation, necrosis or fibrosis extending to medullary space of the metaphysis |

Delayed Type Hypersensitivity model of RA:

In addition to the collagen-induced arthritis mouse model of RA study described above, a delayed type hypersensitivity study for RA is conducted in mice, and is conducted as follows. The studies are conducted in a BSL-1, quarantined room. Mice are acclimated to the facility for 1 week followed by an additional 2 week acclimation with bedding mixing to normalize microbiomes across cages. Fecal microbiome samples are collected 1-2 days prior to mBSA treatment #1. At 8 weeks of age (day 0), animals receive an intra-plantar mBSA (methylated Bovine Serum Albumin) challenge or PBS/Complete fruend's adjuvent (Control) in the right hindpaw. At 8 weeks of age (day 0), immediately following mBSA, animals are treated with either DMAs (twice daily) or Dexamethasone (Dex) 5 mg/kg (once daily). Treatment with DMA or Dex is continued until day 8. Mice receiving DMAs are only gavaged in the morning on day 8. On day 8, mice receive an intra-plantar mBSA challenge or PBS/CFA (control) in the right hind paw after Dex or DMA treatment. Paw swelling is measured on day 9. At the end of the study, the following samples/tissues shown in Table 9.1 are collected and further characterized as described above.

TABLE 9.1

| Organ/material | Storage | Application |
| --- | --- | --- |
| Blood | Plasma: −80° C. | Cytokine profiling |
| Fecal pellet | −80° C. | Shotgun metagenomics |
| Spleen | Half flash frozen, half splenocyte prep and cyropreserved | Immune cell profiling: Flow |
| mBSA injected paw | 10% formalin | Histopathology, Immunostaining |

DMAs are identified that reduce paw inflammation and reduce pro-inflammatory cytokine secretion/detection in blood and injected paw samples.

Periodontal Disease (Systemic Delivery)

Our lead candidate DMAs are evaluated for their therapeutic efficacy in a mouse model of periodontal disease. All mice are group housed with 5 mice per cage in individually ventilated cages (IVCs) specifically designed for germ free husbandry. After an acclimation period, mice are randomly divided into groups, baseline samples of feces, oral microbiome swab, and blood are collected, and baseline measures of body mass are recorded. On Day 0, periodontitis is induced in 12-month-old C57bl/6J male and female mice using the well described ligature induced periodontal disease model (Aghaloo et al., 2011). Briefly, a sterile wire ligature is placed around the crown of the right first maxillary molar to induce the disease process. Immediately following induction of periodontitis, mice begin bi-daily administration by oral gavage with water (negative control) or one of five test DMAs for a period of 8-weeks. Weekly fecal and oral microbiome samples are collected to monitor the functional and taxonomic composition of the gut and oral microbiome over time. After the 8-week administration period, tissues are collected from each mouse for downstream analysis as follows.

Metagenomic analysis of fecal pellets: DNA from the fecal pellets are extracted using the ZymoBIOMICS DNA isolation kit (Zymo Reserch, CA) and the concentration are estimated using the Qubit 2.0 dsDNA high sensitivity assay (Invitrogen, CA). DNA libraries are prepared using the Illumina Nextera Flex library kit and an equimolar volume of each library will be pooled and sequenced on an Illumina NovaSeq S1 instrument (NovaSeq Control Software v1.7.5) on a 2×150 bp paired end run. Raw sequencing reads are processed using Solexa QA v3.1.7.1 (Cox et al., 2010) for trimming and removing of adaptors using a Phred score >20 and a minimum fragment size of 50 bp. Mouse DNA removal from the metagenomes is performed by mapping reads to the mouse reference genome GRCm38p6 using Bowtie2 v 2.4.2, with default parameters (Langmead and Salzberg, 2012).

Taxonomic classification of the short-read metagenomes are based on marker genes identified using MetaPhlAn2 (Segata et al., 2012), and organism abundances are calculated at different classification levels (species, genus, family). Functional profiling of microbial community members is performed using HUMAnN2 (Franzosa et al., 2018) and reference pathways databases including UniRef90 and ChocoPhlAn. The abundance of metabolic pathways in the gut microbiome are estimated using the HUMAnN2 output.

Metagenomic analysis of oral microbiome samples: Bacterial DNA extraction is performed using commercially available DNA purification kit (Epicentre MasterPure™) according to manufacturer's guidelines and the DNA concentration will be estimated using the Qubit 2.0 dsDNA high sensitivity assay (Invitrogen, CA). DNA library preparation, sequencing, and analysis is carried out as described above.

Circulating pro- and anti-inflammatory cytokine analysis: Blood is collected from each mouse into EDTA treated tubes at the time of sacrifice, and plasma is separated from cells. Cells are saved for peripheral blood mononuclear cell (PBMC) analysis. Plasma samples are analyzed by ELISA or Multiplex assay for circulating inflammatory cytokine levels including but not limited to CRP, TNF-α, IL-1β, IL-2, IL-3, IL-4, IL-5, IL-6, IL-7, IL-8, IL-9, IL-10, IL-12, IL-13, IL-15, IL-17, IL-21, IL-22, IL-23, IL-27 IFNγ, G-CSF, GM-CSF, IP-10, KC, LIF, LIX, MCP-1, M-CSF, MIG, MIP-1α, MIP-1β, MIP-2, MIP-3, RANTES, RANKL and VEGF as previously described (Schott et al., 2018).

Peripheral blood mononuclear cell (PBMC) analysis: PBMC populations are analyzed by flow cytometry as previously described (Rao et al., 2012). Anticoagulant treated blood undergoes density gradient centrifugation in Ficol to isolate PBMC populations from granulocytes, erythrocytes, and platelets. After which, PBMCS are washed thoroughly and resuspended in FACS buffer. Following resuspension cells undergo Fc (Constant Fragment) blocking to obstruct antibody binding to cellular Fc receptors. Cell suspensions are then treated with unique fluorescent antibodies that are specific for immunophenotyping markers. For instance, CD3 antibodies and CD19 antibodies would be used to label T and B cells, respectively. Through this process T cells, T cell subsets, B cells, monocytes, dendritic cells, phagocyte subsets, natural killer cells and other cellular populations, as deemed relevant, are analyzed.

Bone marrow and splenic immune cell analysis: Bone marrow aspirates and spleens are collected for immune cell phenotyping by flow cytometry and RNAseq as previously described (Tyagi et al., 2018). Upon collection, samples are split in half and either flash frozen for RNA analysis or immediately processed for flow cytometry. Samples are processed for flow cytometry as described for PBMCs, with the addition that spleens are homogenized either mechanically or enzymatically prior to washing and resuspension in FACS buffer.

Colonic tissue isolation for RNA and protein analysis: Two cm sections of proximal colonic tissue and two cm sections of terminal ileum tissue are isolated, split in half, and flash frozen for RNA and protein evaluation of tight junctions and claudins, critical mediators of gut barrier integrity, as well as inflammatory cytokine levels including but not limited to TNF-α, IL-17, IFNγ and IL-1β. RNA is extracted and analyzed by qRT-PCR, and protein is extracted and evaluated by ELISA and/or western blot as previously described for the aforementioned proteins of interest (Li et al., 2016).

Micro-computed tomographic (μCT) scanning: To analyze amount of alveolar bone loss following ligature induced periodontal disease, jaw bones are imaged by μCT scanning at 16-μm resolution, and volumetric data are converted to DICOM format and imported Imaging software to generate 3D and multiplanar reconstructed images. To quantify the amount of bone loss induced by experimental periodontal disease, the imaged volume is oriented with the nasal cavity floor parallel to the horizontal plane and the midpalatal suture parallel to the midsagittal plane. Then the volume is angled such that the long axis of the distal root of the first molar and the mesial root of the second molar are vertical to the horizontal plane. Then the distance between the cementoenamel junction and the alveolar bone crest are measured at the center of D1 and M2. To quantitatively assess changes in the width of the buccal alveolar outline on axial slices, the imaged volume is oriented such that the floor of the nasal cavity is parallel to the horizontal plane and the midpalatal suture was parallel to the midsagittal plane. Then the shortest distance from the buccal surface of the root to the buccal outline of the alveolar ridge is measured for the mesial and distal roots of the first and second molars at the level of the hard palate.

Histopathology: Bones are decalcified in 14.5% EDTA (pH 7.2) for 4 weeks. Samples are then embedded in paraffin, and 5-μm-thick coronal sections at the interproximal area between the first and second maxillary molars are made. Thus each section includes a complete cross section through the entire maxilla, which allows a side-by-side comparison of the bone, teeth, and soft tissues from the ligature (right) and nonligature (left) sites. To quantify the area of osteonecrosis and periosteal thickness, hematoxylin, and eosin (H&E)-stained slides are digitally scanned using the Aperio XT automated slide scanner and the Aperio ImageScope Version 10 software (Aperio Technologies, Inc., Vista, CA, USA). Areas of osteonecrosis, defined as loss of more than five contiguous osteocytes with confluent areas of empty lacunae, are marked and the total area are calculated by the ImageScope software. The ruler tool in ImageScope is used to measure the greatest area of buccal periosteal thickness on both the ligature and nonligature sides. Numbers of empty and total osteocytic lacunae are counted manually on the digital whole-slide image over a 1-mm-long and 0.25-mm-wide area of bone (length and width measured with the ImageScope ruler tool) at the buccal alveolus adjacent to the D1 root.

Protein and cytokine analysis of periodontal tissue: Whole buccal and palatal tissues of maxillary molars are collected. RNA is extracted and analyzed by qRT-PCR as previously described (Glowackia et al., 2013), and protein is extracted and evaluated by ELISA and/or western blot as previously described for the cytokines and proteins of interest including but not limited to IL-10, TGF-β, TNF-α, cytotoxic T lymphocyte antigen 4 (CTLA-4), and RANKL.

Periodontal Disease (Local Delivery)

Our lead candidate DMAs are evaluated for their therapeutic efficacy in a mouse model of periodontal disease. All mice are group housed with 5 mice per cage in individually ventilated cages (IVCs) specifically designed for germ free husbandry. After an acclimation period, mice are randomly divided into groups, baseline samples of feces, oral microbiome swab, and blood are collected, and baseline measures of body mass are recorded. On Day 0, periodontitis is induced in 12-month-old C57bl/6J male and female mice using the well described ligature induced periodontal disease model (Aghaloo et al., 2011). Briefly, a sterile wire ligature is placed around the crown of the right first maxillary molar to induce the disease process. Immediately following induction of periodontitis, mice begin bi-daily administration by brushing onto the oral site with water (negative control), or one of five test DMAs for a period of 8-weeks. Weekly fecal and oral microbiome samples are collected to monitor the functional and taxonomic composition of the gut and oral microbiome over time. After the 8-week administration period, tissues are collected from each mouse for downstream analysis as follows.

Metagenomic analysis of fecal pellets: DNA from the fecal pellets are extracted using the ZymoBIOMICS DNA isolation kit (Zymo Reserch, CA) and the concentration are estimated using the Qubit 2.0 dsDNA high sensitivity assay (Invitrogen, CA). DNA libraries are prepared using the Illumina Nextera Flex library kit and an equimolar volume of each library will be pooled and sequenced on an Illumina NovaSeq S1 instrument (NovaSeq Control Software v1.7.5) on a 2×150 bp paired end run. Raw sequencing reads are processed using Solexa QA v3.1.7.1 (Cox et al., 2010) for trimming and removing of adaptors using a Phred score >20 and a minimum fragment size of 50 bp. Mouse DNA removal from the metagenomes is performed by mapping reads to the mouse reference genome GRCm38p6 using Bowtie2 v 2.4.2, with default parameters (Langmead and Salzberg, 2012).

Taxonomic classification of the short-read metagenomes are based on marker genes identified using MetaPhlAn2 (Segata et al., 2012), and organism abundances are calculated at different classification levels (species, genus, family). Functional profiling of microbial community members is performed using HUMAnN2 (Franzosa et al., 2018) and reference pathways databases including UniRef90 and ChocoPhlAn. The abundance of metabolic pathways in the gut microbiome are estimated using the HUMAnN2 output.

Metagenomic analysis of oral microbiome samples: Bacterial DNA extraction is performed using commercially available DNA purification kit (Epicentre MasterPure™) according to manufacturer's guidelines and the DNA concentration will be estimated using the Qubit 2.0 dsDNA high sensitivity assay (Invitrogen, CA). DNA library preparation, sequencing, and analysis is carried out as described above.

Circulating pro- and anti-inflammatory cytokine analysis: Blood is collected from each mouse into EDTA treated tubes at the time of sacrifice, and plasma is separated from cells. Cells are saved for peripheral blood mononuclear cell (PBMC) analysis. Plasma samples are analyzed by ELISA or Multiplex assay for circulating inflammatory cytokine levels including but not limited to CRP, TNF-α, IL-1β, IL-2, IL-3, IL-4, IL-5, IL-6, IL-7, IL-8, IL-9, IL-10, IL-12, IL-13, IL-15, IL-17, IL-21, IL-22, IL-23, IL-27 IFNγ, G-CSF, GM-CSF, IP-10, KC, LIF, LIX, MCP-1, M-CSF, MIG, MIP-1α, MIP-1β, MIP-2, MIP-3, RANTES, RANKL and VEGF as previously described (Schott et al., 2018).

Peripheral blood mononuclear cell (PBMC) analysis: PBMC populations are analyzed by flow cytometry as previously described (Rao et al., 2012). Anticoagulant treated blood undergoes density gradient centrifugation in Ficol to isolate PBMC populations from granulocytes, erythrocytes, and platelets. After which, PBMCS are washed thoroughly and resuspended in FACS buffer. Following resuspension cells undergo Fc (Constant Fragment) blocking to obstruct antibody binding to cellular Fc receptors. Cell suspensions are then treated with unique fluorescent antibodies that are specific for immunophenotyping markers. For instance, CD3 antibodies and CD19 antibodies would be used to label T and B cells, respectively. Through this process T cells, T cell subsets, B cells, monocytes, dendritic cells, phagocyte subsets, natural killer cells and other cellular populations, as deemed relevant, are analyzed.

Bone marrow and splenic immune cell analysis: Bone marrow aspirates and spleens are collected for immune cell phenotyping by flow cytometry and RNAseq as previously described (Tyagi et al., 2018). Upon collection, samples are split in half and either flash frozen for RNA analysis or immediately processed for flow cytometry. Samples are processed for flow cytometry as described for PBMCs, with the addition that spleens are homogenized either mechanically or enzymatically prior to washing and resuspension in FACS buffer.

Colonic tissue isolation for RNA and protein analysis: Two cm sections of proximal colonic tissue and two cm sections of terminal ileum tissue are isolated, split in half, and flash frozen for RNA and protein evaluation of tight junctions and claudins, critical mediators of gut barrier integrity, as well as inflammatory cytokine levels including but not limited to TNF-α, IL-17, IFNγ and IL-1β. RNA is extracted and analyzed by qRT-PCR, and protein is extracted and evaluated by ELISA and/or western blot as previously described for the aforementioned proteins of interest (Li et al., 2016).

Micro-computed tomographic (µT) scanning: To analyze amount of alveolar bone loss following ligature induced periodontal disease, jaw bones are imaged by µCT scanning at 16-µm resolution, and volumetric data are converted to DICOM format and imported Imaging software to generate 3D and multiplanar reconstructed images. To quantify the amount of bone loss induced by experimental periodontal disease, the imaged volume is oriented with the nasal cavity floor parallel to the horizontal plane and the midpalatal suture parallel to the midsagittal plane. Then the volume is angled such that the long axis of the distal root of the first molar and the mesial root of the second molar are vertical to the horizontal plane. Then the distance between the cementoenamel junction and the alveolar bone crest are measured at the center of D1 and M2. To quantitatively assess changes in the width of the buccal alveolar outline on axial slices, the imaged volume is oriented such that the floor of the nasal cavity is parallel to the horizontal plane and the midpalatal suture was parallel to the midsagittal plane. Then the shortest distance from the buccal surface of the root to the buccal outline of the alveolar ridge is measured for the mesial and distal roots of the first and second molars at the level of the hard palate.

Histopathology: Bones are decalcified in 14.5% EDTA (pH 7.2) for 4 weeks. Samples are then embedded in paraffin, and 5-μm-thick coronal sections at the interproximal area between the first and second maxillary molars are made. Thus each section includes a complete cross section through the entire maxilla, which allows a side-by-side comparison of the bone, teeth, and soft tissues from the ligature (right) and nonligature (left) sites. To quantify the area of osteonecrosis and periosteal thickness, hematoxylin, and eosin (H&E)-stained slides are digitally scanned using the Aperio XT automated slide scanner and the Aperio ImageScope Version 10 software (Aperio Technologies, Inc., Vista, CA, USA). Areas of osteonecrosis, defined as loss of more than five contiguous osteocytes with confluent areas of empty lacunae, are marked and the total area are calculated by the ImageScope software. The ruler tool in ImageScope is used to measure the greatest area of buccal periosteal thickness on both the ligature and nonligature sides. Numbers of empty and total osteocytic lacunae are counted manually on the digital whole-slide image over a 1-mm-long and 0.25-mm-wide area of bone (length and width measured with the ImageScope ruler tool) at the buccal alveolus adjacent to the D1 root.

Protein and cytokine analysis of periodontal tissue: Whole buccal and palatal tissues of maxillary molars are collected. RNA is extracted and analyzed by qRT-PCR as previously described (Glowackia et al., 2013), and protein is extracted and evaluated by ELISA and/or western blot as previously described for the cytokines and proteins of interest including but not limited to IL-10, TGF-β, TNF-α, cytotoxic T lymphocyte antigen 4 (CTLA-4), and RANKL.

*H. pylori*-Associated Gastritis

Our lead candidate DMAs are evaluated for their therapeutic efficacy in a mouse model of *Helicobacter pylori*-associated gastritis. All mice are group housed with 5 mice per cage in individually ventilated cages (IVCs) specifically designed for germ free husbandry. Adult male and female C57Bl/6J mice are randomly allocated to experimental groups and allowed to acclimate for two weeks. After an acclimation period, baseline samples of feces and blood are collected, and baseline measures of body mass are recorded. On Day 0, animals are infected three times over a 5-day period with a 0.1 ml volume containing $10^8$ *H. pylori* (Sydney strain, 551) organisms. Two weeks following infection, mice are treated by bi-daily oral gavage of water (negative control), triple antibiotic therapy of omeprazole, metronidazole, and clarithromycin (positive control), or one of five test DMAs for a period of 2-weeks. Fecal samples are collected weekly for metagenomic analysis. All animals are sacrificed 36 hours after the cessation of treatment for assessment of bacterial colonization by rapid qPCR and histology.

Histology. One-half of each stomach is placed into 10% buffered formalin and processed in paraffin, and 4-um sections will be stained with a modified Steiner silver stain. Colonization is assessed on a five-point scale: 0, no bacteria; 1, less than ⅓ of crypts colonized with 1 to 10 bacteria; 2, ⅓ to ⅔ of crypts colonized with 10 to 20 bacteria; 3, ⅔ of the crypts colonized with >20 bacteria; and 4, all crypts colonized with >20 bacteria as previously described (Velduyzen van Zanten et al., 2003).

Confirmation of *H. pylori* eradication by quantitative PCR: A longitudinal strip of gastric tissue from the greater curvature is digested with proteinase K at 55° C. overnight, followed by DNA extraction. *H. pylori* colonization levels in gastric tissue is quantified by PCR with strain specific primers as previously described (Velduyzen van Zanten et al., 2003). Any sample detecting <10 copies of the *H. pylori* genome is considered negative for *H. pylori* colonization.

Inflammatory cytokine quantification by qRTPCR: A longitudinal strip of gastric tissue from the greater curvature is isolated, and RNA is extracted and analyzed by qRT-PCR as previously described (Velduyzen van Zanten et al., 2003) to quantify inflammatory cytokines in the stomach tissue including but not limited to TNF-α, IL-1β, and IFNγ.

Metagenomic analysis of fecal pellets: DNA from the fecal pellets are extracted using the ZymoBIOMICS DNA isolation kit (Zymo Reserch, CA) and the concentration are estimated using the Qubit 2.0 dsDNA high sensitivity assay (Invitrogen, CA). DNA libraries are prepared using the Illumina Nextera Flex library kit and an equimolar volume of each library will be pooled and sequenced on an Illumina NovaSeq S1 instrument (NovaSeq Control Software v1.7.5) on a 2×150 bp paired end run. Raw sequencing reads are processed using Solexa QA v3.1.7.1 (Cox et al., 2010) for trimming and removing of adaptors using a Phred score >20 and a minimum fragment size of 50 bp. Mouse DNA removal from the metagenomes is performed by mapping reads to the mouse reference genome GRCm38p6 using Bowtie2 v 2.4.2, with default parameters (Langmead and Salzberg, 2012).

Taxonomic classification of the short-read metagenomes are based on marker genes identified using MetaPhlAn2 (Segata et al., 2012), and organism abundances are calculated at different classification levels (species, genus, family). Functional profiling of microbial community members is performed using HUMAnN2 (Franzosa et al., 2018) and reference pathways databases including UniRef90 and ChocoPhlAn. The abundance of metabolic pathways in the gut microbiome are estimated using the HUMAnN2 output.

Example 10: DMAs Identified with Increased Short Chain Fatty Acids Production

Figure 17A:
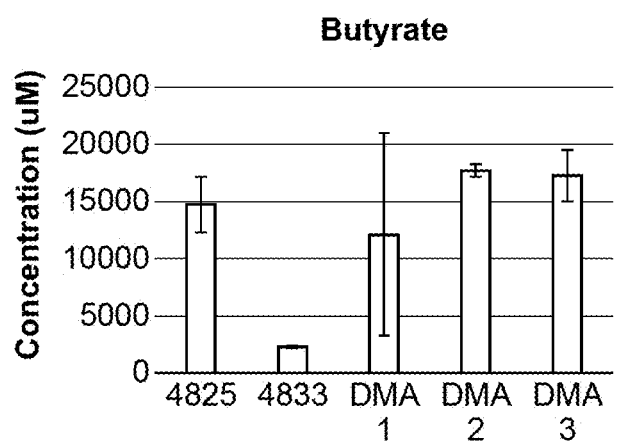
FIG. 17A is a graph depicting butyrate production of the indicated strains and DMAs.
Figure 17B:
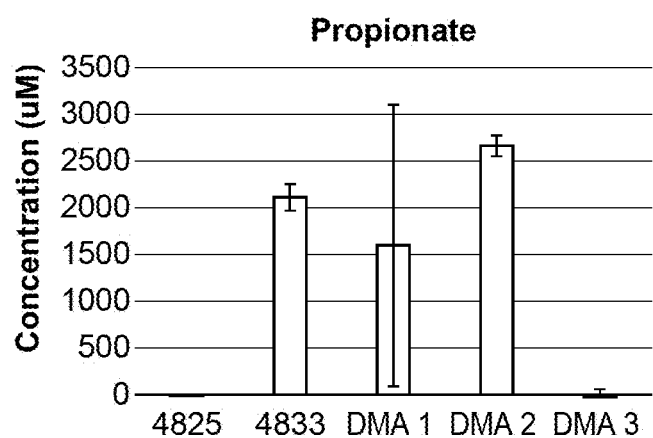
FIG. 17B is a graph depicting propionate production of the indicated strains and DMAs.

Individual strains and DMAs shown in Table 10 and Table 11 were screened for production of butyrate and propionate. For example, SBI4825 (*Clostridium* sp.) exhibited high levels of butyrate, and similar levels of butyrate were observed in DMAs 1, 2, and 3 (FIG. 17A). SBI4833 exhibited high levels of propionate (FIG. 17B). SBI4833 is present in DMAs 1 and 2, but not DMA 3. These results show that particular DMAs are capable of increased production of short chain fatty acids. SCFA data for all tested strains and DMAs are displayed in Table 7.

TABLE 10

Exemplary Strains in DMAs Selected for in vitro Characterization

| Isolate | Kingdom | Genus | Species |
|---|---|---|---|
| *SBS04254 | Bacteria | Lactobacillus | brevis |
| SBI00272 | Fungi | Hanseniaspora | occidentalis |
| *SBI04256 | Bacteria | Lactobacillus | casei |
| SBI4259 | Bacteria | Weisella | cibaria |
| SBS4263 | Fungi | Pichia | kudriavzevii |
| *SBS2335 | Bacteria | Pediococcus | pentosaceus |
| *SBI4877 | Bacteria | Bacillus | velezensis |
| SBI4833 | Bacteria | Clostridioides | mangenotii |
| SBI4825 | Bacteria | Clostridium | sp. |
| SBI00449 | Bacteria | Exiguobacterium | sp. |
| SBI00951 | Bacteria | Paenibacillus | polymyxa |
| SBI00303 | Fungi | Meyerozyma | caribbica |
| *SBI4915 | Bacteria | Lactobacillus | pentosus |
| SBI04884 | Bacteria | Enterococcus | gilvus |
| *SBI00540 | Fungi | Hanseniaspora | uvarum |
| *SBI04881 | Bacteria | Lactobacillus | buchneri |
| *SBI04916 | Bacteria | Lactococcus | lactis |
| SBI04913 | Bacteria | Lactobacillus | harbinensis |

*Indicates species with Qualified Presumption of Safety (QPS) Status

TABLE 11

Exemplary DMAs selected for in vitro characterization

| | | DMA 1 | DMA 2 | DMA 3 | DMA 4 | DMA 5 | DMA 6 | DMA 7 | DMA 8 | DMA 9 | DMA 10 | DMA 11 | DMA 12 |
|---|---|---|---|---|---|---|---|---|---|---|---|---|---|
| Anaerobe | SBI4825 | x | x | x | | | | | | | | | |
| | SBI4833 | x | x | | | | | | | | | | |
| Lactic | SBI4259 | | x | x | | | | | | x | | x | |
| Acid | *SBS04254 | | | x | | x | x | x | | x | | | x |
| Bacteria | *SBI04881 | | | | x | x | | x | | | | | x |
| | *SBS2335 | | | | x | | | | | x | | | x |
| | *SBI04916 | | | | | | x | | | | | | x |
| | SBI04913 | | | | | | x | | x | | | | |
| | SBI04884 | | | | | | | | x | | | | |
| | *SBI04256 | | | | | | | | | | | x | |
| Bacteria | SBI00951 | | | | x | | | | | | | x | |
| (Other) | *SBI4877 | | | | | x | x | | | | | x | |
| | SBI00449 | | | | | | | | x | | | | |
| Fungi | SBI00303 | x | | x | | | | | x | x | | | |
| | SBS4263 | x | | | | | | | | | | | |
| | SBI00272 | | | | x | | | | | | | | |
| | *SBI00540 | | | | | | | x | | | x | | |

*Indicates species with Qualified Presumption of Safety (QPS) Status

Example 11: DMA 12 Exhibits Reduced TNFα Secretion

Individual strains and DMAs shown in Table 7 were screened for the ability to reduce secretion of cytokines when co-cultured with macrophages.

U937 monocyte cells were cultivated in suspension in RPMI medium containing 10% FBS, 1 mM Glutamine, 12.5 mM HEPES, 1×Anti-Anti (Gibco) at 37° C. 5% $CO_2$. Monocytes were differentiated into macrophage-like cells by the addition of 20 nM phorbol 12-myristate 13-acetate (PMA) for 72 hrs, at which the media was replaced with fresh medium without PMA, leaving adherent, differentiated macrophage-like cells. Experimentation proceeded 24 hrs after medium replacement.

To examine the effect of microbial supernatants on cytokine production of macrophages, bacteria and yeast were cultivated for 24-48 hours under nutrient, temperature, and oxygen conditions favorable for robust growth of each strain. Microbes were pelleted and culture supernatants were filter sterilized. Supernatants and cultivation medium controls were added at 10% to U937 cultures and co-incubated for 24 hours to induce cytokine production. U937 culture supernatants were removed and analyzed for lysis (Cytotox 96, Promega) and IL-10 and TNFα release by ELISA (PromoCell) per the manufacturers' protocols. Results as shown in Table 7 were compared to media and agonist (LPS) controls.

To examine the effect of whole microbes on cytokine production of macrophages, microbes were inoculated onto macrophage-like cells at an 1:1 bacterial:macrophage ratio and co-incubated for 8 hrs at 37° C. 5% $CO_2$. Supernatants from the cocultures were removed and analyzed for lysis (Cytotox 96, Promega) and IL-10, IL-6, IL-1b and TNFα release by ELISA (Thermo Fisher) per the manufacturers' protocols. Results as shown in Table 7 were compared to media and agonist (LPS) controls. Microbial titers were measured at the beginning and end of the experiment by dilution plating.

Figure 18:
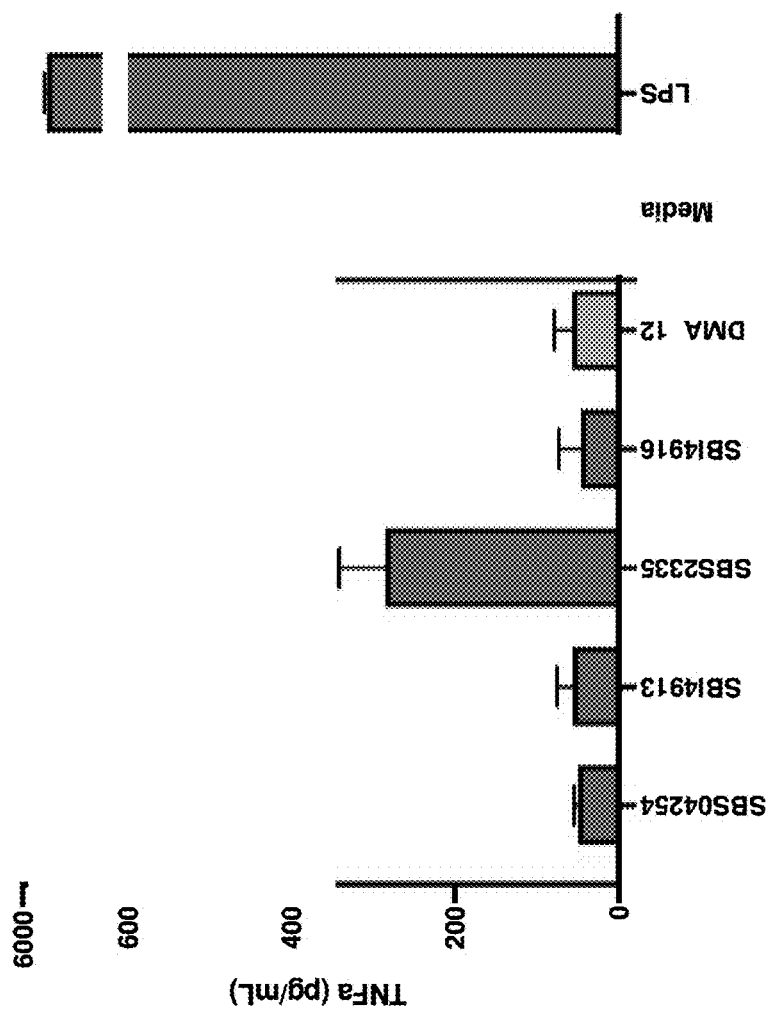
FIG. 18 is a graph depicting TNFα secretion of co-cultures of the indicated strains and DMAs with macrophage-like cells.

As shown in FIG. 18, for Tumor Necrosis Factor Alpha (TNFα), a proinflammoatry cytokine associated with rheumatoid arthritis, unlike most DMAs, whole microbes of DMA12 stimulated less TNFα secretion than its constituent microbes when incubated with macrophages. These results show that particular DMAs can be effective to reduce proinflammatory cytokine secretion by macrophages.

Example 12: Reductions in IL-8 in DMA 2 and DMA 6 vs. Constituent Microbes

Intestinal epithelial cells are the first cells to encounter microbes and contribute to the immune response. Epithelial cells can secrete Interleukin 8 (IL-8) and CXCL-1, two chemokines responsible for neutrophil recruitment to sites of inflammation. To investigate the ability of DMAs and strains to reduce the level of IL-8 in intestinal epithelial cells, DMAs shown in Table 7 were screened for stimulation of secretion of IL-8 and CXCL-1, when cultured with human colorectal adenocarcinoma epithelial cells (HT29 cells).

HT29 cells were cultivated in DMEM medium containing 10%1 mM Glutamine, 1×Anti-Anti(Gibco) at 37° C. 5% $CO_2$. Microbes were inoculated onto epithelial cells at a 1:1 bacterial:macrophage ratio and co-incubated for 16 hrs at 37° C. 5% $CO_2$. Supernatants from the cocultures were removed and analyzed for lysis (Cytotox 96, Promega) and IL-8 and CXCL-1 release by ELISA (Thermo Fisher) per the manufacturers' protocols. Results were compared to media and agonist (LPS) controls. Microbial titers were measured at the beginning and end of the experiment by dilution plating.

Figure 19:
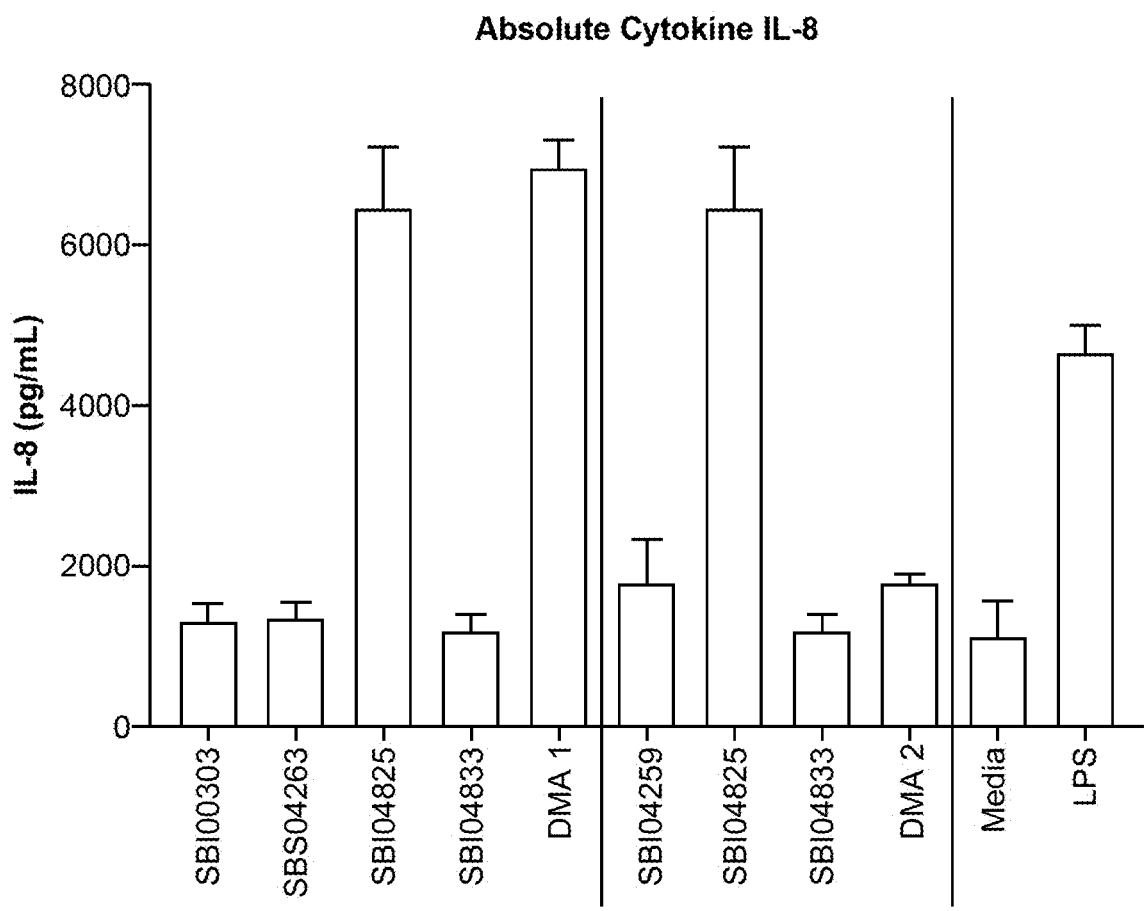
FIG. 19 is a graph depicting IL-8 secretion of co-cultures of the indicated strains and DMAs with intestinal epithelial cells.
Figure 20:
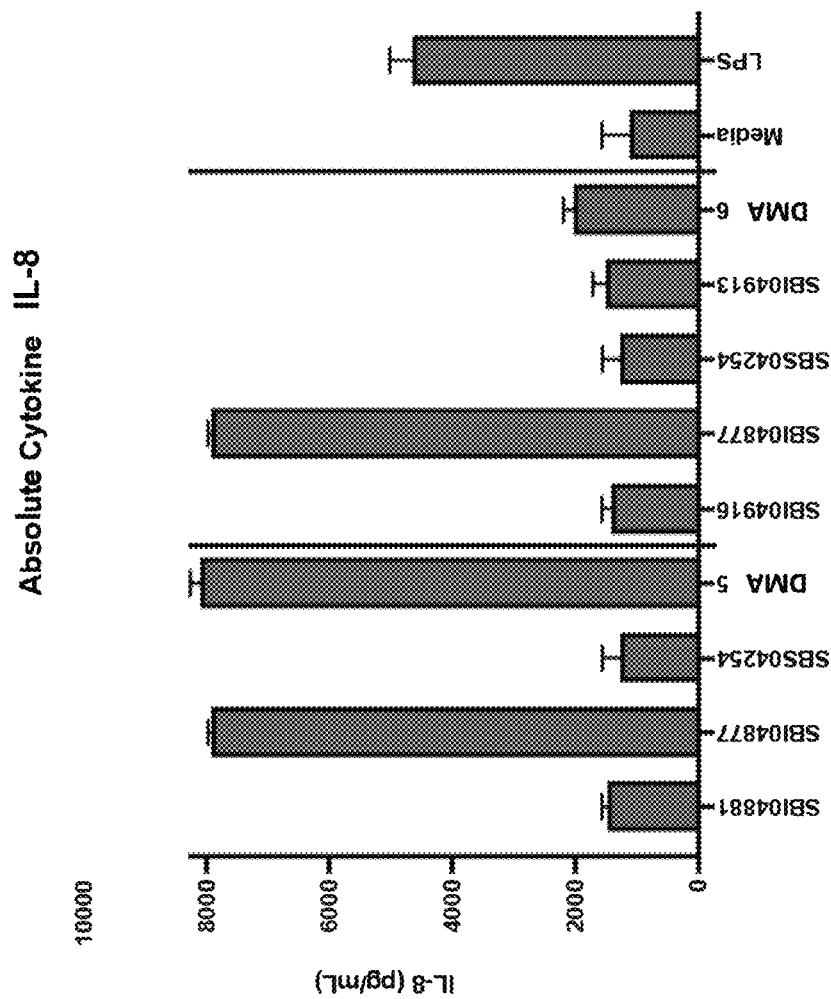
FIG. 20 is a graph depicting IL-8 secretion of co-cultures of the indicated strains and DMAs with intestinal epithelial cells.

The robust IL-8 response induced by SBI4825 was ameliorated in DMA 2 by other microbes present, but not in DMA1 (FIG. 19). The robust IL-8 response induced by SBI4877 was ameliorated in DMA 6 by other microbes present, but not in DMA5 (FIG. 20). These results show that particular DMAs can be effective to reduce proinflammatory cytokine secretion by intestinal epithelial cells.

Example 13: Synergy for GABA Production in DMA 5 and DMA 6

In addition to being beneficial for neurological, vascular, and musculoskeletal functioning, neurotransmitters can directly affect immune cells. DMAs shown in Table 7 were screened for secretion of GABA, a neurotransmitter derived from glutamate that has been shown to inhibit T cell responses and reduce proinflammatory cytokine secretion (FIG. 21).

To examine the ability of individual strains and DMAs to produce GABA, single microbial strains were grown for 24-48 hrs to achieve a high OD in brain heart infusion (BHI) or tryptic soy broth (TSB) for bacteria and potato dextrose broth (PDB) for yeast. Cultures were OD600 normalized to achieve a uniform density and inoculated (10% final volume) into TSB containing 0.1% added tryptophan and grown for 48 hrs. Culture supernatants were removed and analyzed by ELISA for GABA production (LS Bio) following the manufacturers' protocols.

Figure 21:
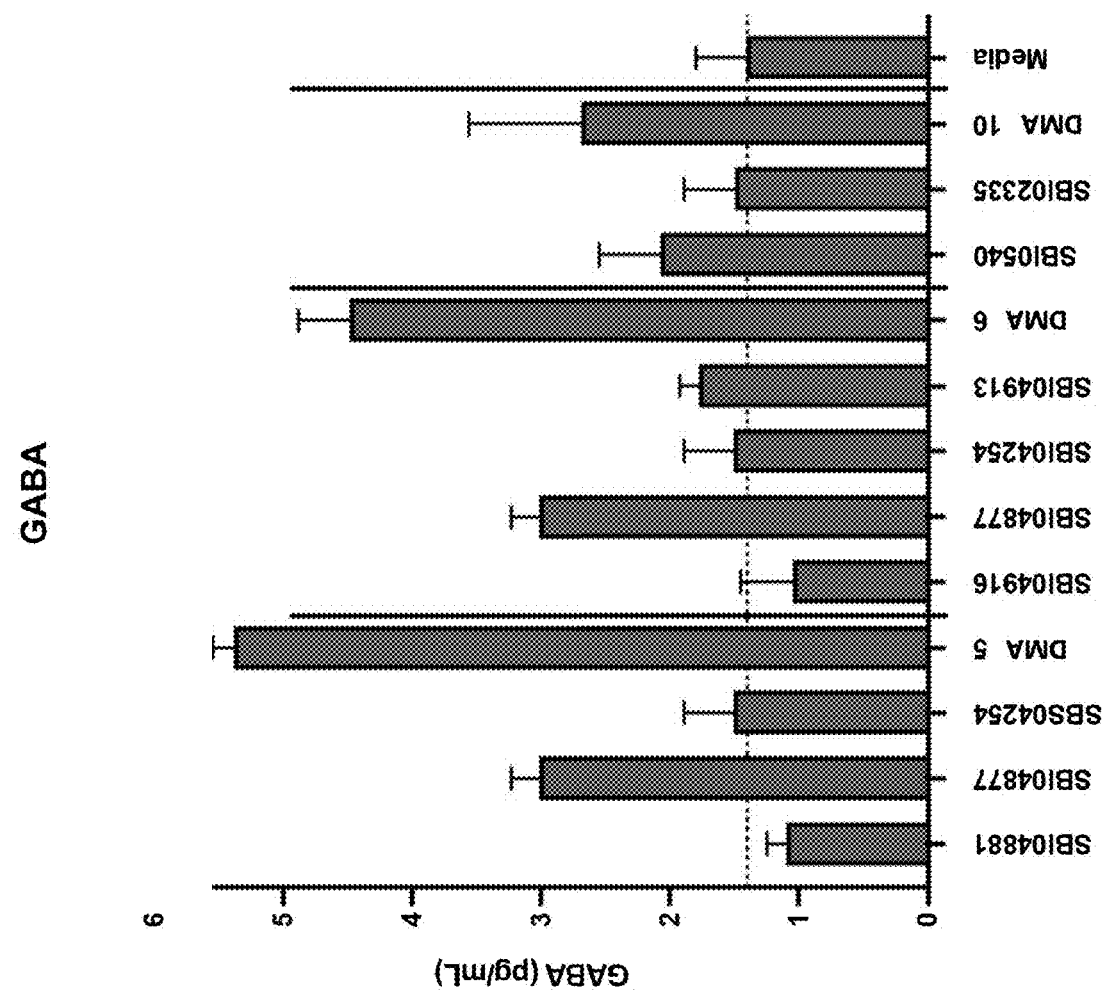
FIG. 21 is a graph depicting GABA production of the indicated strains and DMAs. Vertical lines separate each indicated DMA and strains that comprise each DMA are shown individually adjacent to the indicated DMA.

As shown in FIG. 21, increased levels of GABA were detected in DMA 5 and DMA 6. These results show that particular DMAs are capable of producing GABA neurotransmitter.

Example 14: Enhanced Serotonin Production in DMA3, DMA5, DMA6

DMAs shown in Table 7 were screened for secretion of serotonin, a neurotransmitter that reduces proinflammatory cytokine secretion by macrophages while modulating immune cell recruitment.

To examine the ability of individual strains and DMAs to produce serotonin, single microbial strains were grown for 24-48 hrs to achieve a high OD in brain heart infusion (BHI) or tryptic soy broth (TSB) for bacteria and potato dextrose broth (PDB) for yeast. Cultures were OD600 normalized to achieve a uniform density and inoculated (10% final volume) into TSB containing 0.1% added tryptophan and grown for 48 hrs. Culture supernatants were removed and analyzed by ELISA for Serotonin (ENZO) following the manufacturers' protocols.

Figure 22:
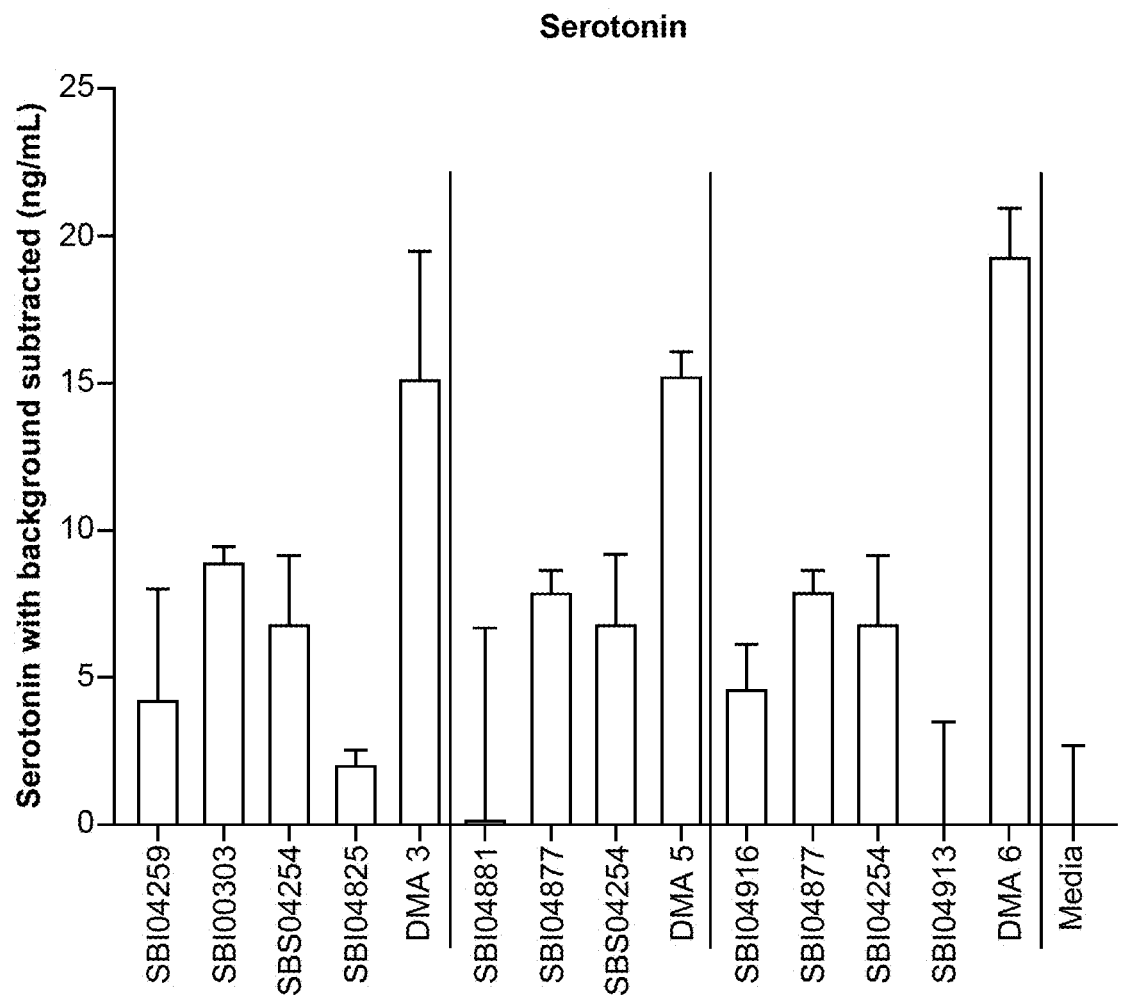
FIG. 22 is a graph depicting Serotonin production of the indicated strains and DMAs. Vertical lines separate each indicated DMA and strains that comprise each DMA are shown individually adjacent to the indicated DMA.

As shown in FIG. 22, increased levels of serotonin were detected in DMA 3, DMA 5, and DMA 6. These results show that particular DMAs are capable of producing serotonin neurotransmitter.

Example 15: Production of Serotonin by DMAs In Vitro

Figure 23:
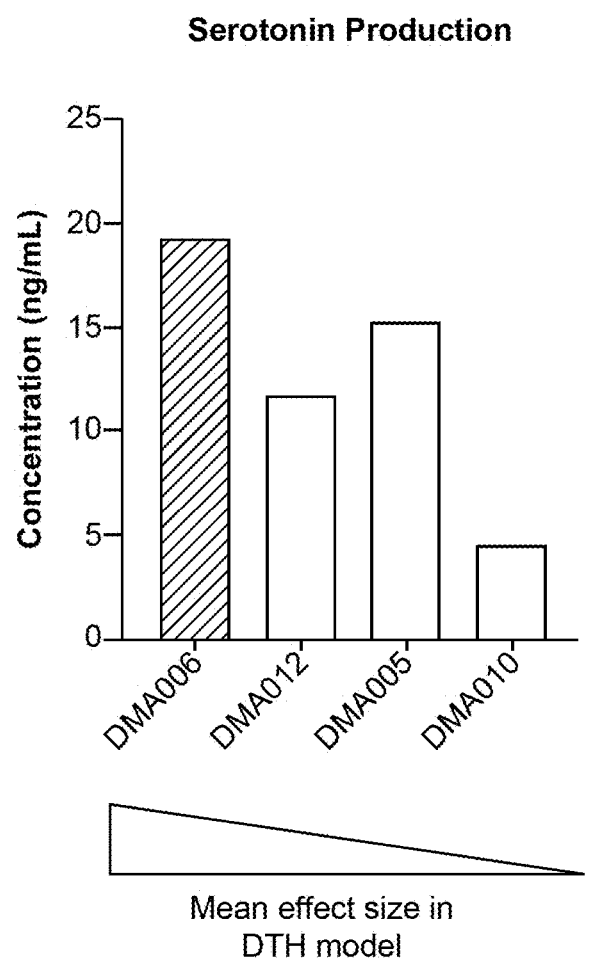
FIG. 23 is a graph depicting the concentration of serotonin produced in vitro by the indicated cultured DMAs.

To confirm the ability of DMAs to produce serotonin, DMAs were cultured in BHI medium and the amount of serotonin excreted in the culture medium was measured by ELISA. DMAs DMA005 (DMA 5), DMA006 (DMA 6), DMA010 (DMA 10), and DMA012 (DMA 12) were capable of producing serotonin. DMA006 (DMA 6) produced the largest amount of serotonin (FIG. 23). These results confirm that DMAs are capable of producing serotonin.

Figure 24:
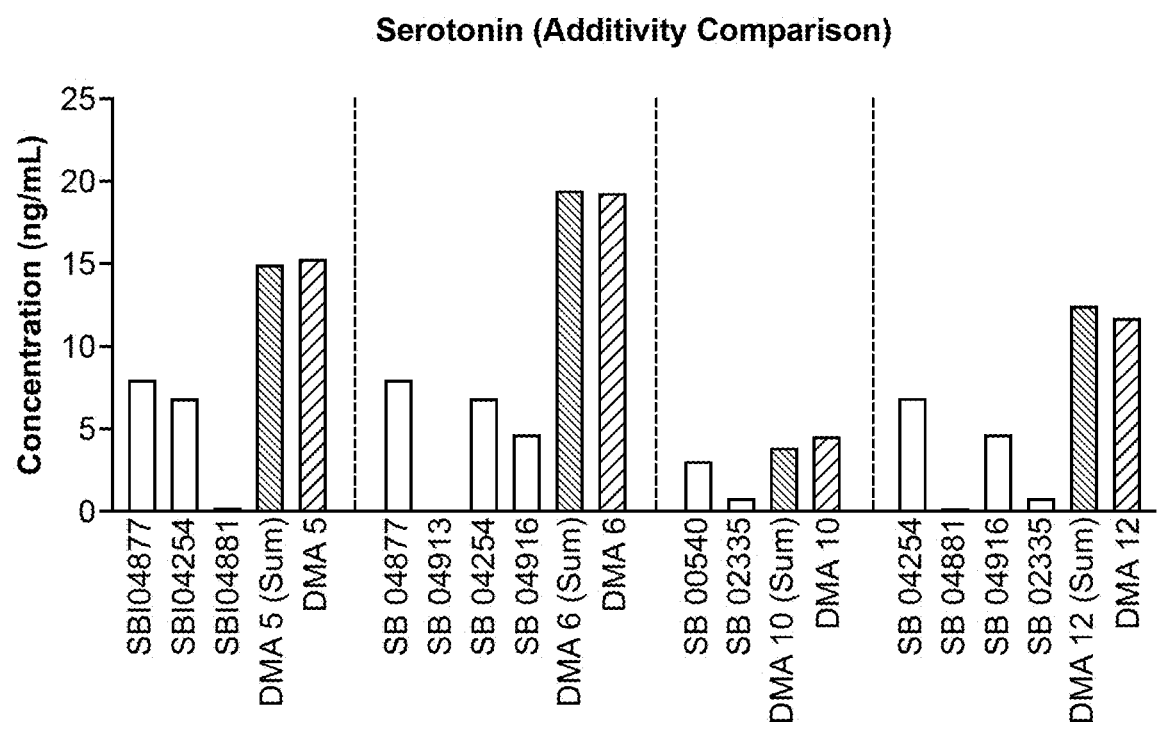
FIG. 24 is a graph depicting the concentration of serotonin produced in vitro by the indicated cultured individual strains of the DMAs, the sum of the serotonin produced of the individual stains ("sum") and the concentration of serotonin produced in vitro by the indicated cultured DMAs.

Individual strains of the DMAs were also cultured and the amount of serotonin was measured and compared to the serotonin of the strains cultured as the DMA (FIG. 24). The amount of serotonin produced by the individual strains comprising DMA005 (DMA 5), DMA006 (DMA 6), DMA010 (DMA 10) and DMA012 (DMA 12) was similar to the total sum of serotonin produced by the corresponding DMA. These results indicate that there is additivity of the serotonin produced by the individual strains when cultured as a DMA.

Figure 25:
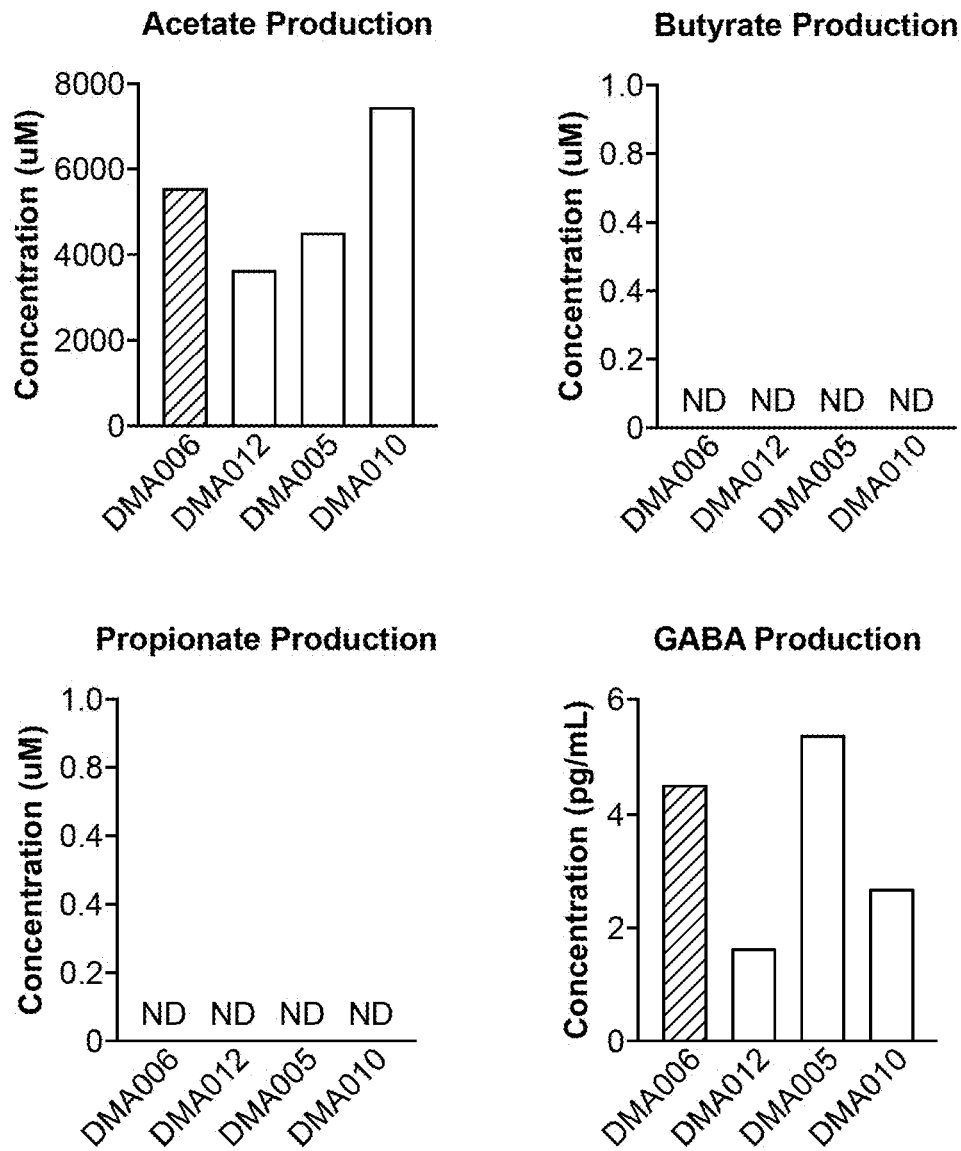
FIG. 25 are graphs depicting the concentration of metabolites: acetate (top left), butyrate (top right), propionate (bottom left) and GABA (bottom right), measured in the culture medium of the indicated DMAs cultured in vitro. "ND" indicates not detected.

Other metabolites were also measured for possible production by the DMAs in vitro, including acetate, butyrate, propionate, and GABA (FIG. 25).

Example 16: DMA Effects on Cytokine Production

Figure 26:
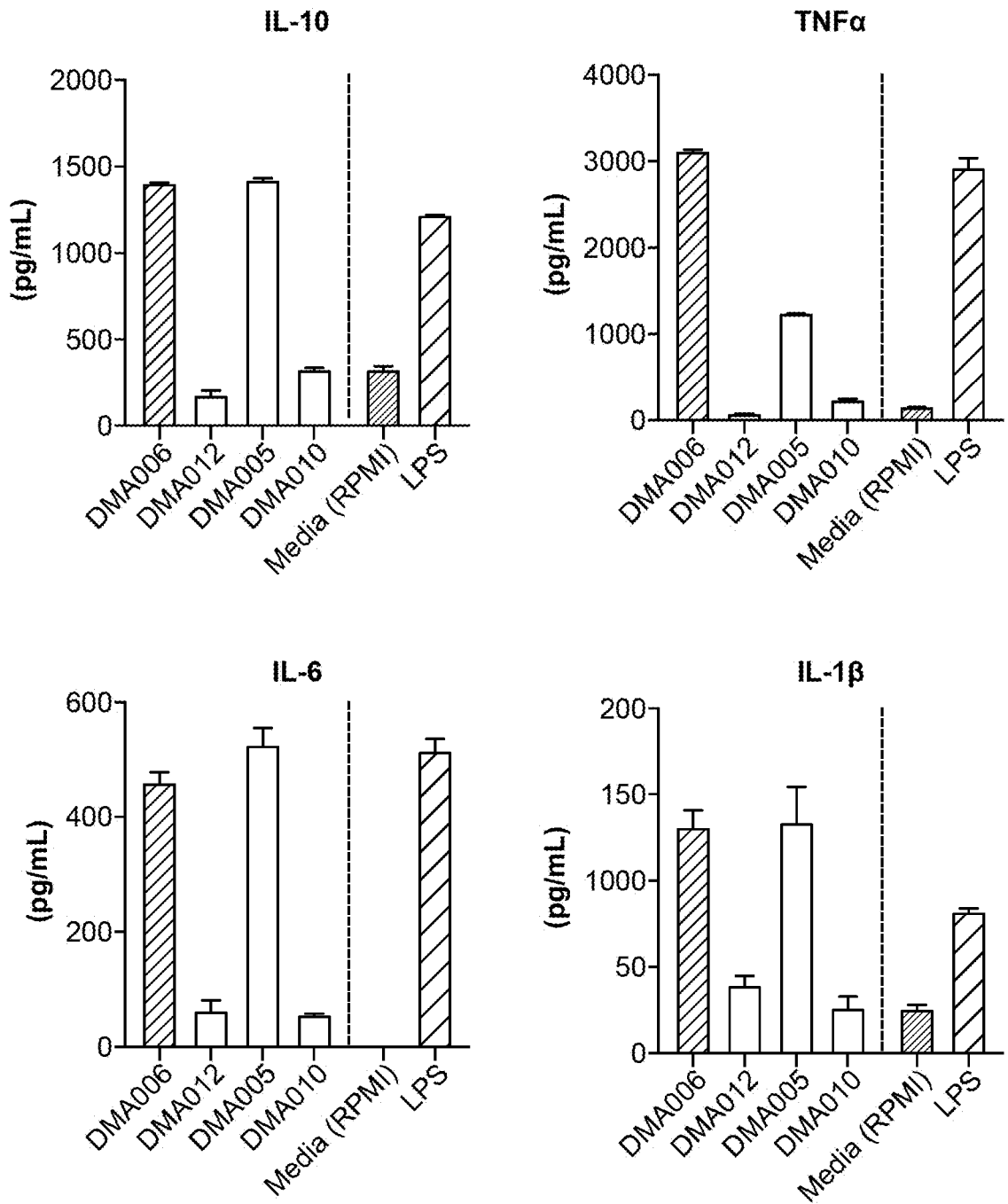
FIG. 26 are graphs depicting concentration of cytokines IL-1β, IL-6, IL-10 and TNFα in culture media of macrophages cultured in vitro with the indicated DMAs, medium alone (RPMI) or lipopolysacharride (LPS) positive control.

In order to confirm the ability of DMAs to modify cytokine production of immune cells, such as macrophages, DMAs were added to macrophages a a ratio of 4:1 (four microbes per one macrophage like cell and coincubated at 37° C., 5% $CO_2$ for eight hours, and cytokine production, such as interleukin (IL)-1β, IL-10, IL-6 and tumor necrosis factor alpha (TNFα) was measured by ELISA (FIG. 26). Macrophages cultured with DMA005 (DMA 5) or DMA006 (DMA 6) exhibited a robust production of IL-10, IL-6, and TNFα.

These results confirm that DMAs can modify cytokine production of immune cells, such as macrophages.

Figure 27:
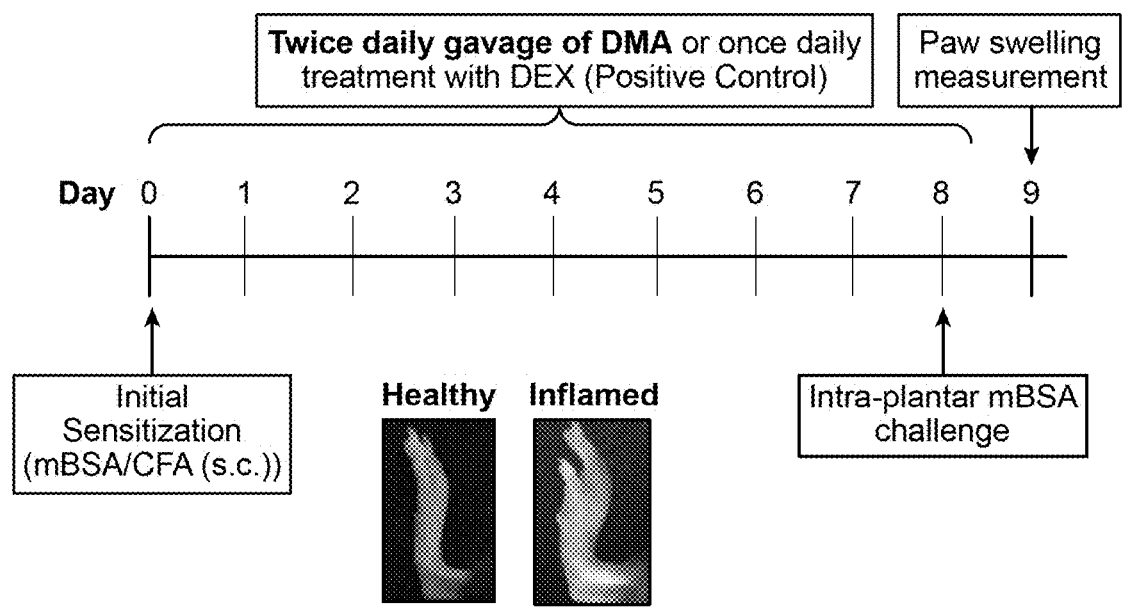
FIG. 27 is a diagram depicting the experimental design for a delayed type hypersensitivity (DTH) mouse model for testing DMAs in vivo. Images of exemplary healthy and unhealthy (inflamed) mouse paws are shown at bottom.

Example 17: Rapid Screening of DMAs in Delayed Type Hypersensitivity (DTH) Mouse Model of Inflammation For rapid screening of DMAs in animals for anti-inflammatory activity, a delayed type hypersensitivity (DTH) model of inflammation was employed. Briefly, 8-week old male mice were sensitized on Day–0 by subcutaneous injection of 1 mg/ml methylated bovine serum albumin (mBSA) and 1 mg/ml complete Freund's adjuvant (CFA). On Day–8, mice received a second challenge injection of 100 µg of BSA in 204 of PBS in the plantar surface of the left hind paw. The contra-lateral paw was injected with the same volume of saline alone. The relative swelling was calculated on Day–9 (FIG. 27). On days 0-8, DMAs were administered by oral gavage twice daily ($5\times10^9$ CFU per strain per administration) or a vehicle control. Dexamethasone was administered once daily as a positive control for reduction of paw swelling/inflammation. Paw swelling measurements were taken nine days after initial sensitization with mBSA/CFA.

Figure 28:
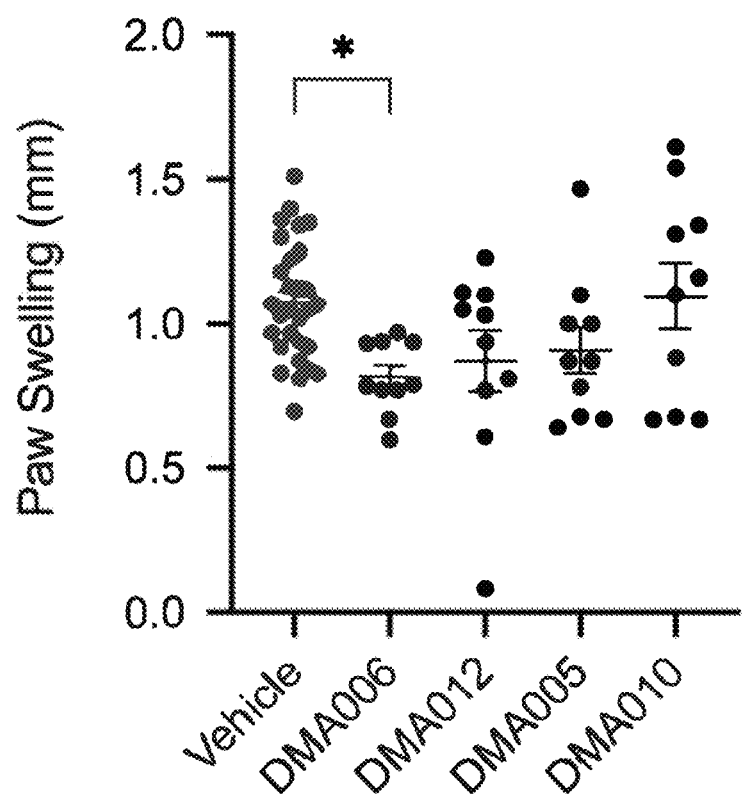
FIG. 28 is a graph depicting quantification of paw swelling in mice administered the indicated DMA compositions or vehicle control (water). Y-axis indicates paw swelling, measured by the difference between the injected (DTH) and uninjected (control) paw by calipers (mm)* p<0.05, One-way ANOVA with Dunnett's multiple comparisons test.

Exemplary DMAs listed in Table 12 were selected for screening of anti-inflammatory effects in the DTH model based on their ability to produce the immunomodulatory effectors serotonin, GABA, and acetate in vitro (FIG. 25 and FIG. 26), as well as their ability to modulate cytokine production by macrophages in vitro (production of IL-10, TNFα, IL-6, and/or IL-1β; Table 7). DMA006 (DMA 6) resulted in a significant reduction in paw swelling compared to vehicle control, ($p<0.05$, one-way ANOVA with Dunnett's multiple comparisons test), while DMA005 (DMA 5), DMA010 (DMA 10) and DMA012 (DMA 12) resulted in trends of reduced swelling (FIG. 28).

These results show that DMAs that produce the anti-inflammatory effector molecules serotonin, GABA, and acetate and that can modulate cytokine production by macrophages in vitro are able to ameliorate the inflammatory response in an animal model of delayed type hypersensitivity. These results also indicate that the effects on the inflammatory response are dependent on the composition of the DMAs and show that the DMA production of serotonin in vitro correlates with reduction of inflammation in vivo (FIG. 23).

TABLE 12

Exemplary DMAs tested in a delayed type hypersensitivity (DTH) mouse model of inflammation.

| Category | Strain | Genus | Species | DMA 5 | DMA 6 | DMA 10 | DMA 12 |
|---|---|---|---|---|---|---|---|
| Lactic Acid Bacteria | *SBS04254 | Lactobacillus | brevis | x | x | | x |
| | *SBI04881 | Lactobacillus | buchneri | x | | | x |
| | *SBS2335 | Pediococcus | pentosaceus | | | x | x |
| | *SBI04916 | Lactococcus | lactis | | x | | x |
| | SBI04913 | Lactobacillus | harbinensis | | x | | |
| Bacteria (Other) | *SBI4877 | Bacillus | velezensis | x | x | | |
| Fungi | SBI00303 | Meyerozyma | carribica | | | | |
| | *SBI00540 | Hanseniaspora | uvarum | | | x | |

*Indicates that the strain has Qualified Presumption of Safety (QPS) status.

Figure 29:
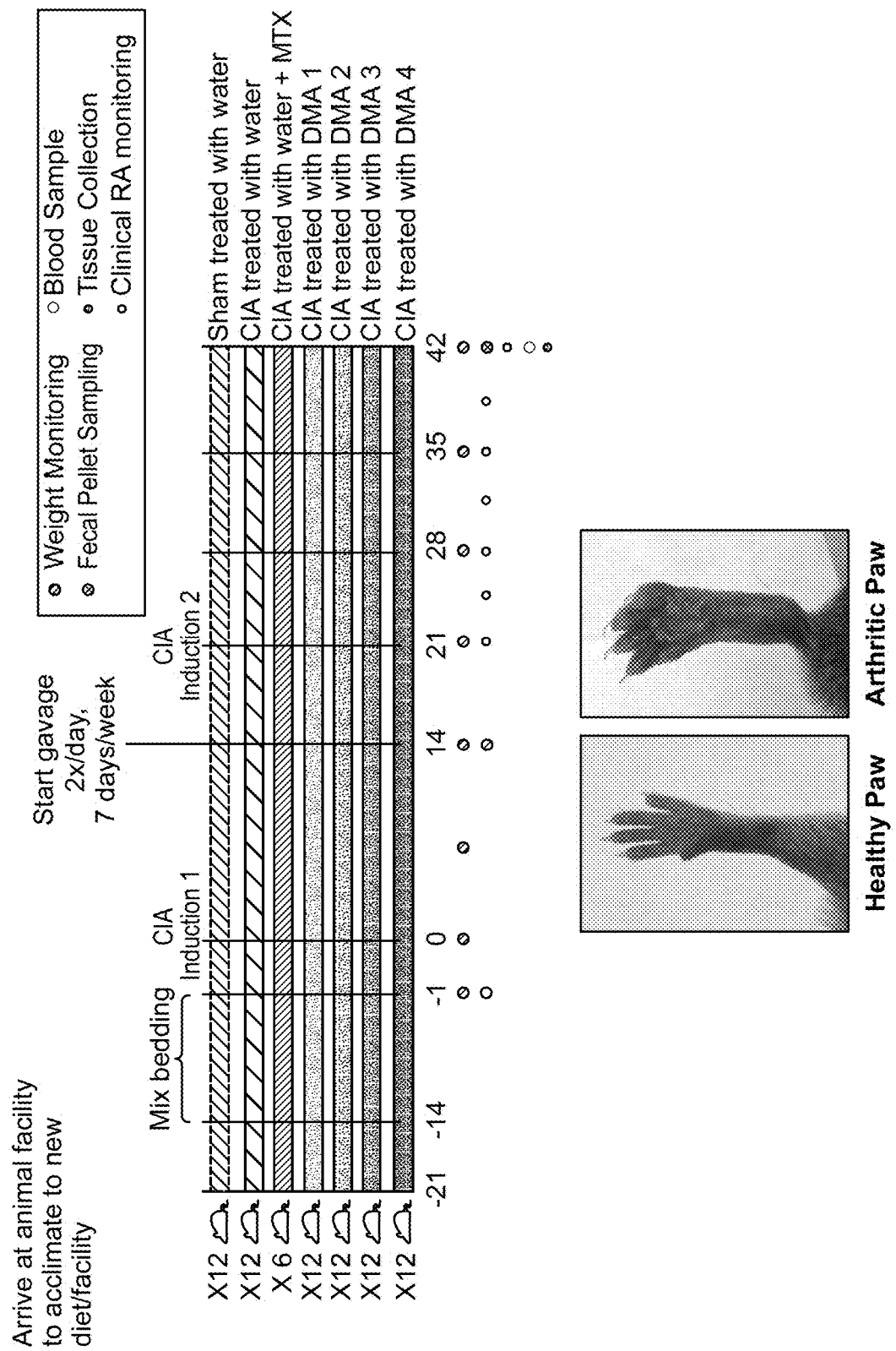
FIG. 29 is a diagram depicting the experimental design for a mouse collagen-induced arthritis (CIA) model of rheumatoid arthritis for testing DMAs effects on disease progression and immune system activity. Exemplary images of healthy and arthritic paws are shown (bottom).

Example 18: DMA Administration Delayed Onset of Arthritis in a Collagen-Induced Arthritis (CIA) Mouse Model In order to test and confirm DMAs effects for treatment of inflammation, a mouse model of collagen induced arthritis was used where collagen is administered to mice to induce arthritis. Exemplary defined microbial assemblages (DMAs) were examined for the ability to decrease paw swelling and clinical scores in the collagen induced arthritis mouse model. Mice were challenged with an initial collagen sensitization challenge on day 0 and a secondary challenge on day 21. Animals also received twice-daily gavage of exemplary DMAs (listed in Table 13, $2 \times 10^{10}$ CFU per strain per administration) or a vehicle control on days 14-42. An additional control group of animals received methotrexate injections three-times weekly on days 21-42 (positive control). Paw swelling was measured using calipers, and clinical scores were determined by observation of the animals. FIG. 29 displays the study design.

Figures 30A, 30B:
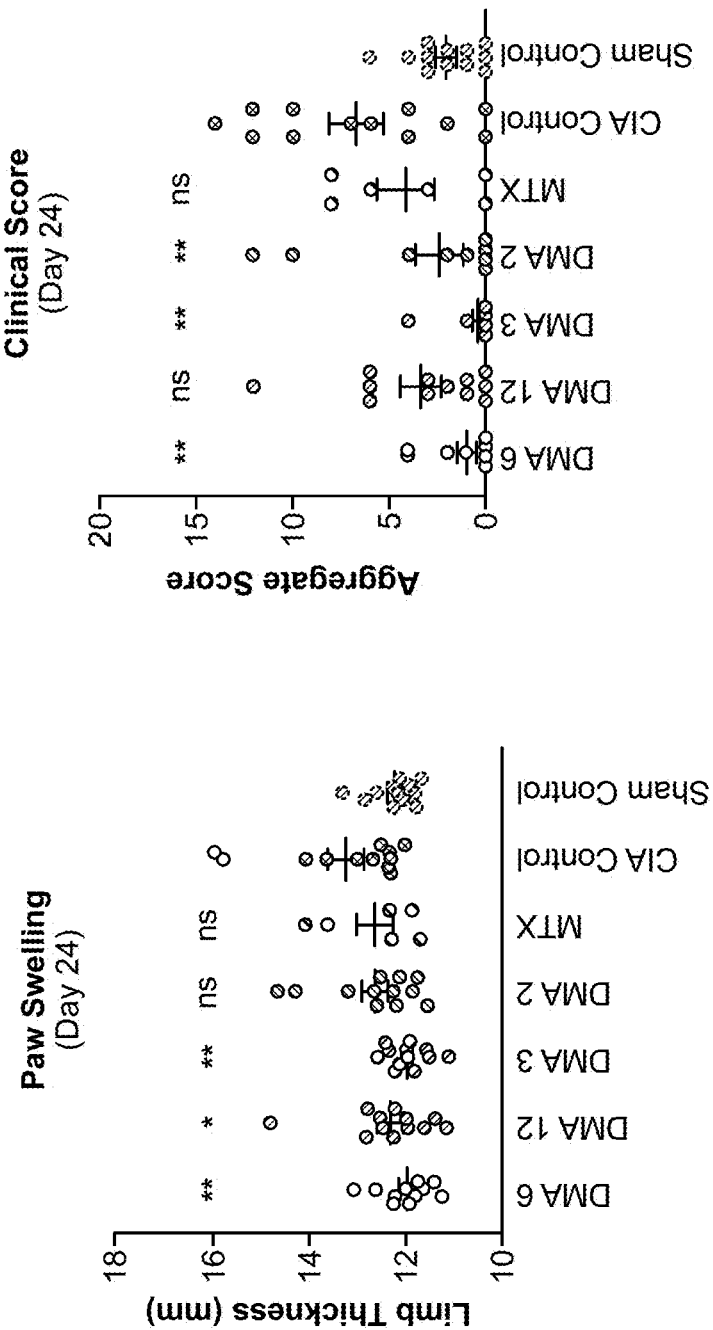
FIG. 30A is a graph depicting paw swelling in mice administered the indicated DMAs at Day 24 in a collagen-induced arthritis (CIA) model of rheumatoid arthritis, using the study design described in FIG. 29.
FIG. 30B is a graph depicting arthritis clinical scores in mice administered the indicated DMAs at Day 24 in a collagen-induced arthritis (CIA) model of rheumatoid arthritis, using the study design described in FIG. 29.

Twice daily administration of exemplary DMAs decreased paw swelling and clinical scores in mice on day 21 (3 days post disease onset), as compared to vehicle treated controls (FIGS. 30A and 30B). The effect on paw swelling was statistically significant for DMA 6, DMA 12, and DMA 3 ($p<0.05$ compared to CIA Control. One-way ANOVA with multiple hypothesis testing correction). The effect on clinical score was statistically significant for DMA 6, DMA 2, and DMA 3 ($p<0.05$ compared to CIA Control. One-way ANOVA with multiple hypothesis testing correction). These results confirm that the DMAs are effective for reducing inflammation in a mouse model of arthritis.

Figure 31:
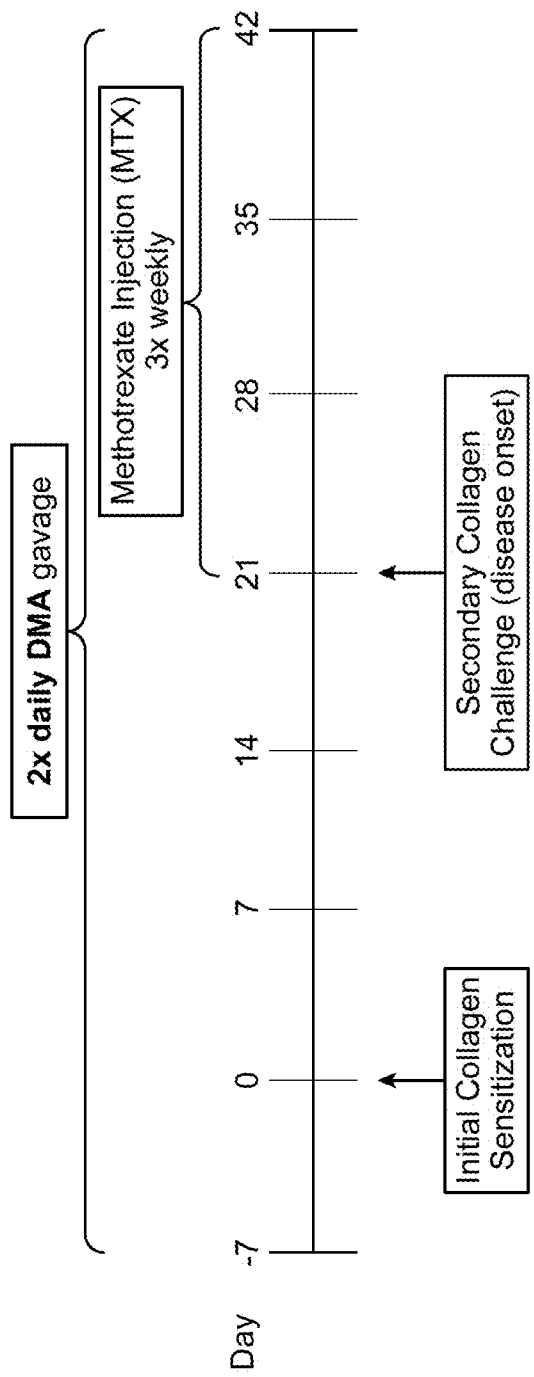
FIG. 31 is a diagram depicting the study design for examining the effects of DMAs administered 7 days prior to antigen challenge on disease progression in a collagen-induced arthritis (CIA) model in mice.

Example 19: DMA Administration Prior to Disease Induction Delayed Onset of Arthritis in a Collagen-Induced Arthritis (CIA) Mouse Model Exemplary defined microbial assemblages (DMAs) were examined for the ability to decrease paw swelling and clinical scores in a collagen induced arthritis mouse model by administering the DMAs prior to immunological challenge. Mice were challenged with an initial collagen sensitization challenge on day 0 and a secondary challenge on day 21. Animals received twice-daily gavage of exemplary DMAs (listed in Table 13, $4 \times 10^{10}$ CFU per strain per administration) or a vehicle control starting 7 days prior to initial sensitization challenge. A control group of animals received methotrexate injections three-times weekly on days 21-42 (positive control). Paw swelling was measured using calipers, and clinical scores were determined by observation of the animals. FIG. 31 displays the study design.

Twice daily administration of exemplary DMAs, DMA 3 and DMA 6, prior to disease induction reduced arthritis scores (FIGS. 32A and 32C) and paw swelling (FIGS. 32B and 32D) in combination with methotrexate administration compared to methotrexate administration alone. The effect on clinical scores was statistically significant on day 35 for MTX ($p=0.03$), MTX+DMA 6 ($p<0.0001$), and MTX+DMA 3 groups ($p=0.0032$) compared to the untreated control (two-way repeated measures ANOVA with multiple hypothesis testing correction).

These results confirm that the DMAs are effective for the prevention of inflammation in a mouse model of arthritis.

TABLE 13

Exemplary DMAs tested in a collagen induced arthritis (CIA) mouse model.

| Category | Strain | Genus | Species | DMA 2 | DMA 3 | DMA 6 | DMA 12 |
|---|---|---|---|---|---|---|---|
| Anaerobe | SBI4825 | Clostridium | sp. | x | x | | |
| | SBI4833 | Clostridioides | mangenotii | x | | | |
| Lactic Acid Bacteria | SBI4259 | Weisella | cibaria | x | x | | |
| | *SBS04254 | Lactobacillus | brevis | | x | x | x |
| | *SBI04881 | Lactobacillus | buchneri | | | | x |
| | *SBS2335 | Pediococcus | pentosaceus | | | | x |
| | *SBI04916 | Lactococcus | lactis | | | x | x |
| | SBI04913 | Lactobacillus | harbinensis | | | x | |
| Bacteria (Other) | *SBI4877 | Bacillus | velezensis | | | x | |
| Fungi | SBI00303 | Meyerozyma | carribica | | x | | |

*Indicates that the strain has Qualified Presumption of Safety (QPS) status.

Example 20. Key In Vitro Functionalities for the Anti-Inflammatory DMA, DMA 6, are Maintained when One or More Isolates are Replaced with New Isolates of the Same Species DMA 6 has demonstrated anti-inflammatory and pro-longevity effects in preclinical models. These effects are achieved through the combinatorial and synergistic effects of the beneficial functions of the microbes that comprise this DMA. These functionalities include the production of Extracellular polymeric substances (EPS), adherence to mucin, production of short chain fatty acids (SCFAs), and reduction in IL-8 secretion from intestinal epithelial cells in culture. To demonstrate that this is not unique to these isolates, we identified several additional distinct isolates (as determined by 16S rRNA sequence, Table 14) of the same species and examined these functions alone and in DMA swaps, where one to four strains in DMA 6 are replaced with another isolate.

In these experiments the constituents of the DMA, DMA6 (SBS4254, SBI4913, SBI4916 and SBI4877) and new replacement isolates (SBI4872, SBI4879, SBI5411, SBI4929, SBI5536, SBI2863 and SBI2328) from the library were tested for relevant phenotypes. Extracellular polymeric substance production (EPS) was determined using Congo Red and Aniline Blue dye-containing media. EPS production, indicated by color change, was assessed after plating and 48 hrs incubation at 30° C. Mucin attachment was determined by adherence to a porcine mucin (Sigma)-coated 96-well black plate. Each strain was fluorescently labeled with BacLight Green (Invitrogen) and incubated with the mucin plate for 30 min at room temperature. Fluorescence was measured before and after vigorous washing of the plate to remove any unattached bacteria. Data were expressed as percent fluorescence before and after washing. Short chain fatty acid production and epithelial cell stimulation was measured from each isolate alone, and as assembled DMAs. For DMA 6 and the swaps with new isolates, all strains were grown in TSB at 30° C. and each of the strains was normalized using OD600 prior to inoculation. For each substitution, one, two, three or four microbes from DMA 6 was replaced with a new isolate of the same species (See Table 14). To quantify acetate production, single strains and DMAs were inoculated into brain heart infusion (BHI) medium and incubated anaerobically for 48 hrs at 37° C. At 24 hrs cultures were pelleted by centrifugation at 5000×g for 10 min and supernatants were harvested. Final microbial titers were determined by dilution plating. Samples were acidified and a valeric acid internal control was added. Short chain fatty acids (SCFAs) quantified by gas chromatography (GC-2014, Shimadzu, Kyoto, Japan) relative to a free fatty acid control (Restek). To examine intestinal epithelial cell cytokine responses to the individual strains alone and as DMAs, HT-29 cells were seeded into 48-well plates at 100,000 cells per well and cultured for 10 days to ensure confluence. DMAs were added at a multiplicity of interaction (MOI) of 1 and co-incubated at 37° C., 5% $CO_2$ for 24 hours, at which point supernatants were removed and IL-8 production was determined by ELISA (LS Bio).

Extracellular polymeric substances (EPS) produced by bacteria have been reported to have many anti-inflammatory properties (Reviewed in Oerlemans et al 2021). We compared the production of EPS of the isolates comprising DMA 6 with the new isolates (Table 15). All EPS phenotypes were consistent within a given species with the exception of SBI4879, which did produce EPS though it was not secreted into the media like the other L. brevis isolates.

Adherence to mucin is a characteristic examined for probiotic microbes (Ringot-Destrez et al 2018). Mucin attachment is believed to facilitate host-microbe interactions, slow intestinal transit, and exclude pathogens. Mucin adherence was consistent within each given species; with L. brevis exhibiting high mucoadherence, L. lactis demonstrating moderate adherence and L. harbinensis and B. velezensis with low adherence.

Figure 33A:
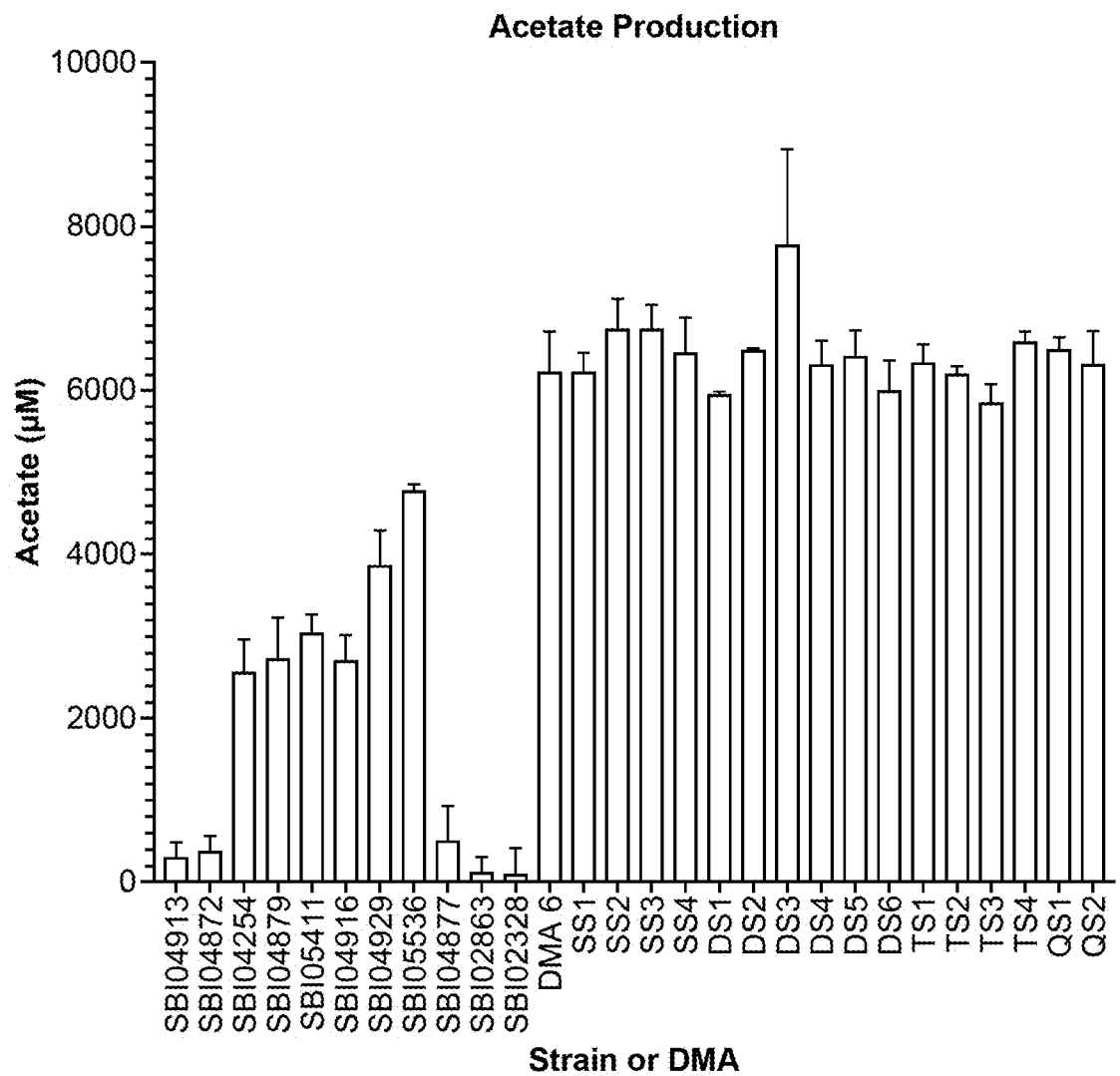
FIG. 33A-C are graphs depicting in vitro functionalities with DMAs with strains swapped as indicated. DMA labels correspond to compositions described in Table 12.

Acetate production from DMA 6, the DMA swaps, and individual strains was measured by gas chromatography (FIG. 33A). Acetate production was similarly low for the L. harbinensis and B. velezensis isolates, and higher in the L. brevis and L. lactis strains. DMA 6 produces more acetate than its individual isolates, demonstrating the additive effects of the combination. All of the DMA swaps produced acetate at levels similar to DMA 6.

Figure 33B:
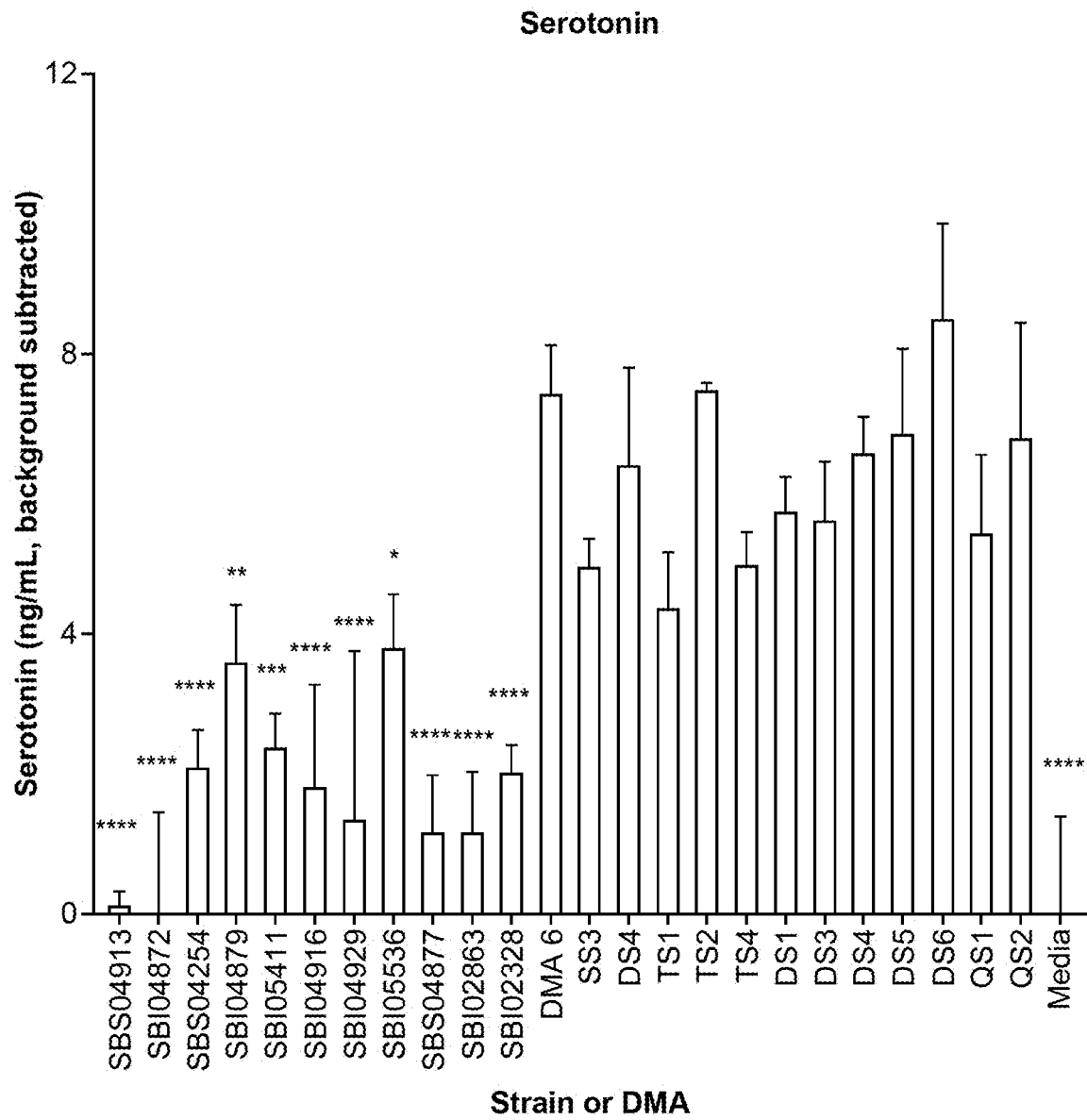

Serotonin is a neurotransmitter that has effects on mood, intestinal motility, and inflammation. The bulk of serotonin in the body is produced in the intestine both by enterocytes and by the microbes in the gut. DMA 6 microbes produce serotonin in liquid culture, and an additive effect of serotonin production is seen for DMA 6 compared to its individual components. Thus, serotonin production from DMA 6, the DMA swaps, and individual strains was measured by competitive ELISA (FIG. 33B). Both L. harbinensis isolates produced little to no serotonin, while the other individual isolates produced variable quantities, all significantly less than DMA 6. Eleven of the sixteen swaps tested produced serotonin at levels similar to DMA 6.

Figure 33C:
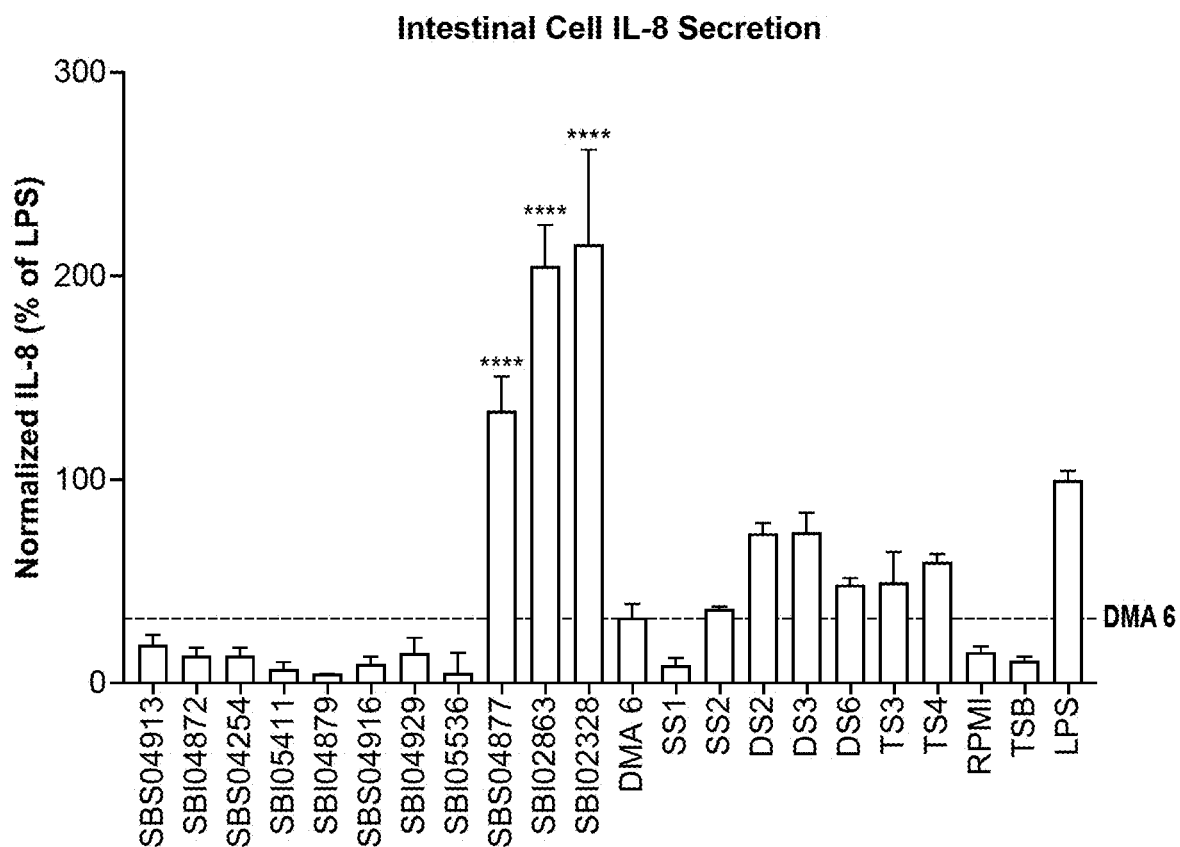

The intestine recruits immune cells to drive inflammatory and anti-inflammatory processes via secretion of various chemokines, including IL-8. The probiotic microbe, B. velezensis, a component of DMA 6, is an immunostimulatory microbe that elicits high IL-8 secretion from epithelial cells in vitro (FIG. 33C). The low levels of IL-8 induced by DMA 6 in was a key driver in the selection of this DMA for preclinical experimentation as it suggested that the other microbes present in the DMA had a profound capacity to modulate inflammation. We tested IL-8 secretion from the DMA swaps to determine whether the same synergy could be recapitulated. While not every one of the 16 DMA swaps tested exhibited reduced IL-8, seven compositions were comparable the phenotype elicited by DMA 6 (FIG. 33C).

These successful single, double, and triple isolate swaps included each of the new replacement isolates, which suggests that each strain is suitable to generate the desired phenotype, but there is some specificity in the combinations.

TABLE 14

Isolates used in the DMA 6 strain swap analysis.

| Strain # | Genus | Species | % ID (16S) | DMA 6 | SS1 | SS2 | SS3 | SS4 | DS1 | DS2 |
|---|---|---|---|---|---|---|---|---|---|---|
| SBI04913 | Lactobacillus | harbinensis | | X | | X | X | X | | X |
| SBI04872 | Lactobacillus | harbinensis | 99.89 | | X | | | | X | |

TABLE 14-continued

| Strain # | Genus | Species | %ID | | | | | | | | |
|---|---|---|---|---|---|---|---|---|---|---|---|
| SBS04254 | Lactobacillus | brevis | | X | X | | X | X | | | |
| SBI04879 | Lactobacillus | brevis | 99.89 | | | | | | X | | |
| SBI05411 | Lactobacillus | brevis | 97.33 | | | X | | | | X | |
| SBI04916 | Lactococcus | lactis | | X | X | X | | X | X | | |
| SBI04929 | Lactococcus | lactis | 99.24 | | | | | | | X | |
| SBI05536 | Lactococcus | lactis | 98.81 | | | | X | | | | |
| SBI04877 | Bacillus | velezensis | | X | X | X | X | | X | | |
| SBI02863 | Bacillus | velezensis | 99.56 | | | | | | | X | |
| SBI02328 | Bacillus | velezensis | 99.71 | | | | | X | | | |

Isolates used in the DMA 6 strain swap analysis.

| Strain # | DS3 | DS4 | DS5 | DS6 | TS1 | TS2 | TS3 | TS4 | QS1 | QS2 |
|---|---|---|---|---|---|---|---|---|---|---|
| SBI04913 | X | | X | | X | | | | | |
| SBI04872 | | X | | X | | X | X | X | X | X |
| SBS04254 | X | | | X | | X | | | | |
| SBI04879 | | | X | | X | | | X | | X |
| SBI05411 | | X | | | | | X | | X | |
| SBI04916 | | X | X | | | | X | | | |
| SBI04929 | | | | X | X | | | | | X |
| SBI05536 | X | | | | | X | | X | X | |
| SBI04877 | | X | | X | | X | | X | | |
| SBI02863 | | X | | X | | | | | X | |
| SBI02328 | X | | | | | | X | | | X |

The strain identification number, genus, species, and 16S percent ID to the original isolate used in DMA 6 is listed to the left. The composition of DMA 6 and each swap is indicated with an "x" for each isolate present (SS = single swap, DS = double swap, TS = triple swap, QS = quadruple swap).

TABLE 15

Extracellular polymeric substance (EPS) production and adherence to mucin are similar between isolates of the same species.

| Strain # | Genus | Species | % ID (16S) | Congo Red Colony | Congo Red Secretion | Aniline Blue | Mucin % Attachment |
|---|---|---|---|---|---|---|---|
| SBI04913 | Lactobacillus | harbinensis | | 2 | 0 | 2 | 2% |
| SBI04872 | Lactobacillus | harbinensis | 99.89 | 2 | 0 | 2 | 4% |
| SBS04254 | Lactobacillus | brevis | | 2 | 2 | 2 | 31% |
| SBI04879 | Lactobacillus | brevis | 99.89 | 2 | 0 | 1 | 26% |
| SBI05411 | Lactobacillus | brevis | 97.33 | 2 | 2 | 2 | 18% |
| SBI04916 | Lactococcus | lactis | | 2 | 2 | 2 | 13% |
| SBI04929 | Lactococcus | lactis | 99.24 | 2 | 2 | 2 | 7% |
| SBI05536 | Lactococcus | lactis | 98.81 | 2 | 2 | 2 | 14% |
| SBI04877 | Bacillus | velezensis | | 1 | 0 | 1 | 4% |
| SBI02863 | Bacillus | velezensis | 99.56 | 1 | 0 | 1 | 4% |
| SBI02328 | Bacillus | velezensis | 99.71 | 1 | 0 | 1 | 2% |

0 = No EPS production, 1 = Intermediate EPS production, 2 = EPS produced, ND = No growth on EPS indicating media. Percent adherence to Mucin.

The strain identification number, genus, species, and 16S percent ID to the original isolate used in DMA 6 is listed to the left. EPS production as determined by plating on Congo red medium, both capsular (colony) and secreted (secretion), and aniline blue medium is scored 0-2 as indicated. Adherence is determined by the percent of microbes remaining attached to mucin after 30 minutes incubation and vigorous washing.

Example 21: DMA Administration Increases Longevity in C. Elegans

Figure 34:
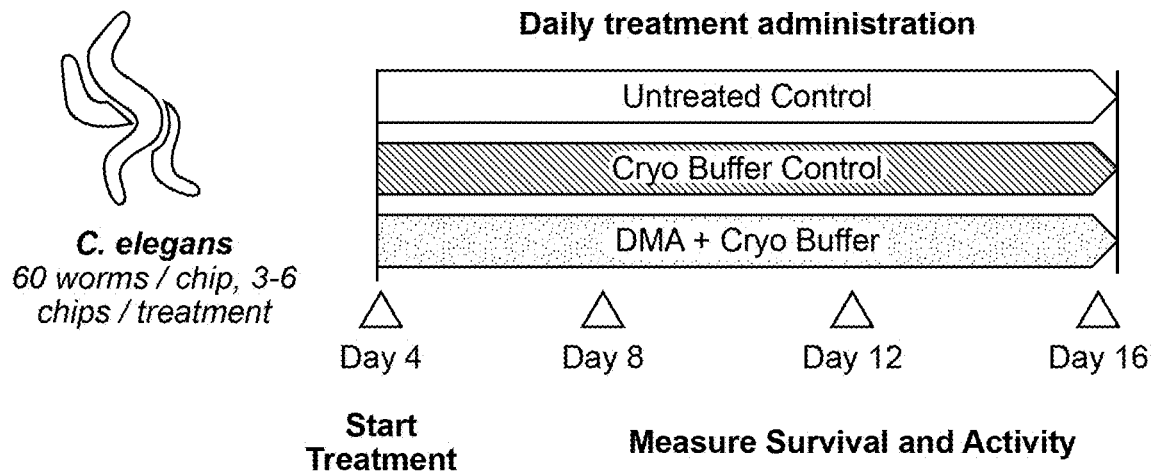
FIG. 34 is a diagram depicting the study design used to examine DMAs for the ability to improve longevity in C. elegans using micropillar-based microfluidic culture devices.

Exemplary defined microbial assemblages (DMAs) were examined for the ability to improve longevity in C. elegans using micropillar-based microfluidic culture devices (NemaLife chips) (Rahman, M., et al., Sci Rep 10, 16190 (2020). The impact of daily administration of each consortium on animal survival and activity levels was examined on days 4, 8, 12, and 16 of animal life (FIG. 34). These time points represent the first day of adulthood, early-, mid-, and late-life periods in the wild-type worm's lifespan.

Longevity studies were performed as follows. All procedures were performed at 20° C. C. elegans were raised on standard agar plates seeded with live E. coli OP50 from hatching until the L4 stage. At the L4 stage, the worms were loaded into NemaLife chips at a density of ~60 animals per chip (N=3-6 chips per experimental group). The worms were then switched to a diet of 25 mg/ml live OP50 resuspended in liquid nematode growth media (NGM). The animals in each chip were imaged to record the population size and baseline activity levels after 24 hrs. Chips were then washed with NGM buffer for 90 seconds to remove waste products and any progeny laid in the previous 24 hours. After washing the chips, the media was exchanged with media for the appropriate experimental condition. Experimental conditions included DMAs listed in Table 16 at a concentration of $5 \times 10^9$ CFU/mL, suspended in a cryo-buffer. A no-treatment negative control was performed using E. coli OP50 as the food source (25 mg/mL OP50). A vehicle control was also performed by administering cryo-buffer diluted with liquid NGM (1:10) to worms fed E. coli OP50 as the food source. The media on all chips were exchanged every 24 hours to remove waste and any progeny. On days 8, 12, and 16 of animal life, videos were recorded of the animals remaining on chip to quantify their survival rate and locomotor activity levels.

Briefly, behavioral videos of worms in microfluidic chips were processed using proprietary software developed by NemaLife Inc (www.nemalifeinc.com). The worms in each video were detected using a convolutional neural network that defines a bounding box enclosing each animal in three frames, each separated by a 30-second interval. If the detected worms in the video have a pixel displacement of more than 10 pixels during the 30 seconds, then the animal was scored as alive. After the software scoring, a manual data curation step is implemented that allows the correction of errors in scoring. Events such as matricide/unnatural death are censored during the human-in-the-loop data curation step.

Locomotory activity 'a' of the worms was determined by NemaLife's proprietary software. The software applies a bounding box to each detected animal, and the pixel intensity correlation is calculated between 30-second separated frames. If the normalized pixel intensity correlation between the two bounding boxes is unity, then $a=0$, indicating that the pixel intensities associated with the detected worm objects are fully correlated, and the animal is stationary in this time interval. Alternatively, if there is no correlation, then $a=1$, indicating that the animal has moved out of its bounding box. Using this approach, three activity scores were obtained per animal from a single video. These activity scores were then grouped by condition and replicate to visualize differences between experimental cohorts.

Figure 35A:
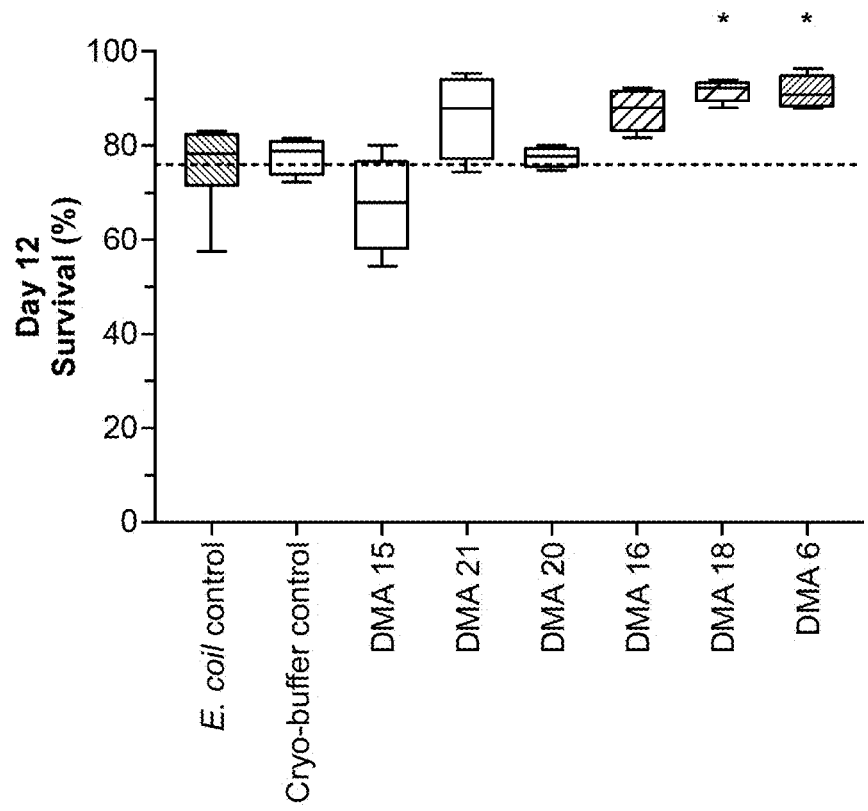
FIG. 35A is a graph depicting the percent survival at day 12 of C. elegans provided with growth medium supplemented with control E. coli, with the indicated DMAs, or with cryo-buffer alone. *p<0.05, one-way ANOVA with multiple hypothesis testing correction.
Figure 35B:
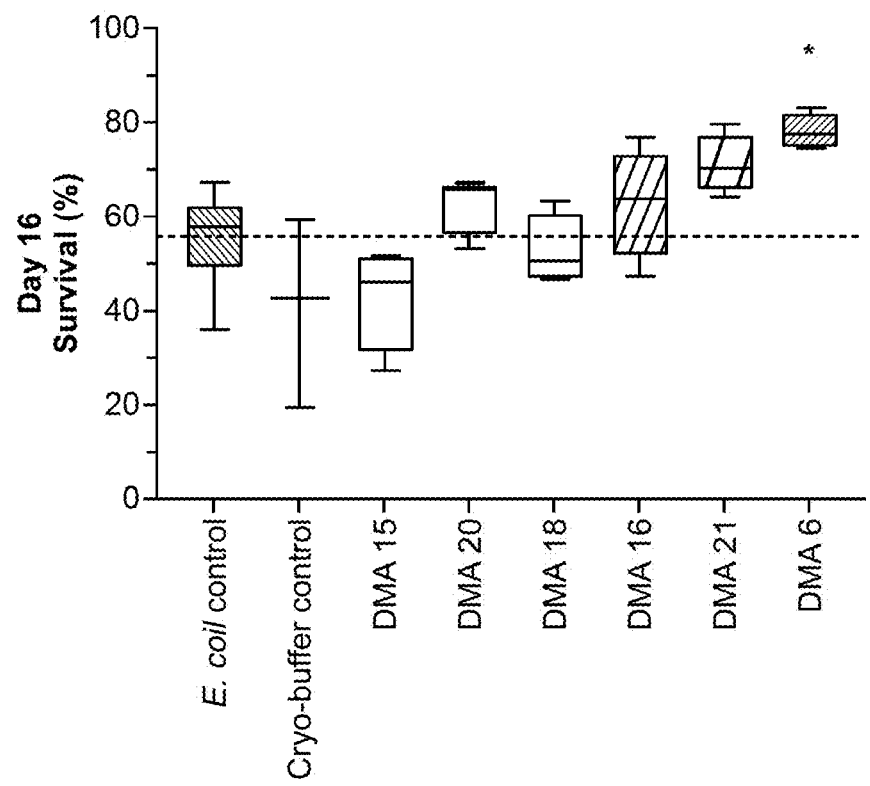
FIG. 35B is a graph depicting the percent survival at day 16 of C. elegans provided with growth medium supplemented with control E. coli, with the indicated DMAs, or with cryo-buffer alone. *p<0.05, one-way ANOVA with multiple hypothesis testing correction.
Figure 36:
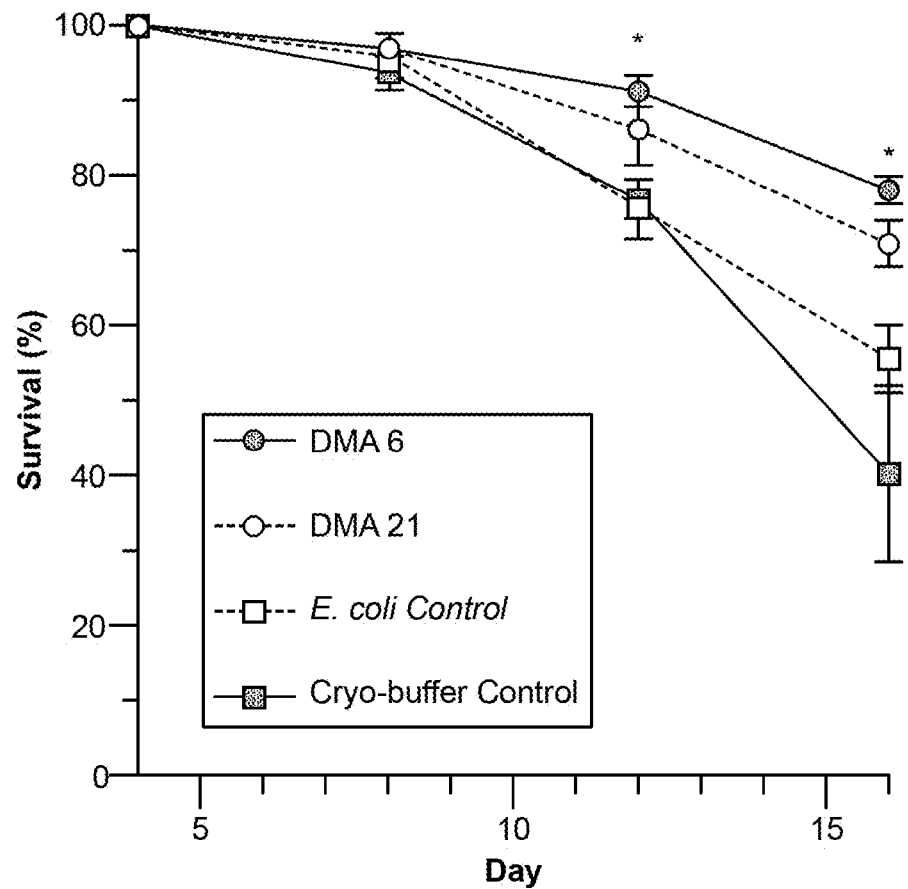
FIG. 36 is a graph depicting the percent survival of C. elegans at the indicated number of days provided with growth medium supplemented with control E. coli, with the indicated DMAs, or with cryo-buffer alone. *p<0.05, one-way ANOVA with multiple hypothesis testing correction.
Figure 37:
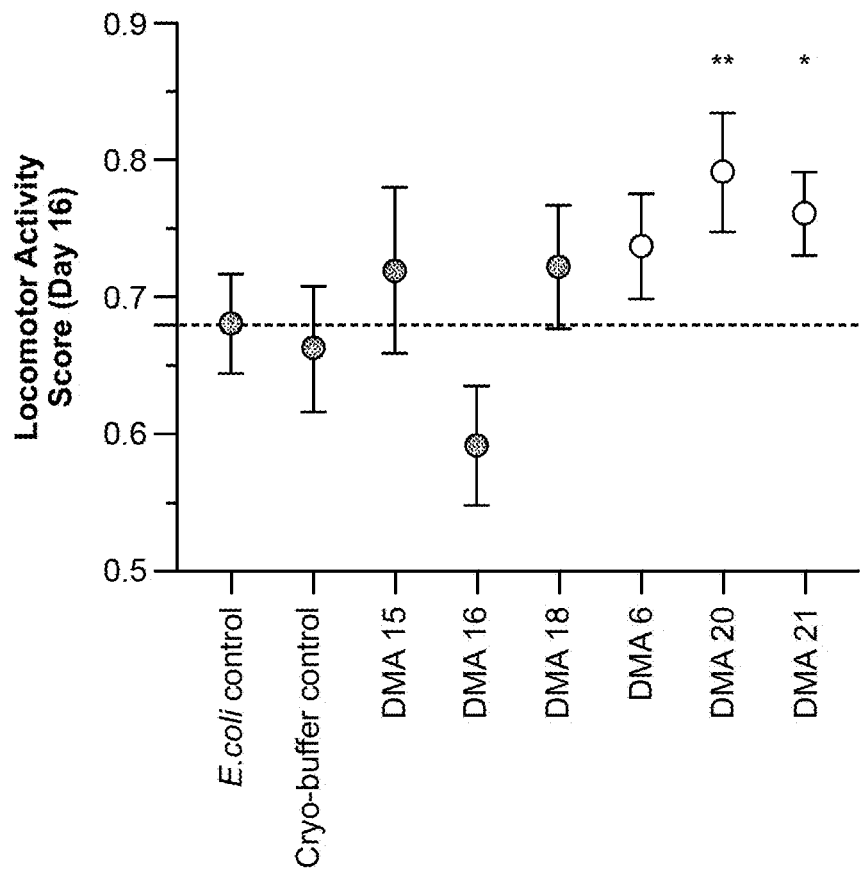
FIG. 37 is a graph depicting the locomotory activity scores at day 16 of C. elegans provided with growth medium supplemented with control E. coli, with the indicated DMAs, or with cryo-buffer alone. *p<0.05, **p<0.01 one-way ANOVA with multiple hypothesis testing correction.

Daily DMA administration increased survival for *C. elegans* at days 12 and 16 of life. This effect was statistically significant on day 12 for DMA 6 and DMA 18 (FIG. 35A) and on day 16 for DMA 6 (FIG. 35B; $p<0.05$, one-way ANOVA with multiple hypothesis testing correction). *C. elegans* survival from day 4 through day 16 are displayed for exemplary DMAs, DMA 6 and DMA 21 compared to control in FIG. 36. Locomotor activity was also increased on day 16 by daily DMA administration. This effect was statistically significant for DMA 20 and DMA 21 (FIG. 37; $p<0.05$, one-way ANOVA with multiple hypothesis testing correction).

These results confirm that the DMAs are capable of increasing survival and locomotor activity in *C. elegans*.

REFERENCES CITED

Aghaloo, T. L., Kang, B., Sung, E. C., Shoff, M., Ronconi, M., Gotcher, J. E., Bezouglaia, O., Dry, S. M., & Tetradis, S. (2011). Periodontal disease and bisphosphonates induce osteonecrosis of the jaws in the rat. *Journal of bone and mineral research: the official journal of the American Society for Bone and Mineral Research*, 26(8), 1871-1882. https://doi.org/10.1002/jbmr.379

Agus, A., Planchais, J., & Sokol, H. (2018). Gut Microbiota Regulation of Tryptophan Metabolism in Health and Disease. *Cell host & microbe*, 23(6), 716-724. https://doi.org/10.1016/j.chom.2018.05.003

Adluri, R. K., Singh, A. V., Skoyles, J., Robins, A., Parton, 1, Baker, M., & Mitchell, I. M. (2010). The effect of fenoldopam and dopexamine on cytokine and endotoxin release following on-pump coronary artery bypass grafting: a prospective randomized double-blind trial. *The heart surgery forum*, 13(6), E353-E361. https://doi.org/10.1532/HSF98.20101073

Altschul, S. F., Gish, W., Miller, W., Myers, E. W., & Lipman, D. J. (1990). Basic local alignment search tool. *Journal of molecular biology*, 215(3), 403-410. https://doi.org/10.1016/S 0022-2836(05)80360-2

An, J., Seok, H., & Ha, E. M. (2021). GABA-producing *Lactobacillus plantarum* inhibits metastatic properties and induces apoptosis of 5-FU-resistant colorectal cancer cells via GABAB receptor signaling. *Journal of microbiology (Seoul, Korea)*, 59(2), 202-216. https://doi.org/10.1007/s12275-021-0562-5

Apweiler, R., Bairoch, A., Wu, C. H., Barker, W. C., Boeckmann, B., Ferro, S., Gasteiger, E., Huang, H., Lopez, R., Magrane, M., Martin, M. J., Natale, D. A., O'Donovan, C., Redaschi, N., & Yeh, L. S. (2004). UniProt: the Universal Protein knowledgebase. *Nucleic acids research*, 32(Database issue), D115-D119. https://doi.org/10.1093/nar/gkh131

Bagga, D., Wang, L., Farias-Eisner, R., Glaspy, J. A., & Reddy, S. T. (2003). Differential effects of prostaglandin derived from omega-6 and omega-3 polyunsaturated fatty acids on COX-2 expression and IL-6 secretion. *Proceedings of the National Academy of Sciences of the United States of America*, 100(4), 1751-1756. https://doi.org/10.1073/pnas.0334211100

Bansal, T., Alaniz, R. C., Wood, T. K., & Jayaraman, A. (2010). The bacterial signal indole increases epithelial-cell tight junction resistance and attenuates indicators of inflammation. *Proceedings of the National Academy of Sciences of the United States of America*, 107(1), 228-233. https://doi.org/10.1073/pnas.0906112107

TABLE 16

Exemplary DMAs tested in a *C. elegans* longevity model.

| Category | Strain | Genus | Species | DMA 6 | DMA 15 | DMA 16 | DMA 18 | DMA 20 | DMA 21 |
|---|---|---|---|---|---|---|---|---|---|
| Lactic Acid Bacteria | SBI04913 | *Lactobacillus* | *harbinensis* | x | | | | | |
| | *SBS04254 | *Lactobacillus* | *brevis* | x | x | x | x | x | x |
| | *SBI04916 | *Lactococcus* | *lactis* | x | x | x | x | x | x |
| Bacteria (Other) | *SBI4877 | *Bacillus* | *velezensis* | x | | | | | |
| Fungi | SBI00817 | *Pichia* | *membranifaciens* | | | x | | | |
| | *SBI00540 | *Hanseniaspora* | *uvarum* | | | | x | | |
| | SBI04927 | *Yarrowia* | *lipolytica* | | | | | | |
| | SBI00274 | *Leucosporidium* | *scottii* | | | | | x | |
| | SBI00272 | *Hanseniaspora* | *occidentalis* | | | | | | x |

*Indicates that the strain has Qualified Presumption of Safety (QPS) status.

While the invention has been particularly shown and described with reference to a preferred embodiment and various alternate embodiments, it will be understood by persons skilled in the relevant art that various changes in form and details can be made therein without departing from the spirit and scope of the invention.

All references, issued patents and patent applications cited within the body of the instant specification are hereby incorporated by reference in their entirety, for all purposes.

Caffaratti, C., Plazy, C., Mery, G., Tidjani, A. R., Fiorini, F., Thiroux, S., Toussaint, B., Hannani, D., & Le Gouellec, A. (2021). What We Know So Far about the Metabolite-Mediated Microbiota-Intestinal Immunity Dialogue and How to Hear the Sound of This Crosstalk. *Metabolites,* 11(6), 406. https://doi.org/10.3390/metabo11060406

Cario E. (2008). Barrier-protective function of intestinal epithelial Toll-like receptor 2. *Mucosal immunology,* 1 Suppl 1, S62-S66. https://doi.org/10.1038/mi.2008.47

Catrina, A. I., Deane, K. D., & Scher, J. U. (2016). Gene, environment, microbiome and mucosal immune tolerance in rheumatoid arthritis. *Rheumatology (Oxford, England),* 55(3), 391-402. https://doi.org/10.1093/rheumatology/keu469

Chassaing, B., Ley, R. E., & Gewirtz, A. T. (2014). Intestinal epithelial cell toll-like receptor 5 regulates the intestinal microbiota to prevent low-grade inflammation and metabolic syndrome in mice. *Gastroenterology,* 147(6), 1363-77.e17. https://doi.org/10.1053/j.gastro.2014.08.033

Costa, O. Y. A., Raaijmakers, J. M., & Kuramae, E. E. (2018). Microbial extracellular polymeric substances: Ecological function and impact on soil aggregation. *Frontiers in Microbiology,* 9. https://doi.org/10.3389/fmicb.2018.01636

Cox, M. P., Peterson, D. A. & Biggs, P. J. SolexaQA: At-a-glance quality assessment of Illumina second-generation sequencing data. *BMC Bioinformatics* 11, 485 (2010).

Feres, M., Teles, F., Teles, R., Figueiredo, L. C., & Faveri, M. (2016). The subgingival periodontal microbiota of the aging mouth. *Periodontology* 2000, 72(1), 30-53. https://doi.org/10.1111/prd.12136

Fiorucci, S., Biagioli, M., Zampella, A., & Distrutti, E. (2018). Bile Acids Activated Receptors Regulate Innate Immunity. *Frontiers in immunology,* 9, 1853. https://doi.org/10.3389/fimmu.2018.01853

Franzosa, E. A., McIver, L. J., Rahnavard, G., Thompson, L. R., Schirmer, M., Weingart, G., Lipson, K. S., Knight, R., Caporaso, J. G., Segata, N., & Huttenhower, C. (2018). Species-level functional profiling of metagenomes and metatranscriptomes. *Nature methods,* 15(11), 962-968. https://doi.org/10.1038/s41592-018-0176-y Gao, J., Xu, K., Liu, H., Liu, G., Bai, M., Peng, C., Li, T., & Yin, Y. (2018). Impact of the Gut Microbiota on Intestinal Immunity Mediated by Tryptophan Metabolism. *Frontiers in cellular and infection microbiology,* 8, 13. https://doi.org/10.3389/fcimb.2018.00013

Gatej, S. M., Marino, V., Bright, R., Fitzsimmons, T. R., Gully, N., Zilm, P., Gibson, R. J.,
Edwards, S., & Bartold, P. M. (2018). Probiotic *Lactobacillus rhamnosus* GG prevents alveolar bone loss in a mouse model of experimental periodontitis. *Journal of clinical periodontology,* 45(2), 204-212. https://doi.org/10.1111/jcpe.12838

Gni, S. S., Sen, S. S., Jun, J. W., Sukumaran, V., & Park, S. C. (2017). Role of *Bacillus licheniformis* VS16-Derived Biosurfactant in Mediating Immune Responses in Carp Rohu and its Application to the Food Industry. *Frontiers in microbiology,* 8, 514. https://doi.org/10.3389/fmicb.2017.00514

Glowacki, A. J., Yoshizawa, S., Jhunjhunwala, S., Vieira, A. E., Garlet, G. P., Sfeir, C., & Little, S. R. (2013). Prevention of inflammation-mediated bone loss in murine and canine periodontal disease via recruitment of regulatory lymphocytes. *Proceedings of the National Academy of Sciences of the United States of America,* 110(46), 18525-18530. https://doi.org/10.1073/pnas.1302829110

Grootaert, C., Boon, N., Zeka, F., Vanhoecke, B., Bracke, M., Verstraete, W., & Van de Wiele, T. (2011). Adherence and viability of intestinal bacteria to differentiated Caco-2 cells quantified by flow cytometry. *Journal of microbiological methods,* 86(1), 33-41. https://doi.org/10.1016/j.mimet.2011.03.011

Han, S., Lu, Y., Xie, J., Fei, Y., Zheng, G., Wang, Z., Liu, J., Lv, L., Ling, Z., Berglund, B., Yao, M., & Li, L. (2021). Probiotic Gastrointestinal Transit and Colonization After Oral Administration: A Long Journey. *Frontiers in cellular and infection microbiology,* 11, 609722. https://doi.org/10.3389/fcimb.2021.609722

Heinken, A., Ravcheev, D. A., Baldini, F., Heirendt, L., Fleming, R. M. T., & Thiele, I. (2019). Systematic assessment of secondary bile acid metabolism in gut microbes reveals distinct metabolic capabilities in inflammatory bowel disease. Microbiome, 7(1). https://doi.org/10.1186/s40168-019-0689-3

Higgins, S. C., Lavelle, E. C., McCann, C., Keogh, B., McNeela, E., Byrne, P., O'Gorman, B., Jarnicki, A., McGuirk, P., & Mills, K. H. (2003). Toll-like receptor 4-mediated innate IL-10 activates antigen-specific regulatory T cells and confers resistance to *Bordetella pertussis* by inhibiting inflammatory pathology. *Journal of immunology* (Baltimore, Md.: 1950), 171(6), 3119-3127. https://doi.org/10.4049/jimmunol.171.6.3119

Holers, V. M., Demoruelle, M. K., Kuhn, K. A., Buckner, J. H., Robinson, W. H., Okamoto, Y., Norris, J. M., & Deane, K. D. (2018). Rheumatoid arthritis and the mucosal origins hypothesis: protection turns to destruction. *Nature reviews. Rheumatology,* 14(9), 542-557. https://doi.org/10.1038/s41584-018-0070-0

Hsieh, S. A., & Allen, P. M. (2020). Immunomodulatory Roles of Polysaccharide Capsules in the Intestine. *Frontiers in immunology,* 11, 690. https://doi.org/10.3389/fimmu.2020.00690

Jang, S., Uematsu, S., Akira, S., & Salgame, P. (2004). IL-6 and IL-10 induction from dendritic cells in response to *Mycobacterium tuberculosis* is predominantly dependent on TLR2-mediated recognition. Journal of immunology (Baltimore, Md.: 1950), 173(5), 3392-3397. https://doi.org/10.4049/jimmunol.173.5.3392

Jenab, A., Roghanian, R., & Emtiazi, G. (2020). Bacterial Natural Compounds with Anti-Inflammatory and Immunomodulatory Properties (Mini Review). *Drug design, development and therapy,* 14, 3787-3801. https://doi.org/10.2147/DDDT.S261283

Jhun, J., Min, H. K., Ryu, J., Lee, S. Y., Ryu, J. G., Choi, J. W., Na, H. S., Lee, S. Y., Jung, Y., Park, S. J., Park, M. S., Kwon, B., Ji, G. E., Cho, M. L., & Park, S. H. (2020). *Lactobacillus* sakei suppresses collagen-induced arthritis and modulates the differentiation of T helper 17 cells and regulatory B cells. *Journal of translational medicine,* 18(1), 317. https://doi.org/10.1186/s12967-020-02477-8

Jin, H., Jeong, Y., Yoo, S H. et al. Isolation and characterization of high exopolysaccharide-producing Weissella confusa VP30 from young children's feces. Microb Cell Fact 18, 110 (2019). https://doi.org/10.1186/s12934-019-1158-1

Jin, X. T., Galvan, A., Wichmann. T., & Smith, Y. (2011). Localization and Function of GABA Transporters GAT-1 and GAT-3 in the Basal Ganglia. *Frontiers in systems neuroscience,* 5, 63. https://doi.org/10.3389/fnsys.2011.00063

Kang, J. X., & Weylandt, K. H. (2008). Modulation of inflammatory cytokines by omega-3 fatty acids. *Sub-*

*cellular biochemistry,* 49, 133-143. https://doi.org/10.1007/978-1-4020-8831-5_5

Kinane, D. F., Stathopoulou, P. G., & Papapanou, P. N. (2017). Periodontal diseases. Nature reviews. *Disease primers,* 3, 17038. https://doi.org/10.1038/nrdp.2017.38

Kobayashi, R., Kobayashi, T., Sakai, F., Hosoya, T., Yamamoto, M., & Kurita-Ochiai, T. (2017). Oral administration of *Lactobacillus* gasseri SBT2055 is effective in preventing *Porphyromonas gingivalis*-accelerated periodontal disease. *Scientific reports,* 7(1), 545. https://doi.org/10.1038/s41598-017-00623-9

Kolmogorov Mikhail, Yuan Jeffrey, Lin Yu and Pevzner Pavel, Assembly of Long Error-Prone Reads Using Repeat Graphs. Nature Biotechnology, 2019

Langmead, B., & Salzberg, S. L. (2012). Fast gapped-read alignment with Bowtie 2. *Nature methods,* 9(4), 357-359. https://doi.org/10.1038/nmeth.1923

Lebeer S, Claes I, Tytgat H L, Verhoeven T L, Marien E, von Ossowski I, Reunanen J, Palva A, Vos W M, Keersmaecker S C, Vanderleyden J. Functional analysis of *Lactobacillus rhamnosus* GG pili in relation to adhesion and immunomodulatory interactions with intestinal epithelial cells. Appl Environ Microbiol. 2012 January; 78(1):185-93. doi: 10.1128/AEM.06192-11. Epub 2011 Oct. 21. PMID: 22020518; PMCID: PMC3255643.

Li, J. Y., Chassaing, B., Tyagi, A. M., Vaccaro, C., Luo, T., Adams, J., Darby, T. M., Weitzmann, M. N., Mulle, J. G., Gewirtz, A, T., Jones, R M., & Pacifici, R. (2016), Sex steroid deficiency-associated bone loss is microbiota dependent and prevented by probiotics. *The Journal of clinical investigation,* 126(6), 2049-2063. https://doi.org/10.1172/JCI86062

B., Faller, L. L., Klitgord, N., Mazumdar, V., Ghodsi., M., Sommer, D. D., Gibbons, T. R., Treangen, T. J., Chang, Y. C., Li, S., Stine, 0. C., Hasturk, H., Kasif, S., Segre, D., Pop, M., & Amar, S. (2012). Deep sequencing of the oral microbiome reveals signatures of periodontal disease. *PloS one,* 7(6), e37919. https://doi.org/10.1371/journal.pone.0037919

Macfarlane, S., & Macfarlane, G. T. (2003). Regulation of short-chain fatty acid production. *The Proceedings of the Nutrition Society,* 62(1), 67-72. https://doi.org/10.1079/PNS2002207

Maeda, Y., Kurakawa, T., Umemoto, E., Motooka, D., Ito, Y., Gotoh, K., Hirota, K., Matsushita, M., Furuta, Y., Narazaki, M., Sakaguchi, N., Kayama, H., Nakamura, S., Iida, T., Saeki, Y., Kumanogoh, A., Sakaguchi, S., & Takeda, K. (2016). Dysbiosis Contributes to Arthritis Development via Activation of Autoreactive T Cells in the Intestine. *Arthritis & rheumatology* (Hoboken, Ni), 68(11), 2646-2661. https://doi.org/10.1002/art.39783

Marietta, E. V., Murray, J. A., Luckey, D. H., Jeraldo, P. R., Lamba, A., Patel, R., Luthra, H. S., Mangalam, A., & Taneja, V. (2016). Suppression of Inflammatory Arthritis by Human Gut-Derived *Prevotella histicola* in Humanized Mice. *Arthritis & rheumatology* (Hoboken, Ni), 68(12), 2878-2888. https://doi.org/10.1002/art.39785

Marinelli, L., Martin-Gallausiaux, C., Bourhis, J M. et al. Identification of the novel role of butyrate as AhR ligand in human intestinal epithelial cells. Sci Rep 9, 643 (2019). https://doi.org/10.1038/s41598-018-37019-2

Monteagudo-Mera A, Rastall R A, Gibson G R, Charalampopoulos D, Chatzifragkou A. Adhesion mechanisms mediated by probiotics and prebiotics and their potential impact on human health. Appl Microbiol Biotechnol. 2019 August; 103(16):6463-6472. doi: 10.1007/s00253-019-09978-7. Epub 2019 Jul. 2. PMID: 31267231; PMCID: PMC6667406.

Morikawa, M., Hirata, Y., & Imanaka, T. (2000). A study on the structure-function relationship of lipopeptide biosurfactants. *Biochimica et biophysica acta,* 1488(3), 211-218. https://doi.org/10.1016/s1388-1981(00)00124-4

Mulligan, C. (1984). The use of biological compounds to enhance the de-watering of peat. Department of Chemical Engineering. McGill University.

Nguyen, B. N., Chavez-Arroyo, A., Cheng, M. I., Krasilnikov, M., Louie, A., & Portnoy, D. A. (2020). TLR2 and endosomal TLR-mediated secretion of IL-10 and immune suppression in response to phagosome-confined *Listeria monocytogenes*. *PLoS pathogens,* 16(7), e1008622. https://doi.org/10.1371/journal.ppat.1008622

Ni, Z., Min, Y., Han, C. et al. TGR5-HNF4α axis contributes to bile acid-induced gastric intestinal metaplasia markers expression. *Cell Death Discov.* 6, 56 (2020). https://doi.org/10.1038/s41420-020-0290-3

Parks, D. H., Imelfort, M., Skennerton, C. T., Hugenholtz, P. & Tyson, G. W. CheckM: assessing the quality of microbial genomes recovered from isolates, single cells, and metagenomes. *Genome Res* 25, 1043-1055 (2015).

Paynich, M. L., Jones-Burrage, S. E., & Knight, K. L. (2017). Exopolysaccharide from *Bacillus subtilis* Induces Anti-Inflammatory M2 Macrophages That Prevent T Cell-Mediated Disease. *Journal of immunology* (Baltimore, Md.: 1950), 198(7), 2689-2698. https://doi.org/10.4049/jimmunol.1601641

Peng, Y., Leung, H. C. M., Yiu, S. M. & Chin, F. Y. L. IDBA-UD: a de novo assembler for single-cell and metagenomic sequencing data with highly uneven depth. *Bioinformatics* 28, 1420-1428 (2012).

Pérez-Chaparro, P. J., Gonçalves, C., Figueiredo, L. C., Faveri, M., Lobão, E., Tamashiro, N., Duarte, P., & Feres, M. (2014). Newly identified pathogens associated with periodontitis: a systematic review. *Journal of dental research,* 93(9), 846-858. https://doi.org/10.1177/0022034514542468

Pinoli, M., Marino, F., & Cosentino, M. (2017). Dopaminergic Regulation of Innate Immunity: a Review. *Journal of neuroimmune pharmacology: the official journal of the Society on NeuroImmune Pharmacology,* 12(4), 602-623. https://doi.org/10.1007/s11481-017-9749-2

Postler, T. S., & Ghosh, S. (2017). Understanding the Holobiont: How Microbial Metabolites Affect Human Health and Shape the Immune System. *Cell metabolism,* 26(1), 110-130. https://doi.org/10.1016/j.cmet.2017.05.008

Rao, S. P., Sancho, J., Campos-Rivera, J., Boutin, P. M., Severy, P. B., Weeden, T., Shankara, S., Roberts, B. L., & Kaplan, J. M. (2012). Human peripheral blood mononuclear cells exhibit heterogeneous CD52 expression levels and show differential sensitivity to alemtuzumab mediated cytolysis. *PloS one,* 7(6), e39416. https://doi.org/10.1371/journal.pone.0039416

Reinhoud, N. J., Brouwer, H. J., van Heerwaarden, L. M., & Korte-Bouws, G. A. (2013). Analysis of glutamate, GABA, noradrenaline, dopamine, serotonin, and metabolites using microbore UHPLC with electrochemical detection. *ACS chemical neuroscience,* 4(5), 888-894. https://doi.org/10.1021/cn400044s Rühmann, B., Schmid, J., & Sieber, V. (2015). Methods to identify the unexplored diversity of microbial exopolysaccharides. *Frontiers in microbiology,* 6, 565. https://doi.org/10.3389/fmicb.2015.00565

Sandrini, S., Aldriwesh, M., Alruways, M., & Freestone, P. (2015). Microbial endocrinology: host-bacteria communication within the gut microbiome. *The Journal of endocrinology*, 225(2), R21-R34. https://doi.org/10.1530/JOE-14-0615

Saraiva, M., & O'Garra, A. (2010). The regulation of IL-10 production by immune cells. *Nature reviews. Immunology*, 10(3), 170-181. https://doi.org/10.1038/nri2711

Segata, N., Waldron, L., Ballarini, A., Narasimhan, V., Jousson, O., & Huttenhower, C. (2012). Metagenomic microbial community profiling using unique clade-specific marker genes. *Nature methods*, 9(8), 811-814. https://doi.org/10.1038/nmeth.2066

Sethi, S., & Samantaray, U. S. (2021). Isolation and biochemical characterization of indole-3-acetic acid (IAA) produced in *pseudomonas* sp. isolated from rhizospheric soil. *International Journal for Research in Applied Sciences and Biotechnology*, 8(4). https://doi.org/10.31033/ijrasb.8.4.1

Scher, J. U., Sczesnak, A., Longman, R. S., Segata, N., Ubeda, C., Bielski, C., Rostron, T., Cerundolo, V., Pamer, E. G., Abramson, S. B., Huttenhower, C., & Littman, D. R. (2013). Expansion of intestinal *Prevotella copri* correlates with enhanced susceptibility to arthritis. *eLife*, 2, e01202. https://doi.org/10.7554/eLife.01202

Scortichini, S., Boarelli, M. C., Silvi, S., & Fiorini, D. (2020). Development and validation of a GC-FID method for the analysis of short chain fatty acids in rat and human faeces and in fermentation fluids. *Journal of chromatography. B, Analytical technologies in the biomedical and life sciences*, 1143, 121972. https://doi.org/10.1016/j.jchromb.2020.121972

Schott, E. M., Farnsworth, C. W., Grier, A., Lillis, J. A., Soniwala, S., Dadourian, G. H., Bell, R. D., Doolittle, M. L., Villani, D. A., Awad, H., Ketz, J. P., Kamal, F., Ackert-Bicknell, C., Ashton, J. M., Gill, S. R., Mooney, R. A., & Zuscik, M. J. (2018). Targeting the gut microbiome to treat the osteoarthritis of obesity. JCI insight, 3(8), e95997. https://doi.org/10.1172/jci.insight.95997

Skelly, A. N., Sato, Y., Kearney, S. et al. Mining the microbiota for microbial and metabolite-based immunotherapies. Nat Rev Immunol 19, 305-323 (2019). https://doi.org/10.1038/s41577-019-0144-5

Thevaranjan, N., Puchta, A., Schulz, C., Naidoo, A., Szamosi, J. C., Verschoor, C. P., Loukov, D., Schenck, L. P., Jury, J., Foley, K. P., Schertzer, J. D., Larché, M. J., Davidson, D. J., Verdú, E. F., Surette, M. G., & Bowdish, D. (2017). Age-Associated Microbial Dysbiosis Promotes Intestinal Permeability, Systemic Inflammation, and Macrophage Dysfunction. Cell host & microbe, 21(4), 455-466.e4. https://doi.org/10.1016/j.chom.2017.03.002

Tyagi, A. M., Yu, M., Darby, T. M., Vaccaro, C., Li, J. Y., Owens, J. A., Hsu, E., Adams, J., Weitzmann, M. N., Jones, R. M., & Pacifici, R. (2018). The Microbial Metabolite Butyrate Stimulates Bone Formation via T Regulatory Cell-Mediated Regulation of WNT10B Expression. *Immunity*, 49(6), 1116-1131.e7. https://doi.org/10.1016/j.immuni.2018.10.013

Vavassori, P., Mencarelli, A., Renga, B., Distrutti, E., & Fiorucci, S. (2009). The bile acid receptor FXR is a modulator of intestinal innate immunity. *Journal of immunology* (Baltimore, Md.: 1950), 183(10), 6251-6261. https://doi.org/10.4049/jimmunol.0803978

Velduyzen van Zanten, S. J., Kolesnikow, T., Leung, V., O'Rourke, J. L., & Lee, A. (2003). Gastric transitional zones, areas where *Helicobacter* treatment fails: results of a treatment trial using the Sydney strain mouse model. *Antimicrobial agents and chemotherapy*, 47(7), 2249-2255. https://doi.org/10.1128/AAC.47.7.2249-2255.2003

Vijayakumar, P. P., & Muriana, P. M. (2015). A Microplate Growth Inhibition Assay for Screening Bacteriocins against *Listeria monocytogenes* to Differentiate Their Mode-of-Action. *Biomolecules*, 5(2), 1178-1194. https://doi.org/10.3390/biom5021178

Villageliú, D., & Lyte, M. (2018). Dopamine production in *Enterococcus faecium*: A microbial endocrinology-based mechanism for the selection of probiotics based on neurochemical-producing potential. *PloS one*, 13(11), e0207038. https://doi.org/10.1371/journal.pone.0207038

Walsham A D, MacKenzie D A, Cook V, Wemyss-Holden S, Hews C L, Juge N, Schüller S. *Lactobacillus reuteri* Inhibition of Enteropathogenic *Escherichia coli* Adherence to Human Intestinal Epithelium. Front Microbiol. 2016 Mar. 1; 7:244. doi: 10.3389/fmicb.2016.00244. PMID: 26973622; PMCID: PMC4771767.

Wan, M., Ding, L., Wang, D., Han, J., & Gao, P. (2020). Serotonin: A Potent Immune Cell Modulator in Autoimmune Diseases. *Frontiers in immunology*, 11, 186. https://doi.org/10.3389/fimmu.2020.00186

Wang, Y. D., Chen, W. D., Moore, D. D., & Huang, W. (2008). FXR: a metabolic regulator and cell protector. *Cell research*, 18(11), 1087-1095. https://doi.org/10.1038/cr.2008.289

Wells, P. M., Adebayo, A. S., Bowyer, R., Freidin, M. B., Finckh, A., Strowig, T., Lesker, T. R., Alpizar-Rodriguez, D., Gilbert, B., Kirkham, B., Cope, A. P., Steves, C. J., & Williams, F. (2020). Associations between gut microbiota and genetic risk for rheumatoid arthritis in the absence of disease: a cross-sectional study. *The Lancet. Rheumatology*, 2(7), e418-e427. https://doi.org/10.1016/S2665-9913(20)30064-3

Wilson, T. M., Trent, B., Kuhn, K. A., & Demoruelle, M. K. (2020). Microbial Influences of Mucosal Immunity in Rheumatoid Arthritis. *Current rheumatology reports*, 22(11), 83. https://doi.org/10.1007/s11926-020-00960-1

Yamashita, M., Matsumoto, K., Endo, T., Ukibe, K., Hosoya, T., Matsubara, Y., Nakagawa, H., Sakai, F., & Miyazaki, T. (2017). Preventive Effect of *Lactobacillus helveticus* SBT2171 on Collagen-Induced Arthritis in Mice. *Frontiers in microbiology*, 8, 1159. https://doi.org/10.3389/fmicb.2017.01159

Yamazaki, M., Matsuoka, T., Yasui, K., Komiyama, A., & Akabane, T. (1989). Dopamine inhibition of superoxide anion production by polymorphonuclear leukocytes. *The Journal of allergy and clinical immunology*, 83(5), 967-972. https://doi.org/10.1016/0091-6749(89)90113-9

Yan, Y., Jiang, W., Liu, L., Wang, X., Ding, C., Tian, Z., & Zhou, R. (2015). Dopamine controls systemic inflammation through inhibition of NLRP3 inflammasome. *Cell*, 160(1-2), 62-73. https://doi.org/10.1016/j.cell.2014.11.047

Yoneno, K., Hisamatsu, T., Shimamura, K., Kamada, N., Ichikawa, R., Kitazume, M. T., Mori, M., Uo, M., Namikawa, Y., Matsuoka, K., Sato, T., Koganei, K., Sugita, A., Kanai, T., & Hibi, T. (2013). TGR5 signalling inhibits the production of pro-inflammatory cytokines by in vitro differentiated inflammatory and intestinal macrophages in Crohn's disease. *Immunology*, 139(1), 19-29. https://doi.org/10.1111/imm.12045

Yu, H., Ding, X., Shang, L., Zeng, X., Liu, H., Li, N., Huang, S., Wang, Y., Wang, G., Cai, S., Chen, M., Levesque, C. L., Johnston, L. J., & Qiao, S. (2018). Protective Ability of Biogenic Antimicrobial Peptide Microcin J25 Against Enterotoxigenic *Escherichia Coli*-Induced Intestinal Epithelial Dysfunction and Inflammatory Responses IPEC-J2 Cells. *Frontiers in cellular and infection microbiology,* 8, 242. https://doi.org/10.3389/fcimb.2018.00242

Zaiss, M. M., Joyce Wu, H. J., Mauro, D., Schett, G., & Ciccia, F. (2021). The gut joint axis in rheumatoid arthritis. *Nature reviews. Rheumatology,* 17(4), 224-237. https://doi.org/10.1038/s41584-021-00585-3

Zhang B, Zuo F, Yu R, Zeng Z, Ma H, Chen S. Comparative genome-based identification of a cell wall-anchored protein from Lactobacillus plantarum increases adhesion of Lactococcus lactis to human epithelial cells. Sci Rep. 2015 Sep. 15; 5:14109. doi: 10.1038/srep14109. PMID: 26370773; PMCID: PMC4572922.

Zhang, X., Zhang, D., Jia, H., Feng, Q., Wang, D., Liang, D., Wu, X., Li, J., Tang, L., Li, Y., Lan, Z., Chen, B., Li, Y., Zhong, H., Xie, H., Jie, Z., Chen, W., Tang, S., Xu, X., Wang, X., . . . Wang, J. (2015). The oral and gut microbiomes are perturbed in rheumatoid arthritis and partly normalized after treatment. *Nature medicine,* 21(8), 895-905. https://doi.org/10.1038/nm.3914

Zhou, B., & Zhang, D. (2017). Antibacterial effects of bacteriocins isolated from Lactobacillus rhamnosus (ATCC 53103) in a rabbit model of knee implant infection. *Experimental and therapeutic medicine,* 15(3), 2985-2989. https://doi.org/10.3892/etm.2018.5790

TABLE 3

List of species identified in each metagenomic sample of each SBP Sample

| SBP ID | SBP Host Common Name | Genus sp. |
|---|---|---|
| SBP00015 | Romaine Lettuce | Acinetobacter sp. TTH0-4 |
| SBP00015 | Romaine Lettuce | Agrobacterium sp. |
| SBP00015 | Romaine Lettuce | Bacillus sp. (in: Bacteria) |
| SBP00015 | Romaine Lettuce | Cutibacterium acnes |
| SBP00015 | Romaine Lettuce | Erwinia tasmaniensis |
| SBP00015 | Romaine Lettuce | Janthinobacterium svalbardensis |
| SBP00015 | Romaine Lettuce | Massilia albidiflava |
| SBP00015 | Romaine Lettuce | Massilia oculi |
| SBP00015 | Romaine Lettuce | Massilia plicata |
| SBP00015 | Romaine Lettuce | Massilia putida |
| SBP00015 | Romaine Lettuce | Massilia sp. NR 4-1 |
| SBP00015 | Romaine Lettuce | Massilia sp. WG5 |
| SBP00015 | Romaine Lettuce | Massilia umbonata |
| SBP00015 | Romaine Lettuce | Massilia violaceinigra |
| SBP00015 | Romaine Lettuce | Pantoea agglomerans |
| SBP00015 | Romaine Lettuce | Paracoccus sp. Arc7-R13 |
| SBP00015 | Romaine Lettuce | Pseudomonas azotoformans |
| SBP00015 | Romaine Lettuce | Pseudomonas chlororaphis |
| SBP00015 | Romaine Lettuce | Pseudomonas fluorescens |
| SBP00015 | Romaine Lettuce | Pseudomonas frederiksbergensis |
| SBP00015 | Romaine Lettuce | Pseudomonas granadensis |
| SBP00015 | Romaine Lettuce | Pseudomonas koreensis |
| SBP00015 | Romaine Lettuce | Pseudomonas lurida |
| SBP00015 | Romaine Lettuce | Pseudomonas psychrophila |
| SBP00015 | Romaine Lettuce | Pseudomonas putida |
| SBP00015 | Romaine Lettuce | Pseudomonas reinekei |
| SBP00015 | Romaine Lettuce | Pseudomonas rhizosphaerae |
| SBP00015 | Romaine Lettuce | Pseudomonas silesiensis |
| SBP00015 | Romaine Lettuce | Pseudomonas sp. |
| SBP00015 | Romaine Lettuce | Pseudomonas sp. 02C 26 |
| SBP00015 | Romaine Lettuce | Pseudomonas sp. B10 |
| SBP00015 | Romaine Lettuce | Pseudomonas umsongensis |
| SBP00015 | Romaine Lettuce | Pseudomonas versuta |
| SBP00015 | Romaine Lettuce | Pseudomonas viridiflava |
| SBP00015 | Romaine Lettuce | Psychrobacter alimentarius |
| SBP00015 | Romaine Lettuce | Psychrobacter cryohalolentis |
| SBP00015 | Romaine Lettuce | Psychrobacter sp. G |
| SBP00015 | Romaine Lettuce | Rhodococcus fascians |
| SBP00015 | Romaine Lettuce | Stenotrophomonas maltophilia |
| SBP00015 | Romaine Lettuce | Stenotrophomonas rhizophila |
| SBP00028 | Cucumber | [Arcobacter] porcinus |
| SBP00028 | Cucumber | [Clostridium] scindens |
| SBP00028 | Cucumber | Acinetobacter baumannii |
| SBP00028 | Cucumber | Acinetobacter calcoaceticus |
| SBP00028 | Cucumber | Actinoplanes sp. ATCC 31351 |
| SBP00028 | Cucumber | Aequorivita sp. H23M31 |
| SBP00028 | Cucumber | Agrobacterium sp. |
| SBP00028 | Cucumber | Alphaproteobacteria bacterium WS11 |
| SBP00028 | Cucumber | Arcobacter bivalviorum |
| SBP00028 | Cucumber | Arcobacter skirrowii |
| SBP00028 | Cucumber | Bacillus paralicheniformis |
| SBP00028 | Cucumber | Bacillus sp. (in: Bacteria) |
| SBP00028 | Cucumber | Bacillus thuringiensis |
| SBP00028 | Cucumber | Bacteroides dorei |
| SBP00028 | Cucumber | Brevundimonas sp. LM2 |
| SBP00028 | Cucumber | Caulobacter mirabilis |
| SBP00028 | Cucumber | Chlamydia pecorum |
| SBP00028 | Cucumber | Clostridium butyricum |
| SBP00028 | Cucumber | Coxiella burnetii |

TABLE 3-continued

List of species identified in each metagenomic sample of each SBP Sample

| SBP ID | SBP Host Common Name | Genus sp. |
|---|---|---|
| SBP00028 | Cucumber | *Cutibacterium acnes* |
| SBP00028 | Cucumber | *Enterobacter cancerogenus* |
| SBP00028 | Cucumber | *Enterobacter cloacae* |
| SBP00028 | Cucumber | *Enterobacter cloacae* complex sp. |
| SBP00028 | Cucumber | *Enterobacter hormaechei* |
| SBP00028 | Cucumber | *Enterobacter* sp. 638 |
| SBP00028 | Cucumber | *Enterococcus faecalis* |
| SBP00028 | Cucumber | *Escherichia coli* |
| SBP00028 | Cucumber | *Flagellimonas* sp. HME9304 |
| SBP00028 | Cucumber | *Geobacter uraniireducens* |
| SBP00028 | Cucumber | *Granulicella mallensis* |
| SBP00028 | Cucumber | *Isosphaera pallida* |
| SBP00028 | Cucumber | *Janthinobacterium svalbardensis* |
| SBP00028 | Cucumber | *Kangiella sediminilitoris* |
| SBP00028 | Cucumber | *Klebsiella pneumoniae* |
| SBP00028 | Cucumber | *Lactobacillus johnsonii* |
| SBP00028 | Cucumber | *Leclercia adecarboxylata* |
| SBP00028 | Cucumber | *Lelliottia amnigena* |
| SBP00028 | Cucumber | *Lelliottia jeotgali* |
| SBP00028 | Cucumber | *Lysobacter gummosus* |
| SBP00028 | Cucumber | *Marinobacterium aestuarii* |
| SBP00028 | Cucumber | *Marinomonas primoryensis* |
| SBP00028 | Cucumber | *Methanococcus maripaludis* |
| SBP00028 | Cucumber | *Methanosarcina horonobensis* |
| SBP00028 | Cucumber | *Methanothrix soehngenii* |
| SBP00028 | Cucumber | *Myxococcus macrosporus* |
| SBP00028 | Cucumber | *Nocardia nova* |
| SBP00028 | Cucumber | *Oceanobacillus iheyensis* |
| SBP00028 | Cucumber | *Oleiphilus messinensis* |
| SBP00028 | Cucumber | *Paenibacillus chitinolyticus* |
| SBP00028 | Cucumber | *Paenibacillus* sp. FSL R7-0273 |
| SBP00028 | Cucumber | *Pantoea agglomerans* |
| SBP00028 | Cucumber | *Pantoea ananatis* |
| SBP00028 | Cucumber | *Parascardovia denticolens* |
| SBP00028 | Cucumber | *Pasteurella multocida* |
| SBP00028 | Cucumber | *Pedobacter* sp. PACM 27299 |
| SBP00028 | Cucumber | *Photobacterium damselae* |
| SBP00028 | Cucumber | *Pleomorphomonas* sp. SM30 |
| SBP00028 | Cucumber | *Porphyromonas crevioricanis* |
| SBP00028 | Cucumber | *Prevotella scopos* |
| SBP00028 | Cucumber | *Providencia rettgeri* |
| SBP00028 | Cucumber | *Pseudomonas fluorescens* |
| SBP00028 | Cucumber | *Pseudomonas koreensis* |
| SBP00028 | Cucumber | *Pseudomonas plecoglossicida* |
| SBP00028 | Cucumber | *Pseudomonas* sp. |
| SBP00028 | Cucumber | *Rhodococcus fascians* |
| SBP00028 | Cucumber | *Salmonella enterica* |
| SBP00028 | Cucumber | *Serratia fonticola* |
| SBP00028 | Cucumber | *Serratia marcescens* |
| SBP00028 | Cucumber | *Serratia plymuthica* |
| SBP00028 | Cucumber | *Serratia* sp. |
| SBP00028 | Cucumber | *Sorangium cellulosum* |
| SBP00028 | Cucumber | *Sphingobacteriaceae bacterium* GW460-11-11-14-LBS |
| SBP00028 | Cucumber | *Spiroplasma floricola* |
| SBP00028 | Cucumber | *Stenotrophomonas maltophilia* |
| SBP00028 | Cucumber | *Stenotrophomonas rhizophila* |
| SBP00028 | Cucumber | *Synechococcus* sp. PCC 7002 |
| SBP00028 | Cucumber | *Undibacterium parvum* |
| SBP00028 | Cucumber | *Vibrio qinghaiensis* |
| SBP00056 | Lime | *Acetobacterium* sp. KB-1 |
| SBP00056 | Lime | *Achromobacter spanius* |
| SBP00056 | Lime | *Achromobacter xylosoxidans* |
| SBP00056 | Lime | *Aeromonas encheleia* |
| SBP00056 | Lime | *Aeromonas hydrophila* |
| SBP00056 | Lime | *Aeromonas media* |
| SBP00056 | Lime | *Aeromonas salmonicida* |
| SBP00056 | Lime | *Aeromonas* sp. |
| SBP00056 | Lime | *Aeromonas* sp. ASNIH4 |
| SBP00056 | Lime | *Aeromonas* sp. CA23 |
| SBP00056 | Lime | *Aeromonas* sp. CU5 |
| SBP00056 | Lime | *Aeromonas veronii* |
| SBP00056 | Lime | *Agrobacterium* sp. |
| SBP00056 | Lime | *Agrobacterium tumefaciens* |
| SBP00056 | Lime | *Alcaligenes faecalis* |
| SBP00056 | Lime | *Aliivibrio wodanis* |
| SBP00056 | Lime | *Anderseniella* sp. Alg231-50 |

TABLE 3-continued

List of species identified in each metagenomic sample of each SBP Sample

| SBP ID | SBP Host Common Name | Genus sp. |
|---|---|---|
| SBP00056 | Lime | *Aquaspirillum* sp. LM1 |
| SBP00056 | Lime | *Aurantimicrobium* sp. MWH-Uga1 |
| SBP00056 | Lime | *Bacillus altitudinis* |
| SBP00056 | Lime | *Bacillus cereus* |
| SBP00056 | Lime | *Bacillus freudenreichii* |
| SBP00056 | Lime | *Bacillus jeotgali* |
| SBP00056 | Lime | *Bacillus megaterium* |
| SBP00056 | Lime | *Bacillus paralicheniformis* |
| SBP00056 | Lime | *Bacillus pumilus* |
| SBP00056 | Lime | *Bacillus safensis* |
| SBP00056 | Lime | *Bacillus* sp. (in: Bacteria) |
| SBP00056 | Lime | *Bacillus subtilis* |
| SBP00056 | Lime | *Bacillus thuringiensis* |
| SBP00056 | Lime | Banana streak IM virus |
| SBP00056 | Lime | *Bordetella bronchialis* |
| SBP00056 | Lime | *Bradyrhizobium* sp. BTAi1 |
| SBP00056 | Lime | *Bradyrhizobium* sp. SK17 |
| SBP00056 | Lime | *Chryseobacterium antarcticum* |
| SBP00056 | Lime | *Chryseobacterium* sp. 17S1E7 |
| SBP00056 | Lime | Citrus endogenous pararetrovirus |
| SBP00056 | Lime | *Clostridium acetobutylicum* |
| SBP00056 | Lime | *Clostridium botulinum* |
| SBP00056 | Lime | *Clostridium isatidis* |
| SBP00056 | Lime | *Clostridium perfringens* |
| SBP00056 | Lime | *Clostridium tetani* |
| SBP00056 | Lime | *Coxiella burnetii* |
| SBP00056 | Lime | *Cupriavidus metallidurans* |
| SBP00056 | Lime | *Curvibacter* sp. AEP1-3 |
| SBP00056 | Lime | *Cutibacterium acnes* |
| SBP00056 | Lime | *Dokdonia* sp. 4H-3-7-5 |
| SBP00056 | Lime | *Ectothiorhodospira haloalkaliphila* |
| SBP00056 | Lime | *Ehrlichia ruminantium* |
| SBP00056 | Lime | *Enterobacter cloacae* |
| SBP00056 | Lime | *Enterobacter ludwigii* |
| SBP00056 | Lime | *Enterobacter* sp. 638 |
| SBP00056 | Lime | *Erythrobacter* sp. Alg231-14 |
| SBP00056 | Lime | *Escherichia coli* |
| SBP00056 | Lime | *Flavobacterium album* |
| SBP00056 | Lime | *Gluconacetobacter diazotrophicus* |
| SBP00056 | Lime | *Haloquadratum walsbyi* |
| SBP00056 | Lime | *Halotalea alkalilenta* |
| SBP00056 | Lime | *Helicobacter pylori* |
| SBP00056 | Lime | *Jannaschia* sp. CCS1 |
| SBP00056 | Lime | *Kitasatospora setae* |
| SBP00056 | Lime | *Klebsiella michiganensis* |
| SBP00056 | Lime | *Klebsiella pneumoniae* |
| SBP00056 | Lime | *Kocuria palustris* |
| SBP00056 | Lime | *Lactococcus lactis* |
| SBP00056 | Lime | *Legionella fallonii* |
| SBP00056 | Lime | *Legionella waltersii* |
| SBP00056 | Lime | *Leuconostoc carnosum* |
| SBP00056 | Lime | *Luteitalea pratensis* |
| SBP00056 | Lime | *Methylobacterium radiotolerans* |
| SBP00056 | Lime | *Methylorubrum populi* |
| SBP00056 | Lime | *Microlunatus phosphovorus* |
| SBP00056 | Lime | *Mycolicibacterium chitae* |
| SBP00056 | Lime | *Mycoplasma californicum* |
| SBP00056 | Lime | *Mycoplasma mycoides* |
| SBP00056 | Lime | *Novosphingobium* sp. THN1 |
| SBP00056 | Lime | *Oceanisphaera profunda* |
| SBP00056 | Lime | *Ochrobactrum anthropi* |
| SBP00056 | Lime | *Ochrobactrum pituitosum* |
| SBP00056 | Lime | *Ochrobactrum pseudogrignonense* |
| SBP00056 | Lime | *Ochrobactrum* sp. A44 |
| SBP00056 | Lime | *Ornithobacterium rhinotracheale* |
| SBP00056 | Lime | *Paenibacillus glucanolyticus* |
| SBP00056 | Lime | *Pandoraea oxalativorans* |
| SBP00056 | Lime | *Pantoea agglomerans* |
| SBP00056 | Lime | *Pantoea* sp. PSNIH1 |
| SBP00056 | Lime | *Pantoea vagans* |
| SBP00056 | Lime | *Paraburkholderia caribensis* |
| SBP00056 | Lime | *Paracoccus* sp. CBA4604 |
| SBP00056 | Lime | *Paracoccus zhejiangensis* |
| SBP00056 | Lime | *Pasteurella multocida* |
| SBP00056 | Lime | *Pectobacterium carotovorum* |
| SBP00056 | Lime | *Photobacterium damselae* |

TABLE 3-continued

List of species identified in each metagenomic sample of each SBP Sample

| SBP ID | SBP Host Common Name | Genus sp. |
|---|---|---|
| SBP00056 | Lime | *Planococcus versutus* |
| SBP00056 | Lime | *Plautia stali* |
| SBP00056 | Lime | *Pseudoalteromonas* sp. R3 |
| SBP00056 | Lime | *Pseudomonas chlororaphis* |
| SBP00056 | Lime | *Pseudomonas fluorescens* |
| SBP00056 | Lime | *Pseudomonas frederiksbergensis* |
| SBP00056 | Lime | *Pseudomonas koreensis* |
| SBP00056 | Lime | *Pseudomonas poae* |
| SBP00056 | Lime | *Pseudomonas protegens* |
| SBP00056 | Lime | *Pseudomonas putida* |
| SBP00056 | Lime | *Pseudomonas* sp. |
| SBP00056 | Lime | *Pseudomonas* sp. K2W31S-8 |
| SBP00056 | Lime | *Pseudomonas* sp. RU47 |
| SBP00056 | Lime | *Pseudomonas stutzeri* |
| SBP00056 | Lime | *Pseudomonas syringae* |
| SBP00056 | Lime | *Ralstonia insidiosa* |
| SBP00056 | Lime | *Ralstonia mannitolilytica* |
| SBP00056 | Lime | *Ralstonia pickettii* |
| SBP00056 | Lime | *Ralstonia solanacearum* |
| SBP00056 | Lime | *Rhodobacter sphaeroides* |
| SBP00056 | Lime | *Rhodococcus fascians* |
| SBP00056 | Lime | *Rhodopseudomonas palustris* |
| SBP00056 | Lime | *Roseateles depolymerans* |
| SBP00056 | Lime | *Rubrobacter radiotolerans* |
| SBP00056 | Lime | *Selenomonas sputigena* |
| SBP00056 | Lime | *Seonamhaeicola* sp. S2-3 |
| SBP00056 | Lime | *Serratia liquefaciens* |
| SBP00056 | Lime | *Serratia marcescens* |
| SBP00056 | Lime | *Shewanella psychrophila* |
| SBP00056 | Lime | *Shinella* sp. HZN7 |
| SBP00056 | Lime | *Sorangium cellulosum* |
| SBP00056 | Lime | *Sphingobium cloacae* |
| SBP00056 | Lime | *Staphylococcus aureus* |
| SBP00056 | Lime | *Stenotrophomonas maltophilia* |
| SBP00056 | Lime | *Streptomyces davaonensis* |
| SBP00056 | Lime | *Streptomyces* sp. 3211 |
| SBP00056 | Lime | *Streptomyces* sp. MK45 |
| SBP00056 | Lime | *Streptosporangium roseum* |
| SBP00056 | Lime | *Sugarcane bacilliform* IM virus |
| SBP00056 | Lime | *Tannerella* sp. oral taxon HOT-286 |
| SBP00056 | Lime | *Thermincola potens* |
| SBP00056 | Lime | *Tsukamurella tyrosinosolvens* |
| SBP00056 | Lime | *Xanthomonas citri* |
| SBP00056 | Lime | *Xenorhabdus doucetiae* |
| SBP00056 | Lime | *Yersinia pseudotuberculosis* |
| SBP00061 | Blackberries | [*Brevibacterium*] *frigoritolerans* |
| SBP00061 | Blackberries | [*Clostridium*] *bolteae* |
| SBP00061 | Blackberries | [*Clostridium*] *cellulosi* |
| SBP00061 | Blackberries | [*Clostridium*] *sphenoides* |
| SBP00061 | Blackberries | [*Enterobacter*] *lignolyticus* |
| SBP00061 | Blackberries | [*Eubacterium*] *eligens* |
| SBP00061 | Blackberries | [*Eubacterium*] *hallii* |
| SBP00061 | Blackberries | [*Eubacterium*] *rectale* |
| SBP00061 | Blackberries | [*Eubacterium*] *sulci* |
| SBP00061 | Blackberries | [*Pasteurella*] *aerogenes* |
| SBP00061 | Blackberries | [*Polyangium*] *brachysporum* |
| SBP00061 | Blackberries | *Acanthocystis turfacea chlorella* virus 1 |
| SBP00061 | Blackberries | *Acetoanaerobium sticklandii* |
| SBP00061 | Blackberries | *Acetobacter ghanensis* |
| SBP00061 | Blackberries | *Acetobacter pasteurianus* |
| SBP00061 | Blackberries | *Acetobacter persici* |
| SBP00061 | Blackberries | *Acetobacteraceae bacterium* |
| SBP00061 | Blackberries | *Acetohalobium arabaticum* |
| SBP00061 | Blackberries | *Acetomicrobium mobile* |
| SBP00061 | Blackberries | *Acholeplasma axanthum* |
| SBP00061 | Blackberries | *Acholeplasma laidlawii* |
| SBP00061 | Blackberries | *Acholeplasma oculi* |
| SBP00061 | Blackberries | *Achromobacter denitrificans* |
| SBP00061 | Blackberries | *Achromobacter insolitus* |
| SBP00061 | Blackberries | *Achromobacter* sp. AONIH1 |
| SBP00061 | Blackberries | *Achromobacter* sp. B7 |
| SBP00061 | Blackberries | *Achromobacter spanius* |
| SBP00061 | Blackberries | *Achromobacter xylosoxidans* |
| SBP00061 | Blackberries | *Acidianus brierleyi* |
| SBP00061 | Blackberries | *Acidianus hospitalis* |
| SBP00061 | Blackberries | *Acidihalobacter ferrooxidans* |

TABLE 3-continued

List of species identified in each metagenomic sample of each SBP Sample

| SBP ID | SBP Host Common Name | Genus sp. |
|---|---|---|
| SBP00061 | Blackberries | *Acidihalobacter prosperus* |
| SBP00061 | Blackberries | *Acidipropionibacterium acidipropionici* |
| SBP00061 | Blackberries | *Acidisphaera* sp. G45-3 |
| SBP00061 | Blackberries | *Acidithiobacillus caldus* |
| SBP00061 | Blackberries | *Acidobacteriaceae bacterium* SBC82 |
| SBP00061 | Blackberries | *Acidobacterium capsulatum* |
| SBP00061 | Blackberries | *Acidovorax avenae* |
| SBP00061 | Blackberries | *Acidovorax carolinensis* |
| SBP00061 | Blackberries | *Acidovorax citrulli* |
| SBP00061 | Blackberries | *Acidovorax* sp. 1608163 |
| SBP00061 | Blackberries | *Acidovorax* sp. KKS102 |
| SBP00061 | Blackberries | *Acinetobacter baumannii* |
| SBP00061 | Blackberries | *Acinetobacter calcoaceticus* |
| SBP00061 | Blackberries | *Acinetobacter defluvii* |
| SBP00061 | Blackberries | *Acinetobacter equi* |
| SBP00061 | Blackberries | *Acinetobacter guillouiae* |
| SBP00061 | Blackberries | *Acinetobacter haemolyticus* |
| SBP00061 | Blackberries | *Acinetobacter junii* |
| SBP00061 | Blackberries | *Acinetobacter lactucae* |
| SBP00061 | Blackberries | *Acinetobacter lwoffii* |
| SBP00061 | Blackberries | *Acinetobacter nosocomialis* |
| SBP00061 | Blackberries | *Acinetobacter pittii* |
| SBP00061 | Blackberries | *Acinetobacter radioresistens* |
| SBP00061 | Blackberries | *Acinetobacter soli* |
| SBP00061 | Blackberries | *Acinetobacter* sp. ACNIH1 |
| SBP00061 | Blackberries | *Acinetobacter* sp. TTH0-4 |
| SBP00061 | Blackberries | *Acinetobacter* sp. WCHA45 |
| SBP00061 | Blackberries | *Acinetobacter ursingii* |
| SBP00061 | Blackberries | *Acinetobacter venetianus* |
| SBP00061 | Blackberries | *Acinetobacter wuhouensis* |
| SBP00061 | Blackberries | *Actinoalloteichus hoggarensis* |
| SBP00061 | Blackberries | *Actinoalloteichus* sp. AHMU CJ021 |
| SBP00061 | Blackberries | *Actinobacillus delphinicola* |
| SBP00061 | Blackberries | *Actinobacillus succinogenes* |
| SBP00061 | Blackberries | *Actinobacteria bacterium* IMCC26256 |
| SBP00061 | Blackberries | *Actinomadura amylolytica* |
| SBP00061 | Blackberries | *Actinomyces meyeri* |
| SBP00061 | Blackberries | *Actinomyces radicidentis* |
| SBP00061 | Blackberries | *Actinomyces* sp. oral taxon 171 |
| SBP00061 | Blackberries | *Actinomyces* sp. oral taxon 897 |
| SBP00061 | Blackberries | *Actinoplanes derwentensis* |
| SBP00061 | Blackberries | *Actinoplanes friuliensis* |
| SBP00061 | Blackberries | *Actinoplanes* sp. ATCC 31351 |
| SBP00061 | Blackberries | *Actinoplanes* sp. OR16 |
| SBP00061 | Blackberries | *Actinoplanes teichomyceticus* |
| SBP00061 | Blackberries | *Actinopolymorpha singaporensis* |
| SBP00061 | Blackberries | *Adlercreutzia equolifaciens* |
| SBP00061 | Blackberries | *Advenella kashmirensis* |
| SBP00061 | Blackberries | *Aequorivita* sp. H23M31 |
| SBP00061 | Blackberries | *Aequorivita sublithincola* |
| SBP00061 | Blackberries | *Aeribacillus pallidus* |
| SBP00061 | Blackberries | *Aerococcus christensenii* |
| SBP00061 | Blackberries | *Aerococcus sanguinicola* |
| SBP00061 | Blackberries | *Aeromonas caviae* |
| SBP00061 | Blackberries | *Aeromonas hydrophila* |
| SBP00061 | Blackberries | *Aeromonas media* |
| SBP00061 | Blackberries | *Aeromonas rivipollensis* |
| SBP00061 | Blackberries | *Aeromonas salmonicida* |
| SBP00061 | Blackberries | *Aeromonas schubertii* |
| SBP00061 | Blackberries | *Aeromonas* sp. |
| SBP00061 | Blackberries | *Aeromonas* sp. CU5 |
| SBP00061 | Blackberries | *Aeromonas veronii* |
| SBP00061 | Blackberries | *Afipia* sp. GAS231 |
| SBP00061 | Blackberries | *Agrobacterium fabrum* |
| SBP00061 | Blackberries | *Agrobacterium* sp. |
| SBP00061 | Blackberries | *Agrobacterium tumefaciens* |
| SBP00061 | Blackberries | *Agromyces aureus* |
| SBP00061 | Blackberries | *Alcaligenes faecalis* |
| SBP00061 | Blackberries | *Algibacter alginicilyticus* |
| SBP00061 | Blackberries | *Algoriphagus machipongonensis* |
| SBP00061 | Blackberries | *Alicycliphilus denitrificans* |
| SBP00061 | Blackberries | *Alicyclobacillus acidocaldarius* |
| SBP00061 | Blackberries | *Aliivibrio fischeri* |
| SBP00061 | Blackberries | *Aliivibrio salmonicida* |
| SBP00061 | Blackberries | *Aliivibrio wodanis* |
| SBP00061 | Blackberries | *Alkaliphilus oremlandii* |

TABLE 3-continued

List of species identified in each metagenomic sample of each SBP Sample

| SBP ID | SBP Host Common Name | Genus sp. |
| --- | --- | --- |
| SBP00061 | Blackberries | *Alkalitalea saponilacus* |
| SBP00061 | Blackberries | *Allofrancisella guangzhouensis* |
| SBP00061 | Blackberries | alpha proteobacterium HIMB59 |
| SBP00061 | Blackberries | *Altererythrobacter atlanticus* |
| SBP00061 | Blackberries | *Alteromonas macleodii* |
| SBP00061 | Blackberries | *Alteromonas mediterranea* |
| SBP00061 | Blackberries | *Alteromonas* sp. 76-1 |
| SBP00061 | Blackberries | *Alteromonas* sp. Mac1 |
| SBP00061 | Blackberries | *Alteromonas* sp. RKMC-009 |
| SBP00061 | Blackberries | *Aminobacter aminovorans* |
| SBP00061 | Blackberries | *Aminobacterium colombiense* |
| SBP00061 | Blackberries | *Amycolatopsis albispora* |
| SBP00061 | Blackberries | *Amycolatopsis japonica* |
| SBP00061 | Blackberries | *Amycolatopsis keratiniphila* |
| SBP00061 | Blackberries | *Amycolatopsis methanolica* |
| SBP00061 | Blackberries | *Amycolatopsis orientalis* |
| SBP00061 | Blackberries | *Amycolatopsis* sp. AA4 |
| SBP00061 | Blackberries | *Anabaena cylindrica* |
| SBP00061 | Blackberries | *Anabaena* sp. 90 |
| SBP00061 | Blackberries | *Anaerococcus mediterraneensis* |
| SBP00061 | Blackberries | *Anaerococcus prevotii* |
| SBP00061 | Blackberries | *Anaeromyxobacter* sp. Fw109-5 |
| SBP00061 | Blackberries | *Anaerostipes hadrus* |
| SBP00061 | Blackberries | *Anaerostipes rhamnosivorans* |
| SBP00061 | Blackberries | *Anoxybacillus amylolyticus* |
| SBP00061 | Blackberries | *Anoxybacillus flavithermus* |
| SBP00061 | Blackberries | *Anoxybacter fermentans* |
| SBP00061 | Blackberries | *Antarcticibacterium flavum* |
| SBP00061 | Blackberries | *Antarctobacter heliothermus* |
| SBP00061 | Blackberries | *Apibacter* sp. HY041 |
| SBP00061 | Blackberries | *Apis mellifera filamentous* virus |
| SBP00061 | Blackberries | *Aquabacterium olei* |
| SBP00061 | Blackberries | *Aquiflexum balticum* |
| SBP00061 | Blackberries | *Aquimarina* sp. AD1 |
| SBP00061 | Blackberries | *Aquimarina* sp. AD10 |
| SBP00061 | Blackberries | *Aquimarina* sp. BL5 |
| SBP00061 | Blackberries | *Aquitalea magnusonii* |
| SBP00061 | Blackberries | *Aquitalea* sp. THG-DN7.12 |
| SBP00061 | Blackberries | *Aquitalea* sp. USM4 |
| SBP00061 | Blackberries | *Arachidicoccus* sp. BS20 |
| SBP00061 | Blackberries | *Arachidicoccus* sp. KIS59-12 |
| SBP00061 | Blackberries | *Arcanobacterium haemolyticum* |
| SBP00061 | Blackberries | *Archangium gephyra* |
| SBP00061 | Blackberries | *Arcobacter anaerophilus* |
| SBP00061 | Blackberries | *Arcobacter bivalviorum* |
| SBP00061 | Blackberries | *Arcobacter butzleri* |
| SBP00061 | Blackberries | *Arcobacter cryaerophilus* |
| SBP00061 | Blackberries | *Arcobacter ellisii* |
| SBP00061 | Blackberries | *Arcobacter marinus* |
| SBP00061 | Blackberries | *Arcobacter molluscorum* |
| SBP00061 | Blackberries | *Arcobacter mytili* |
| SBP00061 | Blackberries | *Arcobacter nitrofigilis* |
| SBP00061 | Blackberries | *Arcobacter pacificus* |
| SBP00061 | Blackberries | *Arcobacter suis* |
| SBP00061 | Blackberries | *Arcobacter trophiarum* |
| SBP00061 | Blackberries | *Aromatoleum aromaticum* |
| SBP00061 | Blackberries | *Arsenophonus nasoniae* |
| SBP00061 | Blackberries | *Arthrobacter alpinus* |
| SBP00061 | Blackberries | *Arthrobacter* sp. ERGS1:01 |
| SBP00061 | Blackberries | *Arthrobacter* sp. FB24 |
| SBP00061 | Blackberries | *Arthrobacter* sp. PAMC 25486 |
| SBP00061 | Blackberries | *Arthrobacter* sp. QXT-31 |
| SBP00061 | Blackberries | *Arthrobacter* sp. U41 |
| SBP00061 | Blackberries | *Arthrospira platensis* |
| SBP00061 | Blackberries | *Asticcacaulis excentricus* |
| SBP00061 | Blackberries | *Aurantimicrobium minutum* |
| SBP00061 | Blackberries | *Auraticoccus monumenti* |
| SBP00061 | Blackberries | *Aureimonas* sp. AU20 |
| SBP00061 | Blackberries | *Auricoccus indicus* |
| SBP00061 | Blackberries | *Azoarcus communis* |
| SBP00061 | Blackberries | *Azorhizobium caulinodans* |
| SBP00061 | Blackberries | *Azospira oryzae* |
| SBP00061 | Blackberries | *Azospirillum brasilense* |
| SBP00061 | Blackberries | *Azospirillum* sp. CFH 70021 |
| SBP00061 | Blackberries | *Azospirillum* sp. TSH100 |
| SBP00061 | Blackberries | *Azospirillum* sp. TSH58 |

TABLE 3-continued

List of species identified in each metagenomic sample of each SBP Sample

| SBP ID | SBP Host Common Name | Genus sp. |
|---|---|---|
| SBP00061 | Blackberries | Azotobacter chroococcum |
| SBP00061 | Blackberries | Bacillus altitudinis |
| SBP00061 | Blackberries | Bacillus amyloliquefaciens |
| SBP00061 | Blackberries | Bacillus asahii |
| SBP00061 | Blackberries | Bacillus atrophaeus |
| SBP00061 | Blackberries | Bacillus beveridgei |
| SBP00061 | Blackberries | Bacillus butanolivorans |
| SBP00061 | Blackberries | Bacillus cellulosilyticus |
| SBP00061 | Blackberries | Bacillus cereus |
| SBP00061 | Blackberries | Bacillus circulans |
| SBP00061 | Blackberries | Bacillus clausii |
| SBP00061 | Blackberries | Bacillus cohnii |
| SBP00061 | Blackberries | Bacillus cytotoxicus |
| SBP00061 | Blackberries | Bacillus foraminis |
| SBP00061 | Blackberries | Bacillus freudenreichii |
| SBP00061 | Blackberries | Bacillus halodurans |
| SBP00061 | Blackberries | Bacillus halotolerans |
| SBP00061 | Blackberries | Bacillus kochii |
| SBP00061 | Blackberries | Bacillus krulwichiae |
| SBP00061 | Blackberries | Bacillus lehensis |
| SBP00061 | Blackberries | Bacillus lentus |
| SBP00061 | Blackberries | Bacillus litoralis |
| SBP00061 | Blackberries | Bacillus marisflavi |
| SBP00061 | Blackberries | Bacillus megaterium |
| SBP00061 | Blackberries | Bacillus methanolicus |
| SBP00061 | Blackberries | Bacillus mycoides |
| SBP00061 | Blackberries | Bacillus oceanisediminis |
| SBP00061 | Blackberries | Bacillus phage Phrodo |
| SBP00061 | Blackberries | Bacillus pseudofirmus |
| SBP00061 | Blackberries | Bacillus pseudomycoides |
| SBP00061 | Blackberries | Bacillus pumilus |
| SBP00061 | Blackberries | Bacillus safensis |
| SBP00061 | Blackberries | Bacillus simplex |
| SBP00061 | Blackberries | Bacillus smithii |
| SBP00061 | Blackberries | Bacillus sonorensis |
| SBP00061 | Blackberries | Bacillus sp. (in: Bacteria) |
| SBP00061 | Blackberries | Bacillus sp. 1NLA3E |
| SBP00061 | Blackberries | Bacillus sp. FJAT-18017 |
| SBP00061 | Blackberries | Bacillus sp. FJAT-45348 |
| SBP00061 | Blackberries | Bacillus sp. OxB-1 |
| SBP00061 | Blackberries | Bacillus sp. X1(2014) |
| SBP00061 | Blackberries | Bacillus sp. Y1 |
| SBP00061 | Blackberries | Bacillus subtilis |
| SBP00061 | Blackberries | Bacillus thermoamylovorans |
| SBP00061 | Blackberries | Bacillus thuringiensis |
| SBP00061 | Blackberries | Bacillus vallismortis |
| SBP00061 | Blackberries | Bacillus velezensis |
| SBP00061 | Blackberries | Bacillus virus Deepblue |
| SBP00061 | Blackberries | Bacillus weihaiensis |
| SBP00061 | Blackberries | Bacteroides caccae |
| SBP00061 | Blackberries | Bacteroides cellulosilyticus |
| SBP00061 | Blackberries | Bacteroides fragilis |
| SBP00061 | Blackberries | Bacteroides helcogenes |
| SBP00061 | Blackberries | Bacteroides ovatus |
| SBP00061 | Blackberries | Bacteroides salanitronis |
| SBP00061 | Blackberries | Bacteroides thetaiotaomicron |
| SBP00061 | Blackberries | Bacteroides zoogleoformans |
| SBP00061 | Blackberries | Bartonella apis |
| SBP00061 | Blackberries | Bartonella vinsonii |
| SBP00061 | Blackberries | Basilea psittacipulmonis |
| SBP00061 | Blackberries | Bat associated circovirus 4 |
| SBP00061 | Blackberries | Bdellovibrio bacteriovorus |
| SBP00061 | Blackberries | Beggiatoa leptomitoformis |
| SBP00061 | Blackberries | Beijerinckia indica |
| SBP00061 | Blackberries | Belliella baltica |
| SBP00061 | Blackberries | Bernardetia litoralis |
| SBP00061 | Blackberries | Beutenbergia cavernae |
| SBP00061 | Blackberries | Bibersteinia trehalosi |
| SBP00061 | Blackberries | Bifidobacterium adolescentis |
| SBP00061 | Blackberries | Bifidobacterium asteroides |
| SBP00061 | Blackberries | Bifidobacterium breve |
| SBP00061 | Blackberries | Bifidobacterium gallinarum |
| SBP00061 | Blackberries | Blackberry Virus F |
| SBP00061 | Blackberries | Blastochloris sp. Gl |
| SBP00061 | Blackberries | Blautia producta |
| SBP00061 | Blackberries | Blautia sp. N6H1-15 |

TABLE 3-continued

List of species identified in each metagenomic sample of each SBP Sample

| SBP ID | SBP Host Common Name | Genus sp. |
| --- | --- | --- |
| SBP00061 | Blackberries | Blueberry fruit drop associated virus |
| SBP00061 | Blackberries | Blueberry red ringspot virus |
| SBP00061 | Blackberries | *Bordetella avium* |
| SBP00061 | Blackberries | *Bordetella bronchialis* |
| SBP00061 | Blackberries | *Bordetella* genomosp. 13 |
| SBP00061 | Blackberries | *Bordetella* genomosp. 8 |
| SBP00061 | Blackberries | *Bordetella hinzii* |
| SBP00061 | Blackberries | *Bordetella petrii* |
| SBP00061 | Blackberries | *Bordetella pseudohinzii* |
| SBP00061 | Blackberries | *Bordetella* sp. H567 |
| SBP00061 | Blackberries | *Bordetella* sp. N |
| SBP00061 | Blackberries | *Borrelia hermsii* |
| SBP00061 | Blackberries | *Borrelia miyamotoi* |
| SBP00061 | Blackberries | *Borreliella afzelii* |
| SBP00061 | Blackberries | *Borreliella garinii* |
| SBP00061 | Blackberries | *Bosea* sp. AS-1 |
| SBP00061 | Blackberries | *Bosea* sp. Tri-49 |
| SBP00061 | Blackberries | *Brachyspira hampsonii* |
| SBP00061 | Blackberries | *Brachyspira hyodysenteriae* |
| SBP00061 | Blackberries | *Brachyspira intermedia* |
| SBP00061 | Blackberries | *Brachyspira murdochii* |
| SBP00061 | Blackberries | *Brachyspira pilosicoli* |
| SBP00061 | Blackberries | *Bradymonas sediminis* |
| SBP00061 | Blackberries | *Bradyrhizobiaceae bacterium* SG-6C |
| SBP00061 | Blackberries | *Bradyrhizobium diazoefficiens* |
| SBP00061 | Blackberries | *Bradyrhizobium erythrophlei* |
| SBP00061 | Blackberries | *Bradyrhizobium guangdongense* |
| SBP00061 | Blackberries | *Bradyrhizobium guangxiense* |
| SBP00061 | Blackberries | *Bradyrhizobium icense* |
| SBP00061 | Blackberries | *Bradyrhizobium japonicum* |
| SBP00061 | Blackberries | *Bradyrhizobium lablabi* |
| SBP00061 | Blackberries | *Bradyrhizobium oligotrophicum* |
| SBP00061 | Blackberries | *Bradyrhizobium ottawaense* |
| SBP00061 | Blackberries | *Bradyrhizobium* sp. |
| SBP00061 | Blackberries | *Bradyrhizobium* sp. 2 3951MB |
| SBP00061 | Blackberries | *Bradyrhizobium* sp. 3 |
| SBP00061 | Blackberries | *Bradyrhizobium* sp. 3 85S1MB |
| SBP00061 | Blackberries | *Bradyrhizobium* sp. BTAi1 |
| SBP00061 | Blackberries | *Bradyrhizobium* sp. CCBAU 51670 |
| SBP00061 | Blackberries | *Bradyrhizobium* sp. CCBAU 51778 |
| SBP00061 | Blackberries | *Bradyrhizobium* sp. CCGE-LA001 |
| SBP00061 | Blackberries | *Bradyrhizobium* sp. ORS 278 |
| SBP00061 | Blackberries | *Bradyrhizobium* sp. ORS 285 |
| SBP00061 | Blackberries | *Bradyrhizobium* sp. ORS 3257 |
| SBP00061 | Blackberries | *Bradyrhizobium* sp. 523321 |
| SBP00061 | Blackberries | *Bradyrhizobium* sp. SK17 |
| SBP00061 | Blackberries | *Bradyrhizobium* sp. WSM471 |
| SBP00061 | Blackberries | *Brevibacillus brevis* |
| SBP00061 | Blackberries | *Brevibacillus formosus* |
| SBP00061 | Blackberries | *Brevibacillus laterosporus* |
| SBP00061 | Blackberries | *Brevibacillus* sp. SCSIO 07484 |
| SBP00061 | Blackberries | *Brevibacterium aurantiacum* |
| SBP00061 | Blackberries | *Brevibacterium linens* |
| SBP00061 | Blackberries | *Brevundimonas* sp. DS20 |
| SBP00061 | Blackberries | *Buchnera aphidicola* |
| SBP00061 | Blackberries | *Burkholderia anthina* |
| SBP00061 | Blackberries | *Burkholderia cenocepacia* |
| SBP00061 | Blackberries | *Burkholderia cepacia* |
| SBP00061 | Blackberries | *Burkholderia contaminans* |
| SBP00061 | Blackberries | *Burkholderia gladioli* |
| SBP00061 | Blackberries | *Burkholderia lata* |
| SBP00061 | Blackberries | *Burkholderia plantarii* |
| SBP00061 | Blackberries | *Burkholderia pseudomallei* |
| SBP00061 | Blackberries | *Burkholderia* sp. CCGE1003 |
| SBP00061 | Blackberries | *Burkholderia* sp. MSMB0852 |
| SBP00061 | Blackberries | *Burkholderia stabilis* |
| SBP00061 | Blackberries | *Burkholderia thailandensis* |
| SBP00061 | Blackberries | *Burkholderia ubonensis* |
| SBP00061 | Blackberries | *Burkholderiales bacterium* JOSHI_001 |
| SBP00061 | Blackberries | *Burkholderiales bacterium* YL45 |
| SBP00061 | Blackberries | *Buttiauxella* sp. 3AFRM03 |
| SBP00061 | Blackberries | *Butyricimonas* sp. H184 |
| SBP00061 | Blackberries | *Butyrivibrio fibrisolvens* |
| SBP00061 | Blackberries | *Butyrivibrio proteoclasticus* |
| SBP00061 | Blackberries | *Caldicellulosiruptor bescii* |
| SBP00061 | Blackberries | *Caldicellulosiruptor kronotskyensis* |

TABLE 3-continued

List of species identified in each metagenomic sample of each SBP Sample

| SBP ID | SBP Host Common Name | Genus sp. |
|---|---|---|
| SBP00061 | Blackberries | *Caldicellulosiruptor obsidiansis* |
| SBP00061 | Blackberries | *Caldisphaera lagunensis* |
| SBP00061 | Blackberries | *Calothrix brevissima* |
| SBP00061 | Blackberries | *Calothrix parasitica* |
| SBP00061 | Blackberries | *Calothrix parietina* |
| SBP00061 | Blackberries | *Calothrix* sp. 336/3 |
| SBP00061 | Blackberries | *Calothrix* sp. NIES-2098 |
| SBP00061 | Blackberries | *Calothrix* sp. NIES-2100 |
| SBP00061 | Blackberries | *Campylobacter coli* |
| SBP00061 | Blackberries | *Campylobacter concisus* |
| SBP00061 | Blackberries | *Campylobacter fetus* |
| SBP00061 | Blackberries | *Campylobacter helveticus* |
| SBP00061 | Blackberries | *Campylobacter hominis* |
| SBP00061 | Blackberries | *Campylobacter hyointestinalis* |
| SBP00061 | Blackberries | *Campylobacter jejuni* |
| SBP00061 | Blackberries | *Campylobacter lari* |
| SBP00061 | Blackberries | *Campylobacter* sp. RM8964 |
| SBP00061 | Blackberries | *Campylobacter sputorum* |
| SBP00061 | Blackberries | *Campylobacter subantarcticus* |
| SBP00061 | Blackberries | *Campylobacter ureolyticus* |
| SBP00061 | Blackberries | *Candidatus Accumulibacter phosphatis* |
| SBP00061 | Blackberries | *Candidatus Arthromitus* sp. SFB-rat-Yit |
| SBP00061 | Blackberries | *Candidatus Babela massiliensis* |
| SBP00061 | Blackberries | *Candidatus Cyclonatronum proteinivorum* |
| SBP00061 | Blackberries | *Candidatus Desulfofervidus auxilii* |
| SBP00061 | Blackberries | *Candidatus Doolittlea endobia* |
| SBP00061 | Blackberries | *Candidatus Endolissoclinum faulkneri* |
| SBP00061 | Blackberries | *Candidatus Erwinia* sp. ErCipseudotaxifoliae |
| SBP00061 | Blackberries | *Candidatus Fokinia solitaria* |
| SBP00061 | Blackberries | *Candidatus Izimaplasma* sp. HR1 |
| SBP00061 | Blackberries | *Candidatus Kinetoplastibacterium galatii* |
| SBP00061 | Blackberries | *Candidatus Kinetoplastibacterium oncopeltii* |
| SBP00061 | Blackberries | *Candidatus Koribacter versatilis* |
| SBP00061 | Blackberries | *Candidatus Methylopumilus turicensis* |
| SBP00061 | Blackberries | *Candidatus Midichloria mitochondrii* |
| SBP00061 | Blackberries | *Candidatus Nitrosocaldus islandicus* |
| SBP00061 | Blackberries | *Candidatus Nitrosocosmicus franklandus* |
| SBP00061 | Blackberries | *Candidatus Nitrosopumilus sediminis* |
| SBP00061 | Blackberries | *Candidatus Nitrosotenuis cloacae* |
| SBP00061 | Blackberries | *Candidatus Nucleicultrix amoebiphila* |
| SBP00061 | Blackberries | *Candidatus Paracaedibacter acanthamoebae* |
| SBP00061 | Blackberries | *Candidatus Pelagibacter* sp. RS39 |
| SBP00061 | Blackberries | *Candidatus Pelagibacter* sp. RS40 |
| SBP00061 | Blackberries | *Candidatus Phycorickettsia trachydisci* |
| SBP00061 | Blackberries | *Candidatus Planktophila dulcis* |
| SBP00061 | Blackberries | *Candidatus Planktophila lacus* |
| SBP00061 | Blackberries | *Candidatus Planktophila versatilis* |
| SBP00061 | Blackberries | *Candidatus Portiera aleyrodidarum* |
| SBP00061 | Blackberries | *Candidatus Protochlamydia amoebophila* |
| SBP00061 | Blackberries | *Candidatus Pseudomonas adelgestsugas* |
| SBP00061 | Blackberries | *Candidatus Puniceispirillum marinum* |
| SBP00061 | Blackberries | *Candidatus Rhodoluna limnophila* |
| SBP00061 | Blackberries | *Candidatus Rickettsiella viridis* |
| SBP00061 | Blackberries | *Candidatus Saccharibacteria* oral taxon TM7x |
| SBP00061 | Blackberries | *Candidatus Sodalis pierantonius* |
| SBP00061 | Blackberries | *Candidatus Solibacter usitatus* |
| SBP00061 | Blackberries | *Candidatus Sulcia muelleri* |
| SBP00061 | Blackberries | *Canid* alphaherpesvirus 1 |
| SBP00061 | Blackberries | *Capnocytophaga canimorsus* |
| SBP00061 | Blackberries | *Capnocytophaga cynodegmi* |
| SBP00061 | Blackberries | *Capnocytophaga* sp. oral taxon 323 |
| SBP00061 | Blackberries | *Capnocytophaga* sp. oral taxon 878 |
| SBP00061 | Blackberries | *Capnocytophaga sputigena* |
| SBP00061 | Blackberries | *Carnobacterium divergens* |
| SBP00061 | Blackberries | *Carnobacterium inhibens* |
| SBP00061 | Blackberries | *Carnobacterium maltaromaticum* |
| SBP00061 | Blackberries | *Catenovulum* sp. CCB-QB4 |
| SBP00061 | Blackberries | *Catenulispora acidiphila* |
| SBP00061 | Blackberries | *Caulobacter flavus* |
| SBP00061 | Blackberries | *Caulobacter henricii* |
| SBP00061 | Blackberries | *Caulobacter* sp. FWC26 |
| SBP00061 | Blackberries | *Caulobacter* sp. K31 |
| SBP00061 | Blackberries | *Caulobacter vibrioides* |
| SBP00061 | Blackberries | *Cedecea neteri* |
| SBP00061 | Blackberries | *Cellulophaga algicola* |
| SBP00061 | Blackberries | *Cellulophaga baltica* |

TABLE 3-continued

List of species identified in each metagenomic sample of each SBP Sample

| SBP ID | SBP Host Common Name | Genus sp. |
|---|---|---|
| SBP00061 | Blackberries | *Cellulophaga lytica* |
| SBP00061 | Blackberries | *Cellvibrio japonicus* |
| SBP00061 | Blackberries | *Chamaesiphon minutus* |
| SBP00061 | Blackberries | *Chania multitudinisentens* |
| SBP00061 | Blackberries | *Chelatococcus daeguensis* |
| SBP00061 | Blackberries | *Chitinophaga pinensis* |
| SBP00061 | Blackberries | *Chitinophaga* sp. MD30 |
| SBP00061 | Blackberries | *Chlamydia pneumoniae* |
| SBP00061 | Blackberries | *Chlamydia* sp. H15-1957-10C |
| SBP00061 | Blackberries | *Chlorobaculum limnaeum* |
| SBP00061 | Blackberries | *Chlorobium phaeobacteroides* |
| SBP00061 | Blackberries | *Chloroflexus aurantiacus* |
| SBP00061 | Blackberries | *Chondrocystis* sp. NIES-4102 |
| SBP00061 | Blackberries | *Chondromyces crocatus* |
| SBP00061 | Blackberries | *Chromobacterium vaccinii* |
| SBP00061 | Blackberries | *Chroococcidiopsis thermalis* |
| SBP00061 | Blackberries | *Chryseobacterium antarcticum* |
| SBP00061 | Blackberries | *Chryseobacterium arthrosphaerae* |
| SBP00061 | Blackberries | *Chryseobacterium camelliae* |
| SBP00061 | Blackberries | *Chryseobacterium carnipullorum* |
| SBP00061 | Blackberries | *Chryseobacterium gallinarum* |
| SBP00061 | Blackberries | *Chryseobacterium gleum* |
| SBP00061 | Blackberries | *Chryseobacterium indologenes* |
| SBP00061 | Blackberries | *Chryseobacterium indoltheticum* |
| SBP00061 | Blackberries | *Chryseobacterium jeonii* |
| SBP00061 | Blackberries | *Chryseobacterium joostei* |
| SBP00061 | Blackberries | *Chryseobacterium lactis* |
| SBP00061 | Blackberries | *Chryseobacterium nakagawai* |
| SBP00061 | Blackberries | *Chryseobacterium piperi* |
| SBP00061 | Blackberries | *Chryseobacterium shandongense* |
| SBP00061 | Blackberries | *Chryseobacterium* sp. 17S1E7 |
| SBP00061 | Blackberries | *Chryseobacterium* sp. 6424 |
| SBP00061 | Blackberries | *Chryseobacterium* sp. G0186 |
| SBP00061 | Blackberries | *Chryseobacterium* sp. G0201 |
| SBP00061 | Blackberries | *Chryseobacterium* sp. StRB126 |
| SBP00061 | Blackberries | *Chryseobacterium* sp. T16E-39 |
| SBP00061 | Blackberries | *Chrysochromulina ericina* virus |
| SBP00061 | Blackberries | *Chthonomonas calidirosea* |
| SBP00061 | Blackberries | *Citrobacter amalonaticus* |
| SBP00061 | Blackberries | *Citrobacter braakii* |
| SBP00061 | Blackberries | *Citrobacter farmeri* |
| SBP00061 | Blackberries | *Citrobacter freundii* |
| SBP00061 | Blackberries | *Citrobacter rodentium* |
| SBP00061 | Blackberries | *Citrobacter* virus Moogle |
| SBP00061 | Blackberries | *Citrobacter werkmanii* |
| SBP00061 | Blackberries | *Clavibacter michiganensis* |
| SBP00061 | Blackberries | *Cloacibacterium normanense* |
| SBP00061 | Blackberries | *Clostridiaceae bacterium* 1450207 |
| SBP00061 | Blackberries | *Clostridiales bacterium* CCNA10 |
| SBP00061 | Blackberries | *Clostridioides difficile* |
| SBP00061 | Blackberries | *Clostridium argentinense* |
| SBP00061 | Blackberries | *Clostridium baratii* |
| SBP00061 | Blackberries | *Clostridium beijerinckii* |
| SBP00061 | Blackberries | *Clostridium bornimense* |
| SBP00061 | Blackberries | *Clostridium botulinum* |
| SBP00061 | Blackberries | *Clostridium butyricum* |
| SBP00061 | Blackberries | *Clostridium carboxidivorans* |
| SBP00061 | Blackberries | *Clostridium cellulovorans* |
| SBP00061 | Blackberries | *Clostridium chauvoei* |
| SBP00061 | Blackberries | *Clostridium drakei* |
| SBP00061 | Blackberries | *Clostridium estertheticum* |
| SBP00061 | Blackberries | *Clostridium formicaceticum* |
| SBP00061 | Blackberries | *Clostridium isatidis* |
| SBP00061 | Blackberries | *Clostridium kluyveri* |
| SBP00061 | Blackberries | *Clostridium novyi* |
| SBP00061 | Blackberries | *Clostridium pasteurianum* |
| SBP00061 | Blackberries | *Clostridium perfringens* |
| SBP00061 | Blackberries | *Clostridium saccharobutylicum* |
| SBP00061 | Blackberries | *Clostridium saccharoperbutylacetonicum* |
| SBP00061 | Blackberries | *Clostridium scatologenes* |
| SBP00061 | Blackberries | *Clostridium septicum* |
| SBP00061 | Blackberries | *Clostridium* sp. AWRP |
| SBP00061 | Blackberries | *Clostridium* sp. CT4 |
| SBP00061 | Blackberries | *Clostridium* sp. DL-VIII |
| SBP00061 | Blackberries | *Clostridium sporogenes* |
| SBP00061 | Blackberries | *Clostridium taeniosporum* |

TABLE 3-continued

List of species identified in each metagenomic sample of each SBP Sample

| SBP ID | SBP Host Common Name | Genus sp. |
|---|---|---|
| SBP00061 | Blackberries | *Clostridium tetani* |
| SBP00061 | Blackberries | *Cohaesibacter* sp. ES.047 |
| SBP00061 | Blackberries | *Collimonas fungivorans* |
| SBP00061 | Blackberries | *Collimonas pratensis* |
| SBP00061 | Blackberries | *Colwellia beringensis* |
| SBP00061 | Blackberries | *Colwellia psychrerythraea* |
| SBP00061 | Blackberries | *Colwellia* sp. Arc7-D |
| SBP00061 | Blackberries | *Colwellia* sp. MT41 |
| SBP00061 | Blackberries | *Colwellia* sp. PAMC 21821 |
| SBP00061 | Blackberries | *Comamonas aquatica* |
| SBP00061 | Blackberries | *Comamonas serinivorans* |
| SBP00061 | Blackberries | *Comamonas terrigena* |
| SBP00061 | Blackberries | *Comamonas testosteroni* |
| SBP00061 | Blackberries | *Commensalibacter* sp. AMU001 |
| SBP00061 | Blackberries | *Coraliomargarita akajimensis* |
| SBP00061 | Blackberries | *Corallococcus coralloides* |
| SBP00061 | Blackberries | *Corynebacterium epidermidicanis* |
| SBP00061 | Blackberries | *Corynebacterium frankenforstense* |
| SBP00061 | Blackberries | *Corynebacterium glutamicum* |
| SBP00061 | Blackberries | *Corynebacterium glyciniphilum* |
| SBP00061 | Blackberries | *Corynebacterium marinum* |
| SBP00061 | Blackberries | *Corynebacterium maris* |
| SBP00061 | Blackberries | *Corynebacterium mustelae* |
| SBP00061 | Blackberries | *Corynebacterium phocae* |
| SBP00061 | Blackberries | *Corynebacterium singulare* |
| SBP00061 | Blackberries | *Corynebacterium* sp. 2184 |
| SBP00061 | Blackberries | *Corynebacterium ulcerans* |
| SBP00061 | Blackberries | *Corynebacterium urealyticum* |
| SBP00061 | Blackberries | *Corynebacterium uterequi* |
| SBP00061 | Blackberries | *Coxiella burnetii* |
| SBP00061 | Blackberries | *Crenobacter* sp. K1W115-77 |
| SBP00061 | Blackberries | *Crinalium epipsammum* |
| SBP00061 | Blackberries | *Croceicoccus marinus* |
| SBP00061 | Blackberries | *Cronobacter malonaticus* |
| SBP00061 | Blackberries | *Cronobacter sakazakii* |
| SBP00061 | Blackberries | *Cryobacterium* sp. LW097 |
| SBP00061 | Blackberries | *Cupriavidus basilensis* |
| SBP00061 | Blackberries | *Cupriavidus gilardii* |
| SBP00061 | Blackberries | *Cupriavidus metallidurans* |
| SBP00061 | Blackberries | *Cupriavidus necator* |
| SBP00061 | Blackberries | *Cupriavidus pauculus* |
| SBP00061 | Blackberries | *Cupriavidus pinatubonensis* |
| SBP00061 | Blackberries | *Cupriavidus* sp. USMAA1020 |
| SBP00061 | Blackberries | *Cupriavidus taiwanensis* |
| SBP00061 | Blackberries | *Curvibacter* sp. AEP1-3 |
| SBP00061 | Blackberries | *Cutibacterium acnes* |
| SBP00061 | Blackberries | *Cutibacterium avidum* |
| SBP00061 | Blackberries | *Cyanobacterium aponinum* |
| SBP00061 | Blackberries | *cyanobacterium* endosymbiont of *Epithemia turgida* |
| SBP00061 | Blackberries | *Cyanothece* sp. ATCC 51142 |
| SBP00061 | Blackberries | *Cyanothece* sp. PCC 7424 |
| SBP00061 | Blackberries | *Cyanothece* sp. PCC 7425 |
| SBP00061 | Blackberries | *Cyanothece* sp. PCC 7822 |
| SBP00061 | Blackberries | *Cyanothece* sp. PCC 8801 |
| SBP00061 | Blackberries | *Cyanothece* sp. PCC 8802 |
| SBP00061 | Blackberries | *Cyclobacterium amurskyense* |
| SBP00061 | Blackberries | *Cyclobacterium marinum* |
| SBP00061 | Blackberries | *Cylindrospermum stagnale* |
| SBP00061 | Blackberries | *Cyprinid* herpesvirus 2 |
| SBP00061 | Blackberries | *Cyprinid* herpesvirus 3 |
| SBP00061 | Blackberries | *Cystobacter fuscus* |
| SBP00061 | Blackberries | *Cytophagales bacterium* TFI 002 |
| SBP00061 | Blackberries | *Dactylococcopsis salina* |
| SBP00061 | Blackberries | *Deferribacter desulfuricans* |
| SBP00061 | Blackberries | *Defluviitoga tunisiensis* |
| SBP00061 | Blackberries | *Dehalobacterium formicoaceticum* |
| SBP00061 | Blackberries | *Dehalococcoides mccartyi* |
| SBP00061 | Blackberries | *Dehalogenimonas formicexedens* |
| SBP00061 | Blackberries | *Deinococcus maricopensis* |
| SBP00061 | Blackberries | *Deinococcus swuensis* |
| SBP00061 | Blackberries | *Delftia acidovorans* |
| SBP00061 | Blackberries | *Delftia* sp. |
| SBP00061 | Blackberries | *Delftia* sp. Cs1-4 |
| SBP00061 | Blackberries | *Delftia* sp. HK171 |
| SBP00061 | Blackberries | *Delftia tsuruhatensis* |
| SBP00061 | Blackberries | *Denitrovibrio acetiphilus* |

TABLE 3-continued

List of species identified in each metagenomic sample of each SBP Sample

| SBP ID | SBP Host Common Name | Genus sp. |
| --- | --- | --- |
| SBP00061 | Blackberries | *Desmodus rotundus* polyomavirus 1 |
| SBP00061 | Blackberries | *Desulfallas gibsoniae* |
| SBP00061 | Blackberries | *Desulfitobacterium dehalogenans* |
| SBP00061 | Blackberries | *Desulfobacca acetoxidans* |
| SBP00061 | Blackberries | *Desulfobacter hydrogenophilus* |
| SBP00061 | Blackberries | *Desulfobacula toluolica* |
| SBP00061 | Blackberries | *Desulfococcus oleovorans* |
| SBP00061 | Blackberries | *Desulfofarcimen acetoxidans* |
| SBP00061 | Blackberries | *Desulfoglaeba alkanexedens* |
| SBP00061 | Blackberries | *Desulfomonile tiedjei* |
| SBP00061 | Blackberries | *Desulfosporosinus acidiphilus* |
| SBP00061 | Blackberries | *Desulfotomaculum ruminis* |
| SBP00061 | Blackberries | *Desulfovibrio desulfuricans* |
| SBP00061 | Blackberries | *Desulfovibrio gigas* |
| SBP00061 | Blackberries | *Desulfovibrio salexigens* |
| SBP00061 | Blackberries | *Desulfovibrio* sp. FW10128 |
| SBP00061 | Blackberries | *Desulfurella acetivorans* |
| SBP00061 | Blackberries | *Desulfurivibrio alkaliphilus* |
| SBP00061 | Blackberries | *Desulfuromonas soudanensis* |
| SBP00061 | Blackberries | *Devosia* sp. H5989 |
| SBP00061 | Blackberries | *Dialister* sp. Marseille-P5638 |
| SBP00061 | Blackberries | *Diaphorobacter polyhydroxybutyrativorans* |
| SBP00061 | Blackberries | *Dickeya dadantii* |
| SBP00061 | Blackberries | *Dickeya dianthicola* |
| SBP00061 | Blackberries | *Dickeya solani* |
| SBP00061 | Blackberries | *Dickeya zeae* |
| SBP00061 | Blackberries | *Dictyoglomus turgidum* |
| SBP00061 | Blackberries | *Dietzia* sp. oral taxon 368 |
| SBP00061 | Blackberries | *Dietzia timorensis* |
| SBP00061 | Blackberries | *Diolcogaster facetosa* bracovirus |
| SBP00061 | Blackberries | *Dokdonia* sp. Dokd-P16 |
| SBP00061 | Blackberries | *Draconibacterium orientale* |
| SBP00061 | Blackberries | *Dyadobacter fermentans* |
| SBP00061 | Blackberries | *Dyella japonica* |
| SBP00061 | Blackberries | *Dyella* sp. M7H15-1 |
| SBP00061 | Blackberries | *Dyella thiooxydans* |
| SBP00061 | Blackberries | *Echinicola strongylocentroti* |
| SBP00061 | Blackberries | *Echinicola vietnamensis* |
| SBP00061 | Blackberries | *Edwardsiella tarda* |
| SBP00061 | Blackberries | *Egibacter rhizosphaerae* |
| SBP00061 | Blackberries | *Ehrlichia canis* |
| SBP00061 | Blackberries | *Ehrlichia chaffeensis* |
| SBP00061 | Blackberries | *Eikenella corrodens* |
| SBP00061 | Blackberries | *Elizabethkingia anophelis* |
| SBP00061 | Blackberries | *Elizabethkingia meningoseptica* |
| SBP00061 | Blackberries | *Elizabethkingia miricola* |
| SBP00061 | Blackberries | endosymbiont 'TC1' of *Trimyema compressum* |
| SBP00061 | Blackberries | endosymbiont of *Euscepes postfasciatus* |
| SBP00061 | Blackberries | endosymbiont of unidentified scaly snail isolate Monju |
| SBP00061 | Blackberries | *Endozoicomonas montiporae* |
| SBP00061 | Blackberries | *Ensifer adhaerens* |
| SBP00061 | Blackberries | *Enterobacter asburiae* |
| SBP00061 | Blackberries | *Enterobacter cancerogenus* |
| SBP00061 | Blackberries | *Enterobacter cloacae* |
| SBP00061 | Blackberries | *Enterobacter cloacae* complex sp. |
| SBP00061 | Blackberries | *Enterobacter hormaechei* |
| SBP00061 | Blackberries | *Enterobacter ludwigii* |
| SBP00061 | Blackberries | *Enterobacter roggenkampii* |
| SBP00061 | Blackberries | *Enterobacteriaceae bacterium* ENNIH1 |
| SBP00061 | Blackberries | *Enterococcus avium* |
| SBP00061 | Blackberries | *Enterococcus cecorum* |
| SBP00061 | Blackberries | *Enterococcus durans* |
| SBP00061 | Blackberries | *Enterococcus faecalis* |
| SBP00061 | Blackberries | *Enterococcus faecium* |
| SBP00061 | Blackberries | *Enterococcus hirae* |
| SBP00061 | Blackberries | *Enterococcus phage* IME-EFm5 |
| SBP00061 | Blackberries | *Enterococcus thailandicus* |
| SBP00061 | Blackberries | *Enterococcus wangshanyuanii* |
| SBP00061 | Blackberries | *Ereboglobus luteus* |
| SBP00061 | Blackberries | *Erwinia billingiae* |
| SBP00061 | Blackberries | *Erwinia tasmaniensis* |
| SBP00061 | Blackberries | *Erythrobacter litoralis* |
| SBP00061 | Blackberries | *Erythrobacter* sp. Alg231-14 |
| SBP00061 | Blackberries | *Erythrobacter* sp. HL-111 |
| SBP00061 | Blackberries | *Escherichia albertii* |
| SBP00061 | Blackberries | *Escherichia coli* |

TABLE 3-continued

List of species identified in each metagenomic sample of each SBP Sample

| SBP ID | SBP Host Common Name | Genus sp. |
|---|---|---|
| SBP00061 | Blackberries | *Escherichia marmotae* |
| SBP00061 | Blackberries | *Eubacterium callanderi* |
| SBP00061 | Blackberries | *Euzebyella marina* |
| SBP00061 | Blackberries | *Exiguobacterium mexicanum* |
| SBP00061 | Blackberries | *Exiguobacterium* sp. AT1b |
| SBP00061 | Blackberries | *Exiguobacterium* sp. N4-1P |
| SBP00061 | Blackberries | *Fabibacter pacificus* |
| SBP00061 | Blackberries | *Faecalibacterium prausnitzii* |
| SBP00061 | Blackberries | *Feldmannia irregularis* virus a |
| SBP00061 | Blackberries | *Fervidobacterium pennivorans* |
| SBP00061 | Blackberries | *Fibrella aestuarina* |
| SBP00061 | Blackberries | *Fibrella* sp. ES10-3-2-2 |
| SBP00061 | Blackberries | *Fictibacillus phosphorivorans* |
| SBP00061 | Blackberries | *Filimonas lacunae* |
| SBP00061 | Blackberries | *Fimbriimonas ginsengisoli* |
| SBP00061 | Blackberries | *Finegoldia magna* |
| SBP00061 | Blackberries | *Fischerella* sp. NIES-3754 |
| SBP00061 | Blackberries | *Fischerella* sp. NIES-4106 |
| SBP00061 | Blackberries | *Flammeovirga* sp. L12M1 |
| SBP00061 | Blackberries | *Flammeovirga* sp. MY04 |
| SBP00061 | Blackberries | *Flammeovirgaceae bacterium* 311 |
| SBP00061 | Blackberries | *Flavisolibacter* sp. 17128-1 |
| SBP00061 | Blackberries | *Flavisolibacter tropicus* |
| SBP00061 | Blackberries | *Flavivirga eckloniae* |
| SBP00061 | Blackberries | *Flavobacteriaceae bacterium* UJ101 |
| SBP00061 | Blackberries | *Flavobacterium album* |
| SBP00061 | Blackberries | *Flavobacterium anhuiense* |
| SBP00061 | Blackberries | *Flavobacterium branchiophilum* |
| SBP00061 | Blackberries | *Flavobacterium columnare* |
| SBP00061 | Blackberries | *Flavobacterium commune* |
| SBP00061 | Blackberries | *Flavobacterium crocinum* |
| SBP00061 | Blackberries | *Flavobacterium gilvum* |
| SBP00061 | Blackberries | *Flavobacterium indicum* |
| SBP00061 | Blackberries | *Flavobacterium johnsoniae* |
| SBP00061 | Blackberries | *Flavobacterium kingsejongi* |
| SBP00061 | Blackberries | *Flavobacterium magnum* |
| SBP00061 | Blackberries | *Flavobacterium pallidum* |
| SBP00061 | Blackberries | *Flavobacterium psychrophilum* |
| SBP00061 | Blackberries | *Flavobacterium* sp. 140616W15 |
| SBP00061 | Blackberries | *Flavobacterium* sp. CJ74 |
| SBP00061 | Blackberries | *Flavobacterium* sp. HYN0086 |
| SBP00061 | Blackberries | *Flavonifractor plautii* |
| SBP00061 | Blackberries | *Flexistipes sinusarabici* |
| SBP00061 | Blackberries | *Formosa agariphila* |
| SBP00061 | Blackberries | *Formosa* sp. Hel1_31_208 |
| SBP00061 | Blackberries | *Formosa* sp. Hel1_33_131 |
| SBP00061 | Blackberries | *Formosa* sp. Hel3_A1_48 |
| SBP00061 | Blackberries | *Francisella halioticida* |
| SBP00061 | Blackberries | *Francisella hispaniensis* |
| SBP00061 | Blackberries | *Francisella* sp. CA97-1460 |
| SBP00061 | Blackberries | *Francisella* sp. TX077308 |
| SBP00061 | Blackberries | *Francisella* sp. TX077310 |
| SBP00061 | Blackberries | *Francisella tularensis* |
| SBP00061 | Blackberries | *Frankia alni* |
| SBP00061 | Blackberries | *Frankia inefficax* |
| SBP00061 | Blackberries | *Frankia* sp. EAN1pec |
| SBP00061 | Blackberries | *Frankia* symbiont of *Datisca glomerata* |
| SBP00061 | Blackberries | *Fuerstia marisgermanicae* |
| SBP00061 | Blackberries | *Fusobacterium hwasookii* |
| SBP00061 | Blackberries | *Fusobacterium mortiferum* |
| SBP00061 | Blackberries | *Fusobacterium necrophorum* |
| SBP00061 | Blackberries | *Fusobacterium nucleatum* |
| SBP00061 | Blackberries | *Fusobacterium periodonticum* |
| SBP00061 | Blackberries | *Fusobacterium ulcerans* |
| SBP00061 | Blackberries | *Fusobacterium varium* |
| SBP00061 | Blackberries | *Gardnerella vaginalis* |
| SBP00061 | Blackberries | *Geitlerinema* sp. PCC 7407 |
| SBP00061 | Blackberries | *Gemella haemolysans* |
| SBP00061 | Blackberries | *Geminocystis herdmanii* |
| SBP00061 | Blackberries | *Geminocystis* sp. NIES-3708 |
| SBP00061 | Blackberries | *Geminocystis* sp. NIES-3709 |
| SBP00061 | Blackberries | *Gemmata* sp. SH-PL17 |
| SBP00061 | Blackberries | *Gemmatimonas aurantiaca* |
| SBP00061 | Blackberries | *Gemmatirosa kalamazoonesis* |
| SBP00061 | Blackberries | *Geobacter bemidjiensis* |
| SBP00061 | Blackberries | *Geobacter lovleyi* |

TABLE 3-continued

List of species identified in each metagenomic sample of each SBP Sample

| SBP ID | SBP Host Common Name | Genus sp. |
|---|---|---|
| SBP00061 | Blackberries | *Geobacter uraniireducens* |
| SBP00061 | Blackberries | *Georgenia* sp. ZLJ0423 |
| SBP00061 | Blackberries | *Geovibrio thiophilus* |
| SBP00061 | Blackberries | *Gibbsiella quercinecans* |
| SBP00061 | Blackberries | *Gilliamella apicola* |
| SBP00061 | Blackberries | *Glaciecola nitratireducens* |
| SBP00061 | Blackberries | *Glaciecola* sp. 4H-3-7 + YE-5 |
| SBP00061 | Blackberries | *Glaciecola* sp. THG-3.7 |
| SBP00061 | Blackberries | *Glossina hytrovirus* |
| SBP00061 | Blackberries | *Gluconobacter albidus* |
| SBP00061 | Blackberries | *Gluconobacter oxydans* |
| SBP00061 | Blackberries | *Glutamicibacter halophytocola* |
| SBP00061 | Blackberries | *Gordonia polyisoprenivorans* |
| SBP00061 | Blackberries | *Gordonia* sp. 1D |
| SBP00061 | Blackberries | *Gordonia* sp. KTR9 |
| SBP00061 | Blackberries | *Gordonia* sp. MMS17-SY073 |
| SBP00061 | Blackberries | *Gordonia terrae* |
| SBP00061 | Blackberries | *Gordonibacter massiliensis* |
| SBP00061 | Blackberries | *Gottschalkia acidurici* |
| SBP00061 | Blackberries | *Gramella forsetii* |
| SBP00061 | Blackberries | *Gramella* sp. MAR_2010_102 |
| SBP00061 | Blackberries | *Granulosicoccus antarcticus* |
| SBP00061 | Blackberries | *Gynuella sunshinyii* |
| SBP00061 | Blackberries | *Haemophilus haemolyticus* |
| SBP00061 | Blackberries | *Haemophilus influenzae* |
| SBP00061 | Blackberries | *Haemophilus parainfluenzae* |
| SBP00061 | Blackberries | *Hafnia paralvei* |
| SBP00061 | Blackberries | *Haliangium ochraceum* |
| SBP00061 | Blackberries | *Halioglobus japonicus* |
| SBP00061 | Blackberries | *Halobacillus halophilus* |
| SBP00061 | Blackberries | *Halobacillus mangrovi* |
| SBP00061 | Blackberries | *Halobacteriovorax marinus* |
| SBP00061 | Blackberries | *Halobacteroides halobius* |
| SBP00061 | Blackberries | *Halocynthiibacter arcticus* |
| SBP00061 | Blackberries | *Haloferax gibbonsil* |
| SBP00061 | Blackberries | *Haloferax volcanii* |
| SBP00061 | Blackberries | *Halogeometricum borinquense* |
| SBP00061 | Blackberries | *Halomicrobium mukohataei* |
| SBP00061 | Blackberries | *Halomonas huangheensis* |
| SBP00061 | Blackberries | *Halomonas hydrothermalis* |
| SBP00061 | Blackberries | *Halomonas* sp. GT |
| SBP00061 | Blackberries | *Halomonas* sp. J592-SW72 |
| SBP00061 | Blackberries | *Halomonas* sp. N3-2A |
| SBP00061 | Blackberries | *Halomonas subglaciescola* |
| SBP00061 | Blackberries | *Halopiger xanaduensis* |
| SBP00061 | Blackberries | *Haloquadratum walsbyi* |
| SBP00061 | Blackberries | *Halorubrum lacusprofundi* |
| SBP00061 | Blackberries | *Halotalea alkalilenta* |
| SBP00061 | Blackberries | *Haloterrigena daqingensis* |
| SBP00061 | Blackberries | *Halothece* sp. PCC 7418 |
| SBP00061 | Blackberries | *Halothiobacillus neapolitanus* |
| SBP00061 | Blackberries | *Halothiobacillus* sp. LS2 |
| SBP00061 | Blackberries | *Hartmannibacter diazotrophicus* |
| SBP00061 | Blackberries | *Helicobacter bizzozeronii* |
| SBP00061 | Blackberries | *Helicobacter canadensis* |
| SBP00061 | Blackberries | *Helicobacter cetorum* |
| SBP00061 | Blackberries | *Helicobacter cholecystus* |
| SBP00061 | Blackberries | *Helicobacter himalayensis* |
| SBP00061 | Blackberries | *Helicobacter pylori* |
| SBP00061 | Blackberries | *Helicoverpa armigera* Iflavirus |
| SBP00061 | Blackberries | *Heliothis zea* nudivirus |
| SBP00061 | Blackberries | *Herbaspirillum huttiense* |
| SBP00061 | Blackberries | *Herbaspirillum robiniae* |
| SBP00061 | Blackberries | *Herbaspirillum rubrisubalbicans* |
| SBP00061 | Blackberries | *Herbaspirillum seropedicae* |
| SBP00061 | Blackberries | *Herbaspirillum* sp. meg3 |
| SBP00061 | Blackberries | *Herbinix luporum* |
| SBP00061 | Blackberries | *Herminiimonas arsenicoxydans* |
| SBP00061 | Blackberries | *Hoeflea* sp. IMCC20628 |
| SBP00061 | Blackberries | *Hungateiclostridium clariflavum* |
| SBP00061 | Blackberries | *Hungateiclostridium saccincola* |
| SBP00061 | Blackberries | *Hungateiclostridium thermocellum* |
| SBP00061 | Blackberries | *Hungatella hathewayi* |
| SBP00061 | Blackberries | *Hydrogenophaga crassostreae* |
| SBP00061 | Blackberries | *Hydrogenophaga* sp. NH-16 |
| SBP00061 | Blackberries | *Hydrogenophaga* sp. RAC07 |

TABLE 3-continued

List of species identified in each metagenomic sample of each SBP Sample

| SBP ID | SBP Host Common Name | Genus sp. |
|---|---|---|
| SBP00061 | Blackberries | *Hydrogenophilus thermoluteolus* |
| SBP00061 | Blackberries | *Hydrogenovibrio crunogenus* |
| SBP00061 | Blackberries | *Hylemonella gracilis* |
| SBP00061 | Blackberries | *Hymenobacter nivis* |
| SBP00061 | Blackberries | *Hymenobacter* sp. 17J36-26 |
| SBP00061 | Blackberries | *Hymenobacter* sp. APR13 |
| SBP00061 | Blackberries | *Hymenobacter* sp. PAMC 26554 |
| SBP00061 | Blackberries | *Hymenobacter swuensis* |
| SBP00061 | Blackberries | *Hyphomicrobium denitrificans* |
| SBP00061 | Blackberries | *Hyphomonas neptunium* |
| SBP00061 | Blackberries | *Idiomarina piscisalsi* |
| SBP00061 | Blackberries | *Idiomarina* sp. OT37-5b |
| SBP00061 | Blackberries | *Inhella inkyongensis* |
| SBP00061 | Blackberries | *Isosphaera pallida* |
| SBP00061 | Blackberries | *Janthinobacterium agaricidamnosum* |
| SBP00061 | Blackberries | *Janthinobacterium* sp. B9-8 |
| SBP00061 | Blackberries | *Janthinobacterium svalbardensis* |
| SBP00061 | Blackberries | *Jiangetla alkaliphila* |
| SBP00061 | Blackberries | *Jiangella* sp. DSM 45060 |
| SBP00061 | Blackberries | *Kangiella profundi* |
| SBP00061 | Blackberries | *Ketobacter alkanivorans* |
| SBP00061 | Blackberries | *Kineococcus radiotolerans* |
| SBP00061 | Blackberries | *Kitasatospora albolonga* |
| SBP00061 | Blackberries | *Kitasatospora aureofaciens* |
| SBP00061 | Blackberries | *Kitasatospora setae* |
| SBP00061 | Blackberries | *Kitasatospora* sp. MMS16-BH015 |
| SBP00061 | Blackberries | *Klebsiella aerogenes* |
| SBP00061 | Blackberries | *Klebsiella michiganensis* |
| SBP00061 | Blackberries | *Klebsiella oxytoca* |
| SBP00061 | Blackberries | *Klebsiella pneumoniae* |
| SBP00061 | Blackberries | *Klebsiella* sp. FDAARGOS_511 |
| SBP00061 | Blackberries | *Klebsiella* sp. WCHKl090001 |
| SBP00061 | Blackberries | *Kocuria palustris* |
| SBP00061 | Blackberries | *Kocuria rosea* |
| SBP00061 | Blackberries | *Kocuria turfanensis* |
| SBP00061 | Blackberries | *Komagataeibacter xylinus* |
| SBP00061 | Blackberries | *Kosakonia cowanii* |
| SBP00061 | Blackberries | *Kosmotoga pacifica* |
| SBP00061 | Blackberries | *Kozakia baliensis* |
| SBP00061 | Blackberries | *Kutzneria albida* |
| SBP00061 | Blackberries | *Laceyella sacchari* |
| SBP00061 | Blackberries | *Lachnoclostridium* sp. YL32 |
| SBP00061 | Blackberries | *Lacinutrix* sp. 5H-3-7-4 |
| SBP00061 | Blackberries | *Lactobacillus acidipiscis* |
| SBP00061 | Blackberries | *Lactobacillus amylophilus* |
| SBP00061 | Blackberries | *Lactobacillus amylovorus* |
| SBP00061 | Blackberries | *Lactobacillus animalis* |
| SBP00061 | Blackberries | *Lactobacillus apis* |
| SBP00061 | Blackberries | *Lactobacillus buchneri* |
| SBP00061 | Blackberries | *Lactobacillus crispatus* |
| SBP00061 | Blackberries | *Lactobacillus curvatus* |
| SBP00061 | Blackberries | *Lactobacillus farciminis* |
| SBP00061 | Blackberries | *Lactobacillus gasseri* |
| SBP00061 | Blackberries | *Lactobacillus ginsenosidimutans* |
| SBP00061 | Blackberries | *Lactobacillus kullabergensis* |
| SBP00061 | Blackberries | *Lactobacillus lindneri* |
| SBP00061 | Blackberries | *Lactobacillus murinus* |
| SBP00061 | Blackberries | *Lactobacillus parabuchneri* |
| SBP00061 | Blackberries | *Lactobacillus paracasei* |
| SBP00061 | Blackberries | *Lactobacillus pentosus* |
| SBP00061 | Blackberries | *Lactobacillus plantarum* |
| SBP00061 | Blackberries | *Lactobacillus reuteri* |
| SBP00061 | Blackberries | *Lactobacillus sakei* |
| SBP00061 | Blackberries | *Lactobacillus salivarius* |
| SBP00061 | Blackberries | *Lactobacillus* sp. HBUA552074 |
| SBP00061 | Blackberries | *Lactococcus garvieae* |
| SBP00061 | Blackberries | *Lactococcus lactis* |
| SBP00061 | Blackberries | *Lactococcus piscium* |
| SBP00061 | Blackberries | Lake Sarah-associated circular virus-29 |
| SBP00061 | Blackberries | *Lautropia mirabilis* |
| SBP00061 | Blackberries | *Leclercia adecarboxylata* |
| SBP00061 | Blackberries | *Legionella anisa* |
| SBP00061 | Blackberries | *Legionella cherrii* |
| SBP00061 | Blackberries | *Legionella clemsonensis* |
| SBP00061 | Blackberries | *Legionella fallonii* |
| SBP00061 | Blackberries | *Legionella hackeliae* |

TABLE 3-continued

List of species identified in each metagenomic sample of each SBP Sample

| SBP ID | SBP Host Common Name | Genus sp. |
|---|---|---|
| SBP00061 | Blackberries | *Legionella pneumophila* |
| SBP00061 | Blackberries | *Legionella sainthelensi* |
| SBP00061 | Blackberries | *Legionella spiritensis* |
| SBP00061 | Blackberries | *Leisingera methylohalidivorans* |
| SBP00061 | Blackberries | *Lelliottia amnigena* |
| SBP00061 | Blackberries | *Lelliottia jeotgali* |
| SBP00061 | Blackberries | *Lelliottia nimipressuralis* |
| SBP00061 | Blackberries | *Lelliottia* sp. WB101 |
| SBP00061 | Blackberries | *Lentibacillus amyloliquefaciens* |
| SBP00061 | Blackberries | *Lentzea guizhouensis* |
| SBP00061 | Blackberries | *Leptolyngbya boryana* |
| SBP00061 | Blackberries | *Leptolyngbya* sp. NIES-3755 |
| SBP00061 | Blackberries | *Leptospira borgpetersenii* |
| SBP00061 | Blackberries | *Leptospira interrogans* |
| SBP00061 | Blackberries | *Leptospira kmetyi* |
| SBP00061 | Blackberries | *Leptospira santarosai* |
| SBP00061 | Blackberries | *Leptothrix cholodnii* |
| SBP00061 | Blackberries | *Leptotrichia buccalis* |
| SBP00061 | Blackberries | *Leptotrichia* sp. oral taxon 212 |
| SBP00061 | Blackberries | *Leucobacter triazinivorans* |
| SBP00061 | Blackberries | *Leuconostoc carnosum* |
| SBP00061 | Blackberries | *Leuconostoc gelidum* |
| SBP00061 | Blackberries | *Leuconostoc mesenteroides* |
| SBP00061 | Blackberries | *Limnochorda pilosa* |
| SBP00061 | Blackberries | *Limnohabitans* sp. 63ED37-2 |
| SBP00061 | Blackberries | *Listeria grayi* |
| SBP00061 | Blackberries | *Listeria innocua* |
| SBP00061 | Blackberries | *Listeria ivanovii* |
| SBP00061 | Blackberries | *Listeria monocytogenes* |
| SBP00061 | Blackberries | *Listeria seeligeri* |
| SBP00061 | Blackberries | *Litorilituus sediminis* |
| SBP00061 | Blackberries | *Luteibacter rhizovicinus* |
| SBP00061 | Blackberries | *Luteitalea pratensis* |
| SBP00061 | Blackberries | *Lutibacter profundi* |
| SBP00061 | Blackberries | *Lutibacter* sp. LPB0138 |
| SBP00061 | Blackberries | *Lysinibacillus* sp. 2017 |
| SBP00061 | Blackberries | *Lysinibacillus* sp. Marseille-P5727 |
| SBP00061 | Blackberries | *Lysinibacillus* sp. SGAir0095 |
| SBP00061 | Blackberries | *Lysinibacillus sphaericus* |
| SBP00061 | Blackberries | *Lysobacter antibioticus* |
| SBP00061 | Blackberries | *Lysobacter capsici* |
| SBP00061 | Blackberries | *Lysobacter enzymogenes* |
| SBP00061 | Blackberries | *Lysobacter gummosus* |
| SBP00061 | Blackberries | *Macrococcus canis* |
| SBP00061 | Blackberries | *Macrococcus caseolyticus* |
| SBP00061 | Blackberries | *Macrococcus* sp. IME1552 |
| SBP00061 | Blackberries | *Magnetospirillum gryphiswaldense* |
| SBP00061 | Blackberries | *Magnetospirillum magneticum* |
| SBP00061 | Blackberries | *Mannheimia* sp. USDA-ARS-USMARC-1261 |
| SBP00061 | Blackberries | *Mannheimia varigena* |
| SBP00061 | Blackberries | *Maribacter* sp. MAR_2009_60 |
| SBP00061 | Blackberries | *Maribacter* sp. T28 |
| SBP00061 | Blackberries | *Marinifilaceae bacterium* SPP2 |
| SBP00061 | Blackberries | *Mariniflexile* sp. TRM1-10 |
| SBP00061 | Blackberries | *Marinilactibacillus* sp. 15R |
| SBP00061 | Blackberries | *Marinobacter psychrophilus* |
| SBP00061 | Blackberries | *Marinobacter salarius* |
| SBP00061 | Blackberries | *Marinobacter* sp. Arc7-DN-1 |
| SBP00061 | Blackberries | *Marinobacter* sp. LQ44 |
| SBP00061 | Blackberries | *Marinobacter* sp. LV10R510-11A |
| SBP00061 | Blackberries | *Marinomonas mediterranea* |
| SBP00061 | Blackberries | *Marinomonas* sp. FW-1 |
| SBP00061 | Blackberries | *Marinomonas* sp. MWYL1 |
| SBP00061 | Blackberries | *Marivirga tractuosa* |
| SBP00061 | Blackberries | *Marivivens* sp. JLT3646 |
| SBP00061 | Blackberries | *Massilia albidiflava* |
| SBP00061 | Blackberries | *Massilia armeniaca* |
| SBP00061 | Blackberries | *Massilia lutea* |
| SBP00061 | Blackberries | *Massilia oculi* |
| SBP00061 | Blackberries | *Massilia plicata* |
| SBP00061 | Blackberries | *Massilia putida* |
| SBP00061 | Blackberries | *Massilia* sp. WG5 |
| SBP00061 | Blackberries | *Massilia* sp. YMA4 |
| SBP00061 | Blackberries | *Megamonas hypermegale* |
| SBP00061 | Blackberries | *Megavirus chiliensis* |
| SBP00061 | Blackberries | *Melaminivora* sp. SC2-9 |

TABLE 3-continued

List of species identified in each metagenomic sample of each SBP Sample

| SBP ID | SBP Host Common Name | Genus sp. |
|---|---|---|
| SBP00061 | Blackberries | *Melioribacter roseus* |
| SBP00061 | Blackberries | *Melissococcus plutonius* |
| SBP00061 | Blackberries | *Melittangium boletus* |
| SBP00061 | Blackberries | *Mesoplasma coleopterae* |
| SBP00061 | Blackberries | *Mesoplasma florum* |
| SBP00061 | Blackberries | *Mesoplasma lactucae* |
| SBP00061 | Blackberries | *Mesoplasma syrphidae* |
| SBP00061 | Blackberries | *Mesoplasma tabanidae* |
| SBP00061 | Blackberries | *Mesorhizobium ciceri* |
| SBP00061 | Blackberries | *Mesorhizobium oceanicum* |
| SBP00061 | Blackberries | *Mesorhizobium* sp. DCY119 |
| SBP00061 | Blackberries | *Mesorhizobium* sp. M1B.F.Ca.ET.045.04.1.1 |
| SBP00061 | Blackberries | *Mesorhizobium* sp. M1D.F.Ca.ET.043.01.1.1 |
| SBP00061 | Blackberries | *Mesorhizobium* sp. M3A.F.Ca.ET.080.04.2.1 |
| SBP00061 | Blackberries | *Mesorhizobium* sp. M4B.F.Ca.ET.058.02.1.1 |
| SBP00061 | Blackberries | *Methanobacterium congolense* |
| SBP00061 | Blackberries | *Methanobrevibacter ruminantium* |
| SBP00061 | Blackberries | *Methanobrevibacter* sp. AbM4 |
| SBP00061 | Blackberries | *Methanocaldococcus infernus* |
| SBP00061 | Blackberries | *Methanocaldococcus* sp. FS406-22 |
| SBP00061 | Blackberries | *Methanocella paludicola* |
| SBP00061 | Blackberries | *Methanococcoides burtonii* |
| SBP00061 | Blackberries | *Methanococcus maripaludis* |
| SBP00061 | Blackberries | *Methanococcus vannielii* |
| SBP00061 | Blackberries | *Methanoculleus bourgensis* |
| SBP00061 | Blackberries | *Methanohalobium evestigatum* |
| SBP00061 | Blackberries | *Methanohalophilus mahii* |
| SBP00061 | Blackberries | *Methanomethylovorans hollandica* |
| SBP00061 | Blackberries | *Methanosaeta harundinacea* |
| SBP00061 | Blackberries | *Methanosarcina barkeri* |
| SBP00061 | Blackberries | *Methanosarcina horonobensis* |
| SBP00061 | Blackberries | *Methanosarcina lacustris* |
| SBP00061 | Blackberries | *Methanosarcina siciliae* |
| SBP00061 | Blackberries | *Methanosarcina* sp. MTP4 |
| SBP00061 | Blackberries | *Methanosphaera stadtmanae* |
| SBP00061 | Blackberries | *Methanothermus fervidus* |
| SBP00061 | Blackberries | *Methanothrix soehngenii* |
| SBP00061 | Blackberries | *Methanotorris igneus* |
| SBP00061 | Blackberries | *Methylibium petroleiphilum* |
| SBP00061 | Blackberries | *Methylobacterium aquaticum* |
| SBP00061 | Blackberries | *Methylobacterium brachiatum* |
| SBP00061 | Blackberries | *Methylobacterium currus* |
| SBP00061 | Blackberries | *Methylobacterium nodulans* |
| SBP00061 | Blackberries | *Methylobacterium phyllosphaerae* |
| SBP00061 | Blackberries | *Methylobacterium radiotolerans* |
| SBP00061 | Blackberries | *Methylobacterium* sp. 17SD2-17 |
| SBP00061 | Blackberries | *Methylobacterium* sp. 17Sr1-1 |
| SBP00061 | Blackberries | *Methylobacterium* sp. 17Sr1-28 |
| SBP00061 | Blackberries | *Methylobacterium* sp. 17Sr1-43 |
| SBP00061 | Blackberries | *Methylobacterium* sp. 4-46 |
| SBP00061 | Blackberries | *Methylobacterium* sp. C1 |
| SBP00061 | Blackberries | *Methylobacterium* sp. DM1 |
| SBP00061 | Blackberries | *Methylobacterium* sp. XJLW |
| SBP00061 | Blackberries | *Methyloceanibacter* sp. wino2 |
| SBP00061 | Blackberries | *Methylocystis* sp. SC2 |
| SBP00061 | Blackberries | *Methylomicrobium alcaliphilum* |
| SBP00061 | Blackberries | *Methylomonas denitrificans* |
| SBP00061 | Blackberries | *Methylomonas koyamae* |
| SBP00061 | Blackberries | *Methylomonas* sp. LW13 |
| SBP00061 | Blackberries | *Methylomusa anaerophila* |
| SBP00061 | Blackberries | *Methylorubrum extorquens* |
| SBP00061 | Blackberries | *Methylorubrum populi* |
| SBP00061 | Blackberries | *Methylovirgula ligni* |
| SBP00061 | Blackberries | *Micavibrio aeruginosavorus* |
| SBP00061 | Blackberries | *Microbacterium aurum* |
| SBP00061 | Blackberries | *Microbacterium foliorum* |
| SBP00061 | Blackberries | *Microbacterium hominis* |
| SBP00061 | Blackberries | *Microbacterium oxydans* |
| SBP00061 | Blackberries | *Microbacterium* sp. LKL04 |
| SBP00061 | Blackberries | *Microbacterium* sp. No. 7 |
| SBP00061 | Blackberries | *Microbacterium testaceum* |
| SBP00061 | Blackberries | *Microbulbifer* sp. A4817 |
| SBP00061 | Blackberries | *Microbulbifer thermotolerans* |
| SBP00061 | Blackberries | *Micrococcus luteus* |
| SBP00061 | Blackberries | *Microcoleus* sp. PCC 7113 |
| SBP00061 | Blackberries | *Microcystis aeruginosa* |

TABLE 3-continued

List of species identified in each metagenomic sample of each SBP Sample

| SBP ID | SBP Host Common Name | Genus sp. |
|---|---|---|
| SBP00061 | Blackberries | *Microcystis panniformis* |
| SBP00061 | Blackberries | *Microcystis* sp. MC19 |
| SBP00061 | Blackberries | *Microlunatus soli* |
| SBP00061 | Blackberries | *Micromonospora coriariae* |
| SBP00061 | Blackberries | *Micromonospora coxensis* |
| SBP00061 | Blackberries | *Micromonospora echinaurantiaca* |
| SBP00061 | Blackberries | *Micromonospora echinofusca* |
| SBP00061 | Blackberries | *Micromonospora echinospora* |
| SBP00061 | Blackberries | *Micromonospora krabiensis* |
| SBP00061 | Blackberries | *Micromonospora narathiwatensis* |
| SBP00061 | Blackberries | *Micromonospora purpureochromogenes* |
| SBP00061 | Blackberries | *Micromonospora rifamycinica* |
| SBP00061 | Blackberries | *Micromonospora* sp. B006 |
| SBP00061 | Blackberries | *Micromonospora* sp. WMMA2032 |
| SBP00061 | Blackberries | *Micromonospora tulbaghiae* |
| SBP00061 | Blackberries | *Micromonospora viridifaciens* |
| SBP00061 | Blackberries | *Micromonospora zamorensis* |
| SBP00061 | Blackberries | *Micropruina glycogenica* |
| SBP00061 | Blackberries | *Microvirga* sp. 17 mud 1-3 |
| SBP00061 | Blackberries | *Microvirgula aerodenitrificans* |
| SBP00061 | Blackberries | Mimivirus terra2 |
| SBP00061 | Blackberries | *Mitsuaria* sp. 7 |
| SBP00061 | Blackberries | *Mogibacterium diversum* |
| SBP00061 | Blackberries | Mollivirus *sibericum* |
| SBP00061 | Blackberries | *Monoglobus pectinilyticus* |
| SBP00061 | Blackberries | *Moorea producens* |
| SBP00061 | Blackberries | *Moraxella bovis* |
| SBP00061 | Blackberries | *Moraxella bovoculi* |
| SBP00061 | Blackberries | *Moraxella catarrhalis* |
| SBP00061 | Blackberries | *Moraxella cuniculi* |
| SBP00061 | Blackberries | *Moraxella osloensis* |
| SBP00061 | Blackberries | *Morganella morganii* |
| SBP00061 | Blackberries | *Mucilaginibacter gotjawali* |
| SBP00061 | Blackberries | *Mucilaginibacter sp.* BJC16-A31 |
| SBP00061 | Blackberries | *Mucinivorans hirudinis* |
| SBP00061 | Blackberries | Mulberry badnavirus 1 |
| SBP00061 | Blackberries | *Muricauda ruestringensis* |
| SBP00061 | Blackberries | Murid betaherpesvirus 2 |
| SBP00061 | Blackberries | *Mycobacterium* sp. djl-10 |
| SBP00061 | Blackberries | *Mycobacterium* sp. JS623 |
| SBP00061 | Blackberries | *Mycobacterium* sp. MS1601 |
| SBP00061 | Blackberries | *Mycobacteroides abscessus* |
| SBP00061 | Blackberries | *Mycolicibacter terrae* |
| SBP00061 | Blackberries | *Mycolicibacterium aurum* |
| SBP00061 | Blackberries | *Mycolicibacterium chubuense* |
| SBP00061 | Blackberries | *Mycolicibacterium rhodesiae* |
| SBP00061 | Blackberries | *Mycolicibacterium smegmatis* |
| SBP00061 | Blackberries | *Mycolicibacterium thermoresistibile* |
| SBP00061 | Blackberries | *Mycoplasma agalactiae* |
| SBP00061 | Blackberries | *Mycoplasma bovigenitalium* |
| SBP00061 | Blackberries | *Mycoplasma californicum* |
| SBP00061 | Blackberries | *Mycoplasma capricolum* |
| SBP00061 | Blackberries | *Mycoplasma cloacale* |
| SBP00061 | Blackberries | *Mycoplasma columborale* |
| SBP00061 | Blackberries | *Mycoplasma conjunctivae* |
| SBP00061 | Blackberries | *Mycoplasma crocodyli* |
| SBP00061 | Blackberries | *Mycoplasma glycophilum* |
| SBP00061 | Blackberries | *Mycoplasma haemofelis* |
| SBP00061 | Blackberries | *Mycoplasma neurolyticum* |
| SBP00061 | Blackberries | *Mycoplasma phocicerebrale* |
| SBP00061 | Blackberries | *Mycoplasma phocidae* |
| SBP00061 | Blackberries | *Mycoplasma phocirhinis* |
| SBP00061 | Blackberries | *Mycoplasma suis* |
| SBP00061 | Blackberries | *Myroides odoratus* |
| SBP00061 | Blackberries | *Myxococcus fulvus* |
| SBP00061 | Blackberries | *Myxococcus macrosporus* |
| SBP00061 | Blackberries | *Myxococcus xanthus* |
| SBP00061 | Blackberries | *Natranaerobius thermophilus* |
| SBP00061 | Blackberries | *Natrialba magadii* |
| SBP00061 | Blackberries | *Nautilia profundicola* |
| SBP00061 | Blackberries | *Neisseria animaloris* |
| SBP00061 | Blackberries | *Neisseria elongata* |
| SBP00061 | Blackberries | *Neisseria lactamica* |
| SBP00061 | Blackberries | *Neisseria subflava* |
| SBP00061 | Blackberries | *Neisseria weaveri* |
| SBP00061 | Blackberries | *Neisseria zoodegmatis* |

TABLE 3-continued

List of species identified in each metagenomic sample of each SBP Sample

| SBP ID | SBP Host Common Name | Genus sp. |
|---|---|---|
| SBP00061 | Blackberries | *Neodiprion lecontei nucleopolyhedrovirus* |
| SBP00061 | Blackberries | *Neorhizobium galegae* |
| SBP00061 | Blackberries | *Niabella soli* |
| SBP00061 | Blackberries | *Niastella koreensis* |
| SBP00061 | Blackberries | *Nissabacter* sp. SGAir0207 |
| SBP00061 | Blackberries | *Nitratiruptor* sp. SB155-2 |
| SBP00061 | Blackberries | *Nitrobacter hamburgensis* |
| SBP00061 | Blackberries | *Nitrosomonas* sp. AL212 |
| SBP00061 | Blackberries | *Nitrospira defluvii* |
| SBP00061 | Blackberries | *Niveispirillum cyanobacteriorum* |
| SBP00061 | Blackberries | *Nocardia brasiliensis* |
| SBP00061 | Blackberries | *Nocardia cyriacigeorgica* |
| SBP00061 | Blackberries | *Nocardia seriolae* |
| SBP00061 | Blackberries | *Nocardia* sp. CFHS0054 |
| SBP00061 | Blackberries | *Nocardia* sp. CS682 |
| SBP00061 | Blackberries | *Nocardioides humi* |
| SBP00061 | Blackberries | *Nocardioides* sp. 603 |
| SBP00061 | Blackberries | *Nocardiopsis dassonvillei* |
| SBP00061 | Blackberries | *Nocardiopsis gilva* |
| SBP00061 | Blackberries | *Nodularia spumigena* |
| SBP00061 | Blackberries | *Nonlabens dokdonensis* |
| SBP00061 | Blackberries | *Nonlabens* sp. MJ115 |
| SBP00061 | Blackberries | *Nonlabens spongiae* |
| SBP00061 | Blackberries | *Nonomuraea* sp. ATCC 55076 |
| SBP00061 | Blackberries | *Nostoc carneum* |
| SBP00061 | Blackberries | *Nostoc flagelliforme* |
| SBP00061 | Blackberries | *Nostoc linckia* |
| SBP00061 | Blackberries | *Nostoc piscinale* |
| SBP00061 | Blackberries | *Nostoc punctiforme* |
| SBP00061 | Blackberries | *Nostoc* sp. 'Lobaria pulmonaria (5183) cyanobiont |
| SBP00061 | Blackberries | *Nostoc* sp. 'Peltigera membranacea cyanobion' N6 |
| SBP00061 | Blackberries | *Nostoc* sp. CENA543 |
| SBP00061 | Blackberries | *Nostoc* sp. NIES-4103 |
| SBP00061 | Blackberries | *Nostoc* sp. PCC 7107 |
| SBP00061 | Blackberries | *Nostoc* sp. PCC 7524 |
| SBP00061 | Blackberries | *Nostoc sphaeroides* |
| SBP00061 | Blackberries | *Nostocales cyanobacterium* HT-58-2 |
| SBP00061 | Blackberries | *Novosphingobium* sp. PP1Y |
| SBP00061 | Blackberries | *Oceanisphaera profunda* |
| SBP00061 | Blackberries | *Oceanobacillus iheyensis* |
| SBP00061 | Blackberries | *Ochrobactrum anthropi* |
| SBP00061 | Blackberries | *Ochrobactrum pituitosum* |
| SBP00061 | Blackberries | *Ochrobactrum pseudogrignonense* |
| SBP00061 | Blackberries | *Ochrobactrum* sp. A44 |
| SBP00061 | Blackberries | *Oleiphilus messinensis* |
| SBP00061 | Blackberries | *Oleispira antarctica* |
| SBP00061 | Blackberries | *Olsenella* sp. GAM18 |
| SBP00061 | Blackberries | *Opitutaceae bacterium* TAV5 |
| SBP00061 | Blackberries | *Opitutus terrae* |
| SBP00061 | Blackberries | *Orientia tsutsugamushi* |
| SBP00061 | Blackberries | *Ornithinimicrobium flavum* |
| SBP00061 | Blackberries | *Ornithobacterium rhinotracheale* |
| SBP00061 | Blackberries | *Orrella dioscoreae* |
| SBP00061 | Blackberries | *Oscillatoria acuminata* |
| SBP00061 | Blackberries | *Oscillatoria nigro-viridis* |
| SBP00061 | Blackberries | *Oscillibacter valericigenes* |
| SBP00061 | Blackberries | *Ottowia oryzae* |
| SBP00061 | Blackberries | *Owenweeksia hongkongensis* |
| SBP00061 | Blackberries | *Paenibacillus alvei* |
| SBP00061 | Blackberries | *Paenibacillus baekrokdamisoli* |
| SBP00061 | Blackberries | *Paenibacillus beijingensis* |
| SBP00061 | Blackberries | *Paenibacillus bovis* |
| SBP00061 | Blackberries | *Paenibacillus chitinolyticus* |
| SBP00061 | Blackberries | *Paenibacillus donghaensis* |
| SBP00061 | Blackberries | *Paenibacillus durus* |
| SBP00061 | Blackberries | *Paenibacillus glucanolyticus* |
| SBP00061 | Blackberries | *Paenibacillus graminis* |
| SBP00061 | Blackberries | *Paenibacillus larvae* |
| SBP00061 | Blackberries | *Paenibacillus mucilaginosus* |
| SBP00061 | Blackberries | *Paenibacillus odorifer* |
| SBP00061 | Blackberries | *Paenibacillus polymyxa* |
| SBP00061 | Blackberries | *Paenibacillus riograndensis* |
| SBP00061 | Blackberries | *Paenibacillus sabinae* |
| SBP00061 | Blackberries | *Paenibacillus* sp. 18JY67-1 |
| SBP00061 | Blackberries | *Paenibacillus* sp. BIHB4019 |
| SBP00061 | Blackberries | *Paenibacillus* sp. CAA11 |

TABLE 3-continued

List of species identified in each metagenomic sample of each SBP Sample

| SBP ID | SBP Host Common Name | Genus sp. |
|---|---|---|
| SBP00061 | Blackberries | *Paenibacillus* sp. FSL H7-0357 |
| SBP00061 | Blackberries | *Paenibacillus* sp. FSL H7-0737 |
| SBP00061 | Blackberries | *Paenibacillus* sp. FSL P4-0081 |
| SBP00061 | Blackberries | *Paenibacillus* sp. FSL R7-0273 |
| SBP00061 | Blackberries | *Paenibacillus* sp. FSL R7-0331 |
| SBP00061 | Blackberries | *Paenibacillus* sp. IHBB 10380 |
| SBP00061 | Blackberries | *Paenibacillus* sp. JDR-2 |
| SBP00061 | Blackberries | *Paenibacillus* sp. MBLB1234 |
| SBP00061 | Blackberries | *Paenibacillus yonginensis* |
| SBP00061 | Blackberries | *Paeniclostridium sordellii* |
| SBP00061 | Blackberries | *Paenisporosarcina antarctica* |
| SBP00061 | Blackberries | *Paludibacter propionicigenes* |
| SBP00061 | Blackberries | *Paludisphaera borealis* |
| SBP00061 | Blackberries | *Pandoraea oxalativorans* |
| SBP00061 | Blackberries | *Pandoraea pulmonicola* |
| SBP00061 | Blackberries | *Pandoraea thiooxydans* |
| SBP00061 | Blackberries | *Pandoravirus inopinatum* |
| SBP00061 | Blackberries | *Pandoravirus macleodensis* |
| SBP00061 | Blackberries | *Pandoravirus quercus* |
| SBP00061 | Blackberries | *Pantoea agglomerans* |
| SBP00061 | Blackberries | *Pantoea alhagi* |
| SBP00061 | Blackberries | *Pantoea ananatis* |
| SBP00061 | Blackberries | *Pantoea* sp. At-9b |
| SBP00061 | Blackberries | *Pantoea stewartii* |
| SBP00061 | Blackberries | *Pantoea vagans* |
| SBP00061 | Blackberries | *Paraburkholderia aromaticivorans* |
| SBP00061 | Blackberries | *Paraburkholderia caffeinilytica* |
| SBP00061 | Blackberries | *Paraburkholderia caledonica* |
| SBP00061 | Blackberries | *Paraburkholderia caribensis* |
| SBP00061 | Blackberries | *Paraburkholderia hospita* |
| SBP00061 | Blackberries | *Paraburkholderia phenoliruptrix* |
| SBP00061 | Blackberries | *Paraburkholderia terricola* |
| SBP00061 | Blackberries | *Paracoccus aminovorans* |
| SBP00061 | Blackberries | *Paracoccus yeei* |
| SBP00061 | Blackberries | *Paraglaciecola psychrophila* |
| SBP00061 | Blackberries | *Paraprevotella xylaniphila* |
| SBP00061 | Blackberries | *Parvimonas micra* |
| SBP00061 | Blackberries | *Pasteurella multocida* |
| SBP00061 | Blackberries | *Paucibacter* sp. KCTC 42545 |
| SBP00061 | Blackberries | *Pectobacterium carotovorum* |
| SBP00061 | Blackberries | *Pediococcus acidilactici* |
| SBP00061 | Blackberries | *Pediococcus inopinatus* |
| SBP00061 | Blackberries | *Pediococcus pentosaceus* |
| SBP00061 | Blackberries | *Pedobacter cryoconitis* |
| SBP00061 | Blackberries | *Pedobacter ginsengisoli* |
| SBP00061 | Blackberries | *Pedobacter* sp. eg |
| SBP00061 | Blackberries | *Pedobacter* sp. G11 |
| SBP00061 | Blackberries | *Pedobacter steynii* |
| SBP00061 | Blackberries | *Pelobacter propionicus* |
| SBP00061 | Blackberries | *Pelodictyon phaeoclathratiforme* |
| SBP00061 | Blackberries | *Pelolinea submarina* |
| SBP00061 | Blackberries | *Pelosinus fermentans* |
| SBP00061 | Blackberries | *Pelosinus* sp. UFO1 |
| SBP00061 | Blackberries | *Peptostreptococcaceae bacterium* oral taxon 929 |
| SBP00061 | Blackberries | *Persicobacter* sp. JZB09 |
| SBP00061 | Blackberries | *Petrimonas mucosa* |
| SBP00061 | Blackberries | *Petrotoga mobilis* |
| SBP00061 | Blackberries | *Phaeobacter gallaeciensis* |
| SBP00061 | Blackberries | *Phenylobacterium zucineum* |
| SBP00061 | Blackberries | *Photobacterium damselae* |
| SBP00061 | Blackberries | *Photobacterium gaetbulicola* |
| SBP00061 | Blackberries | *Photobacterium profundum* |
| SBP00061 | Blackberries | *Photorhabdus asymbiotica* |
| SBP00061 | Blackberries | *Phreatobacter stygius* |
| SBP00061 | Blackberries | *Phycisphaera mikurensis* |
| SBP00061 | Blackberries | *Pimelobacter simplex* |
| SBP00061 | Blackberries | *Planctomyces* sp. SH-PL62 |
| SBP00061 | Blackberries | *Planktothrix agardhii* |
| SBP00061 | Blackberries | *Planococcus antarcticus* |
| SBP00061 | Blackberries | *Planococcus donghaensis* |
| SBP00061 | Blackberries | *Planococcus halocryophilus* |
| SBP00061 | Blackberries | *Planococcus maritimus* |
| SBP00061 | Blackberries | *Planococcus plakortidis* |
| SBP00061 | Blackberries | *Plantibacter* sp. |
| SBP00061 | Blackberries | *Plautia stali* |
| SBP00061 | Blackberries | *Pleomorphomonas* sp. SM30 |

TABLE 3-continued

List of species identified in each metagenomic sample of each SBP Sample

| SBP ID | SBP Host Common Name | Genus sp. |
|---|---|---|
| SBP00061 | Blackberries | *Pleurocapsa minor* |
| SBP00061 | Blackberries | *Pluralibacter gergoviae* |
| SBP00061 | Blackberries | *Palaribacter reichenbachii* |
| SBP00061 | Blackberries | *Polaribacter* sp. ALD11 |
| SBP00061 | Blackberries | *Polaribacter* sp. Hel1_33_78 |
| SBP00061 | Blackberries | *Polaribacter* sp. KT25b |
| SBP00061 | Blackberries | *Polaribacter* sp. MED152 |
| SBP00061 | Blackberries | *Polaribacter* sp. SA4-10 |
| SBP00061 | Blackberries | *Polaribacter* sp. SA4-12 |
| SBP00061 | Blackberries | *Polaromonas naphthalenivorans* |
| SBP00061 | Blackberries | *Polaromonas* sp. JS666 |
| SBP00061 | Blackberries | *Polynucleobacter asymbioticus* |
| SBP00061 | Blackberries | *Polynucleobacter duraquae* |
| SBP00061 | Blackberries | *Polynucleobacter necessarius* |
| SBP00061 | Blackberries | *Pontibacter actiniarum* |
| SBP00061 | Blackberries | *Pontibacter akesuensis* |
| SBP00061 | Blackberries | *Pontibacter korlensis* |
| SBP00061 | Blackberries | *Porphyrobacter neustonensis* |
| SBP00061 | Blackberries | *Porphyrobacter* sp. LM 6 |
| SBP00061 | Blackberries | *Pragia fontium* |
| SBP00061 | Blackberries | *Prevotella fusca* |
| SBP00061 | Blackberries | *Prevotella intermedia* |
| SBP00061 | Blackberries | *Prevotella jejuni* |
| SBP00061 | Blackberries | *Prevotella melaninogenica* |
| SBP00061 | Blackberries | *Prochlorococcus marinus* |
| SBP00061 | Blackberries | *Propionibacterium phage PA1-14* |
| SBP00061 | Blackberries | *Propionibacterium* sp. oral taxon 193 |
| SBP00061 | Blackberries | *Prosthecochloris* sp. GSB1 |
| SBP00061 | Blackberries | *Proteiniphilum saccharofermentans* |
| SBP00061 | Blackberries | *Proteus hauseri* |
| SBP00061 | Blackberries | *Proteus mirabilis* |
| SBP00061 | Blackberries | *Proteus vulgaris* |
| SBP00061 | Blackberries | *Providencia heimbachae* |
| SBP00061 | Blackberries | *Providencia rettgeri* |
| SBP00061 | Blackberries | *Providencia rustigianii* |
| SBP00061 | Blackberries | *Providencia sneebia* |
| SBP00061 | Blackberries | *Providencia* sp. WCHPr000369 |
| SBP00061 | Blackberries | *Providencia stuartii* |
| SBP00061 | Blackberries | *Pseudanabaena* sp. ABRG5-3 |
| SBP00061 | Blackberries | *Pseudanabaena* sp. PCC 7367 |
| SBP00061 | Blackberries | *Pseudarcicella* sp. HME7025 |
| SBP00061 | Blackberries | *Pseudoalteromonas atlantica* |
| SBP00061 | Blackberries | *Pseudoalteromonas luteoviolacea* |
| SBP00061 | Blackberries | *Pseudoalteromonas phenolica* |
| SBP00061 | Blackberries | *Pseudoalteromonas piratica* |
| SBP00061 | Blackberries | *Pseudoalteromonas piscicida* |
| SBP00061 | Blackberries | *Pseudoalteromonas rubra* |
| SBP00061 | Blackberries | *Pseudoalteromonas spongiae* |
| SBP00061 | Blackberries | *Pseudoflavitalea* sp. 5GH32-13 |
| SBP00061 | Blackberries | *Pseudomonas aeruginosa* |
| SBP00061 | Blackberries | *Pseudomonas agarici* |
| SBP00061 | Blackberries | *Pseudomonas alcaligenes* |
| SBP00061 | Blackberries | *Pseudomonas amygdali* |
| SBP00061 | Blackberries | *Pseudomonas antarctica* |
| SBP00061 | Blackberries | *Pseudomonas azotoformans* |
| SBP00061 | Blackberries | *Pseudomonas brassicacearum* |
| SBP00061 | Blackberries | *Pseudomonas brenneri* |
| SBP00061 | Blackberries | *Pseudomonas cedrina* |
| SBP00061 | Blackberries | *Pseudomonas chlororaphis* |
| SBP00061 | Blackberries | *Pseudomonas citronellolis* |
| SBP00061 | Blackberries | *Pseudomonas corrugata* |
| SBP00061 | Blackberries | *Pseudomonas entomophila* |
| SBP00061 | Blackberries | *Pseudomonas extremaustralis* |
| SBP00061 | Blackberries | *Pseudomonas extremorientalis* |
| SBP00061 | Blackberries | *Pseudomonas fluorescens* |
| SBP00061 | Blackberries | *Pseudomonas frederiksbergensis* |
| SBP00061 | Blackberries | *Pseudomonas knackmussii* |
| SBP00061 | Blackberries | *Pseudomonas koreensis* |
| SBP00061 | Blackberries | *Pseudomonas libanensis* |
| SBP00061 | Blackberries | *Pseudomonas lini* |
| SBP00061 | Blackberries | *Pseudomonas litoralis* |
| SBP00061 | Blackberries | *Pseudomonas mandelii* |
| SBP00061 | Blackberries | *Pseudomonas mendocina* |
| SBP00061 | Blackberries | *Pseudomonas mucidolens* |
| SBP00061 | Blackberries | *Pseudomonas orientalis* |
| SBP00061 | Blackberries | *Pseudomonas palleroniana* |

TABLE 3-continued

List of species identified in each metagenomic sample of each SBP Sample

| SBP ID | SBP Host Common Name | Genus sp. |
| --- | --- | --- |
| SBP00061 | Blackberries | *Pseudomonas parafulva* |
| SBP00061 | Blackberries | *Pseudomonas phage* vB_PsyM_KIL1 |
| SBP00061 | Blackberries | *Pseudomonas plecoglossicida* |
| SBP00061 | Blackberries | *Pseudomonas poae* |
| SBP00061 | Blackberries | *Pseudomonas prosekii* |
| SBP00061 | Blackberries | *Pseudomonas protegens* |
| SBP00061 | Blackberries | *Pseudomonas psychrotolerans* |
| SBP00061 | Blackberries | *Pseudomonas putida* |
| SBP00061 | Blackberries | *Pseudomonas reinekei* |
| SBP00061 | Blackberries | *Pseudomonas rhizosphaerae* |
| SBP00061 | Blackberries | *Pseudomonas sabulinigri* |
| SBP00061 | Blackberries | *Pseudomonas savastanoi* |
| SBP00061 | Blackberries | *Pseudomonas silesiensis* |
| SBP00061 | Blackberries | *Pseudomonas simiae* |
| SBP00061 | Blackberries | *Pseudomonas sp.* |
| SBP00061 | Blackberries | *Pseudomonas sp.* 31-12 |
| SBP00061 | Blackberries | *Pseudomonas sp.* B10 |
| SBP00061 | Blackberries | *Pseudomonas sp.* CMR12a |
| SBP00061 | Blackberries | *Pseudomonas sp.* DR 5-09 |
| SBP00061 | Blackberries | *Pseudomonas sp.* FDAARGOS_380 |
| SBP00061 | Blackberries | *Pseudomonas sp.* GR 6-02 |
| SBP00061 | Blackberries | *Pseudomonas sp.* K2W315-8 |
| SBP00061 | Blackberries | *Pseudomonas sp.* LBUM920 |
| SBP00061 | Blackberries | *Pseudomonas sp.* LG1E9 |
| SBP00061 | Blackberries | *Pseudomonas sp.* MT-1 |
| SBP00061 | Blackberries | *Pseudomonas sp.* MYb193 |
| SBP00061 | Blackberries | *Pseudomonas sp.* NC02 |
| SBP00061 | Blackberries | *Pseudomonas sp.* NS1(2017) |
| SBP00061 | Blackberries | *Pseudomonas sp.* R3-52-08 |
| SBP00061 | Blackberries | *Pseudomonas sp.* RS-89-07 |
| SBP00061 | Blackberries | *Pseudomonas sp.* RU47 |
| SBP00061 | Blackberries | *Pseudomonas sp.* 5-6-2 |
| SBP00061 | Blackberries | *Pseudomonas sp.* S09G 359 |
| SBP00061 | Blackberries | *Pseudomonas sp.* St29 |
| SBP00061 | Blackberries | *Pseudomonas sp.* StFLB209 |
| SBP00061 | Blackberries | *Pseudomonas sp.* SXM-1 |
| SBP00061 | Blackberries | *Pseudomonas sp.* TCU-HL1 |
| SBP00061 | Blackberries | *Pseudomonas stutzeri* |
| SBP00061 | Blackberries | *Pseudomonas synxantha* |
| SBP00061 | Blackberries | *Pseudomonas syringae* |
| SBP00061 | Blackberries | *Pseudomonas taetrolens* |
| SBP00061 | Blackberries | *Pseudomonas thivervalensis* |
| SBP00061 | Blackberries | *Pseudomonas tolaasii* |
| SBP00061 | Blackberries | *Pseudomonas trivialis* |
| SBP00061 | Blackberries | *Pseudomonas umsongensis* |
| SBP00061 | Blackberries | *Pseudomonas vancouverensis* |
| SBP00061 | Blackberries | *Pseudomonas veronii* |
| SBP00061 | Blackberries | *Pseudomonas viridiflava* |
| SBP00061 | Blackberries | *Pseudomonas yamanorum* |
| SBP00061 | Blackberries | *Pseudonocardia dioxanivorans* |
| SBP00061 | Blackberries | *Pseudonocardia sp.* AL041005-10 |
| SBP00061 | Blackberries | *Pseudonocardia sp.* HH130630-07 |
| SBP00061 | Blackberries | *Pseudopedobacter saltans* |
| SBP00061 | Blackberries | *Pseudothermotoga thermarum* |
| SBP00061 | Blackberries | *Pseudoxanthomonas suwonensis* |
| SBP00061 | Blackberries | *Psychrobacter sp.* P11F6 |
| SBP00061 | Blackberries | *Psychrobacter sp.* P11G3 |
| SBP00061 | Blackberries | *Psychroflexus torquis* |
| SBP00061 | Blackberries | *Psychromonas ingrahamii* |
| SBP00061 | Blackberries | *Psychromonas sp.* CNPT3 |
| SBP00061 | Blackberries | *Pyrococcus horikoshii* |
| SBP00061 | Blackberries | *Rahnella aquatilis* |
| SBP00061 | Blackberries | *Rahnella sp.* ERMR1:05 |
| SBP00061 | Blackberries | *Rahnella sp.* Y9602 |
| SBP00061 | Blackberries | *Ralstonia insidiosa* |
| SBP00061 | Blackberries | *Ralstonia mannitolilytica* |
| SBP00061 | Blackberries | *Ralstonia pickettii* |
| SBP00061 | Blackberries | *Ralstonia solanacearum* |
| SBP00061 | Blackberries | *Ramlibacter tataouinensis* |
| SBP00061 | Blackberries | *Raoultella ornithinolytica* |
| SBP00061 | Blackberries | *Raoultella terrigena* |
| SBP00061 | Blackberries | *Raphidiopsis curvata* |
| SBP00061 | Blackberries | *Rathayibacter festucae* |
| SBP00061 | Blackberries | *Rathayibacter tritici* |
| SBP00061 | Blackberries | *Rhizobacter gummiphilus* |
| SBP00061 | Blackberries | *Rhizobium acidisoli* |

TABLE 3-continued

List of species identified in each metagenomic sample of each SBP Sample

| SBP ID | SBP Host Common Name | Genus sp. |
|---|---|---|
| SBP00061 | Blackberries | Rhizobium etli |
| SBP00061 | Blackberries | Rhizobium jaguaris |
| SBP00061 | Blackberries | Rhizobium leguminosarum |
| SBP00061 | Blackberries | Rhizobium phaseoli |
| SBP00061 | Blackberries | Rhizobium sp. ACO-34A |
| SBP00061 | Blackberries | Rhizobium sp. NXC24 |
| SBP00061 | Blackberries | Rhodanobacter denitrificans |
| SBP00061 | Blackberries | Rhodanobacteraceae bacterium Dysh456 |
| SBP00061 | Blackberries | Rhodobacter sphaeroides |
| SBP00061 | Blackberries | Rhodobacteraceae bacterium QY30 |
| SBP00061 | Blackberries | Rhodobiaceae bacterium |
| SBP00061 | Blackberries | Rhodococcus fascians |
| SBP00061 | Blackberries | Rhodococcus opacus |
| SBP00061 | Blackberries | Rhodococcus rhodochrous |
| SBP00061 | Blackberries | Rhodococcus sp. 52-17 |
| SBP00061 | Blackberries | Rhodoferax ferrireducens |
| SBP00061 | Blackberries | Rhodoferax koreense |
| SBP00061 | Blackberries | Rhodoplanes sp. Z2-YC6860 |
| SBP00061 | Blackberries | Rhodopseudomonas palustris |
| SBP00061 | Blackberries | Rhodothermaceae bacterium RA |
| SBP00061 | Blackberries | Rickettsia bellii |
| SBP00061 | Blackberries | Riemerella anatipestifer |
| SBP00061 | Blackberries | Rivularia sp. PCC 7116 |
| SBP00061 | Blackberries | Roseateles depolymerans |
| SBP00061 | Blackberries | Roseiflexus castenholzii |
| SBP00061 | Blackberries | Roseobacter litoralis |
| SBP00061 | Blackberries | Roseomonas gilardii |
| SBP00061 | Blackberries | Roseomonas sp. FDAARGOS_362 |
| SBP00061 | Blackberries | Rothia mucilaginosa |
| SBP00061 | Blackberries | Rubrivivax gelatinosus |
| SBP00061 | Blackberries | Ruegeria pomeroyi |
| SBP00061 | Blackberries | Ruegeria sp. NKC1-1 |
| SBP00061 | Blackberries | Rufibacter sp. DG15C |
| SBP00061 | Blackberries | Rufibacter sp. DG31D |
| SBP00061 | Blackberries | Ruminiclostridium cellulolyticum |
| SBP00061 | Blackberries | Ruminococcus albus |
| SBP00061 | Blackberries | Ruminococcus bicirculans |
| SBP00061 | Blackberries | Runella sp. SP2 |
| SBP00061 | Blackberries | Saccharophagus degradans |
| SBP00061 | Blackberries | Saccharopolyspora erythraea |
| SBP00061 | Blackberries | Saccharospirillum mangrovi |
| SBP00061 | Blackberries | Saccharothrix espanaensis |
| SBP00061 | Blackberries | Sagittula sp. P11 |
| SBP00061 | Blackberries | Salegentibacter sp. T436 |
| SBP00061 | Blackberries | Salinibacter ruber |
| SBP00061 | Blackberries | Salinigranum rubrum |
| SBP00061 | Blackberries | Salinivirga cyanobacteriivorans |
| SBP00061 | Blackberries | Salipiger profundus |
| SBP00061 | Blackberries | Salmonella bongori |
| SBP00061 | Blackberries | Salmonella enterica |
| SBP00061 | Blackberries | Saprospira grandis |
| SBP00061 | Blackberries | Scytonema sp. HK-05 |
| SBP00061 | Blackberries | Scytonema sp. NIES-4073 |
| SBP00061 | Blackberries | Sebaldella termitidis |
| SBP00061 | Blackberries | Sedimentisphaera salicampi |
| SBP00061 | Blackberries | Sediminicola sp. YIK13 |
| SBP00061 | Blackberries | Selenomonas sp. oral taxon 920 |
| SBP00061 | Blackberries | Seonamhaeicola sp. S2-3 |
| SBP00061 | Blackberries | Serpentinomonas raichei |
| SBP00061 | Blackberries | Serratia fonticola |
| SBP00061 | Blackberries | Serratia liquefaciens |
| SBP00061 | Blackberries | Serratia marcescens |
| SBP00061 | Blackberries | Serratia plymuthica |
| SBP00061 | Blackberries | Serratia sp. |
| SBP00061 | Blackberries | Serratia sp. FGI94 |
| SBP00061 | Blackberries | Serratia sp. SCBI |
| SBP00061 | Blackberries | Shewanella amazonensis |
| SBP00061 | Blackberries | Shewanella baltica |
| SBP00061 | Blackberries | Shewanella denitrificans |
| SBP00061 | Blackberries | Shewanella halifaxensis |
| SBP00061 | Blackberries | Shewanella japonica |
| SBP00061 | Blackberries | Shewanella loihica |
| SBP00061 | Blackberries | Shewanella marisflavi |
| SBP00061 | Blackberries | Shewanella piezotolerans |
| SBP00061 | Blackberries | Shewanella sp. ANA-3 |
| SBP00061 | Blackberries | Shewanella sp. WE21 |

TABLE 3-continued

List of species identified in each metagenomic sample of each SBP Sample

| SBP ID | SBP Host Common Name | Genus sp. |
|---|---|---|
| SBP00061 | Blackberries | *Shewanella violacea* |
| SBP00061 | Blackberries | *Shewanella woodyi* |
| SBP00061 | Blackberries | *Shigella boydii* |
| SBP00061 | Blackberries | *Shigella flexneri* |
| SBP00061 | Blackberries | *Shinella* sp. HZN7 |
| SBP00061 | Blackberries | *Simkania negevensis* |
| SBP00061 | Blackberries | *Simplicispira suum* |
| SBP00061 | Blackberries | *Singulisphaera acidiphila* |
| SBP00061 | Blackberries | *Sinorhizobium fredii* |
| SBP00061 | Blackberries | *Sinorhizobium meliloti* |
| SBP00061 | Blackberries | *Slackia heliotrinireducens* |
| SBP00061 | Blackberries | *Snodgrassella alvi* |
| SBP00061 | Blackberries | *Sodalis* endosymbiont of *Henestaris halophilus* |
| SBP00061 | Blackberries | *Solibacillus* sp. R5-41 |
| SBP00061 | Blackberries | *Solimonas* sp. K1W22B-7 |
| SBP00061 | Blackberries | *Solitalea canadensis* |
| SBP00061 | Blackberries | *Sorangium cellulosum* |
| SBP00061 | Blackberries | *Sphaerochaeta coccoides* |
| SBP00061 | Blackberries | *Sphaerospermopsis kisseleviana* |
| SBP00061 | Blackberries | *Sphingobacteriaceae bacterium* GW460-11-11-14-LB5 |
| SBP00061 | Blackberries | *Sphingobacterium daejeonense* |
| SBP00061 | Blackberries | *Sphingobacterium mizutaii* |
| SBP00061 | Blackberries | *Sphingobacterium psychroaquaticum* |
| SBP00061 | Blackberries | *Sphingobacterium* sp. 21 |
| SBP00061 | Blackberries | *Sphingobacterium* sp. G1-14 |
| SBP00061 | Blackberries | *Sphingobacterium* sp. ML3W |
| SBP00061 | Blackberries | *Sphingobium amiense* |
| SBP00061 | Blackberries | *Sphingobium hydrophobicum* |
| SBP00061 | Blackberries | *Sphingobium yanoikuyae* |
| SBP00061 | Blackberries | *Sphingomonas panacis* |
| SBP00061 | Blackberries | *Sphingomonas* sp. AAP5 |
| SBP00061 | Blackberries | *Sphingomonas* sp. JJ-A5 |
| SBP00061 | Blackberries | *Sphingomonas taxi* |
| SBP00061 | Blackberries | *Sphingomonas wittichii* |
| SBP00061 | Blackberries | *Sphingopyxis alaskensis* |
| SBP00061 | Blackberries | *Sphingopyxis macrogoltabida* |
| SBP00061 | Blackberries | *Sphingopyxis* sp. LPB0140 |
| SBP00061 | Blackberries | *Sphingorhabdus* sp. Alg231-15 |
| SBP00061 | Blackberries | *Sphingorhabdus* sp. YGSMI21 |
| SBP00061 | Blackberries | *Spirochaeta africana* |
| SBP00061 | Blackberries | *Spiroplasma alleghenense* |
| SBP00061 | Blackberries | *Spiroplasma diminutum* |
| SBP00061 | Blackberries | *Spiroplasma litorale* |
| SBP00061 | Blackberries | *Spiroplasma sabaudiense* |
| SBP00061 | Blackberries | *Spirosoma aerolatum* |
| SBP00061 | Blackberries | *Spirosoma montaniterrae* |
| SBP00061 | Blackberries | *Spirosoma pollinicola* |
| SBP00061 | Blackberries | *Spirosoma radiotolerans* |
| SBP00061 | Blackberries | *Sporosarcina pasteurii* |
| SBP00061 | Blackberries | *Sporosarcina psychrophila* |
| SBP00061 | Blackberries | *Sporosarcina* sp. PTS2304 |
| SBP00061 | Blackberries | *Sporosarcina ureae* |
| SBP00061 | Blackberries | *Stackebrandtia nassauensis* |
| SBP00061 | Blackberries | *Stanieria cyanosphaera* |
| SBP00061 | Blackberries | *Stanieria* sp. NIES-3757 |
| SBP00061 | Blackberries | *Staphylococcus argenteus* |
| SBP00061 | Blackberries | *Staphylococcus aureus* |
| SBP00061 | Blackberries | *Staphylococcus capitis* |
| SBP00061 | Blackberries | *Staphylococcus caprae* |
| SBP00061 | Blackberries | *Staphylococcus cohnii* |
| SBP00061 | Blackberries | *Staphylococcus condimenti* |
| SBP00061 | Blackberries | *Staphylococcus epidermidis* |
| SBP00061 | Blackberries | *Staphylococcus haemolyticus* |
| SBP00061 | Blackberries | *Staphylococcus hominis* |
| SBP00061 | Blackberries | *Staphylococcus pasteuri* |
| SBP00061 | Blackberries | *Staphylococcus pseudintermedius* |
| SBP00061 | Blackberries | *Staphylococcus saprophyticus* |
| SBP00061 | Blackberries | *Staphylococcus schleiferi* |
| SBP00061 | Blackberries | *Staphylococcus schweitzeri* |
| SBP00061 | Blackberries | *Staphylococcus sciuri* |
| SBP00061 | Blackberries | *Staphylococcus simiae* |
| SBP00061 | Blackberries | *Staphylococcus simulans* |
| SBP00061 | Blackberries | *Staphylococcus stepanovicii* |
| SBP00061 | Blackberries | *Staphylococcus succinus* |
| SBP00061 | Blackberries | *Staphylococcus warneri* |
| SBP00061 | Blackberries | *Staphylococcus xylosus* |

TABLE 3-continued

List of species identified in each metagenomic sample of each SBP Sample

| SBP ID | SBP Host Common Name | Genus sp. |
|---|---|---|
| SBP00061 | Blackberries | *Stella vacuolata* |
| SBP00061 | Blackberries | *Stenotrophomonas acidaminiphila* |
| SBP00061 | Blackberries | *Stenotrophomonas maltophilia* |
| SBP00061 | Blackberries | *Stenotrophomonas rhizophila* |
| SBP00061 | Blackberries | *Stenotrophomonas* sp. ESTM1D_MKCIP4_1 |
| SBP00061 | Blackberries | *Stenotrophomonas* sp. G4 |
| SBP00061 | Blackberries | *Stenotrophomonas* sp. MYb57 |
| SBP00061 | Blackberries | *Stenotrophomonas* sp. SAU14A_NAIMI4_5 |
| SBP00061 | Blackberries | *Streptacidiphilus* sp. DSM 106435 |
| SBP00061 | Blackberries | *Streptococcus canis* |
| SBP00061 | Blackberries | *Streptococcus dysgalactiae* |
| SBP00061 | Blackberries | *Streptococcus equi* |
| SBP00061 | Blackberries | *Streptococcus gallolyticus* |
| SBP00061 | Blackberries | *Streptococcus gordonii* |
| SBP00061 | Blackberries | *Streptococcus infantarius* |
| SBP00061 | Blackberries | *Streptococcus milleri* |
| SBP00061 | Blackberries | *Streptococcus mitis* |
| SBP00061 | Blackberries | *Streptococcus mutans* |
| SBP00061 | Blackberries | *Streptococcus pantholopis* |
| SBP00061 | Blackberries | *Streptococcus parasanguinis* |
| SBP00061 | Blackberries | *Streptococcus parauberis* |
| SBP00061 | Blackberries | *Streptococcus pluranimalium* |
| SBP00061 | Blackberries | *Streptococcus pneumoniae* |
| SBP00061 | Blackberries | *Streptococcus pyogenes* |
| SBP00061 | Blackberries | *Streptococcus sanguinis* |
| SBP00061 | Blackberries | *Streptococcus* sp. A12 |
| SBP00061 | Blackberries | *Streptococcus* sp. HSISB1 |
| SBP00061 | Blackberries | *Streptococcus* sp. HSISM1 |
| SBP00061 | Blackberries | *Streptococcus suis* |
| SBP00061 | Blackberries | *Streptococcus thermophilus* |
| SBP00061 | Blackberries | *Streptococcus uberis* |
| SBP00061 | Blackberries | *Streptococcus vestibularis* |
| SBP00061 | Blackberries | *Streptomyces alboflavus* |
| SBP00061 | Blackberries | *Streptomyces albulus* |
| SBP00061 | Blackberries | *Streptomyces antibioticus* |
| SBP00061 | Blackberries | *Streptomyces asterosporus* |
| SBP00061 | Blackberries | *Streptomyces atratus* |
| SBP00061 | Blackberries | *Streptomyces avermitilis* |
| SBP00061 | Blackberries | *Streptomyces bingchenggensis* |
| SBP00061 | Blackberries | *Streptomyces cattleya* |
| SBP00061 | Blackberries | *Streptomyces chartreusis* |
| SBP00061 | Blackberries | *Streptomyces clavuligerus* |
| SBP00061 | Blackberries | *Streptomyces cyaneogriseus* |
| SBP00061 | Blackberries | *Streptomyces dengpaensis* |
| SBP00061 | Blackberries | *Streptomyces formicae* |
| SBP00061 | Blackberries | *Streptomyces griseoviridis* |
| SBP00061 | Blackberries | *Streptomyces hygroscopicus* |
| SBP00061 | Blackberries | *Streptomyces lavendulae* |
| SBP00061 | Blackberries | *Streptomyces luteoverticillatus* |
| SBP00061 | Blackberries | *Streptomyces lydicus* |
| SBP00061 | Blackberries | *Streptomyces niveus* |
| SBP00061 | Blackberries | *Streptomyces nodosus* |
| SBP00061 | Blackberries | *Streptomyces olivaceus* |
| SBP00061 | Blackberries | *Streptomyces olivoreticuli* |
| SBP00061 | Blackberries | *Streptomyces pactum* |
| SBP00061 | Blackberries | *Streptomyces puniciscabiei* |
| SBP00061 | Blackberries | *Streptomyces reticuli* |
| SBP00061 | Blackberries | *Streptomyces rimosus* |
| SBP00061 | Blackberries | *Streptomyces rubrolavendulae* |
| SBP00061 | Blackberries | *Streptomyces scabiei* |
| SBP00061 | Blackberries | *Streptomyces* sp. 2323.1 |
| SBP00061 | Blackberries | *Streptomyces* sp. 3214.6 |
| SBP00061 | Blackberries | *Streptomyces* sp. 4F |
| SBP00061 | Blackberries | *Streptomyces* sp. CB09001 |
| SBP00061 | Blackberries | *Streptomyces* sp. CdTBO1 |
| SBP00061 | Blackberries | *Streptomyces* sp. DUT11 |
| SBP00061 | Blackberries | *Streptomyces* sp. ETH9427 |
| SBP00061 | Blackberries | *Streptomyces* sp. HNM0039 |
| SBP00061 | Blackberries | *Streptomyces* sp. NEAU-S7GS2 |
| SBP00061 | Blackberries | *Streptomyces* sp. P3 |
| SBP00061 | Blackberries | *Streptomyces* sp. RTd22 |
| SBP00061 | Blackberries | *Streptomyces* sp. S063 |
| SBP00061 | Blackberries | *Streptomyces* sp. SAT1 |
| SBP00061 | Blackberries | *Streptomyces* sp. SCSIO 03032 |
| SBP00061 | Blackberries | *Streptomyces* sp. SGAir0924 |
| SBP00061 | Blackberries | *Streptomyces* sp. SM18 |

TABLE 3-continued

List of species identified in each metagenomic sample of each SBP Sample

| SBP ID | SBP Host Common Name | Genus sp. |
|---|---|---|
| SBP00061 | Blackberries | *Streptomyces* sp. Tue 6075 |
| SBP00061 | Blackberries | *Streptomyces* sp. W1SF4 |
| SBP00061 | Blackberries | *Streptomyces* sp. WAC 01438 |
| SBP00061 | Blackberries | *Streptomyces* sp. WAC 01529 |
| SBP00061 | Blackberries | *Streptomyces* sp. YIM 121038 |
| SBP00061 | Blackberries | *Streptomyces* sp. Z022 |
| SBP00061 | Blackberries | *Streptomyces* sp. ZFG47 |
| SBP00061 | Blackberries | *Streptomyces violaceusniger* |
| SBP00061 | Blackberries | *Streptomyces virus Amela* |
| SBP00061 | Blackberries | *Streptosporangium roseum* |
| SBP00061 | Blackberries | *Streptosporangium* sp. 'caverna' |
| SBP00061 | Blackberries | *Sulfitobacter* sp. JL08 |
| SBP00061 | Blackberries | *Sulfitobacter* sp. SK012 |
| SBP00061 | Blackberries | *Sulfolobus acidocaldarius* |
| SBP00061 | Blackberries | *Sulfolobus islandicus* |
| SBP00061 | Blackberries | *Sulfuricurvum kujiense* |
| SBP00061 | Blackberries | *Sulfuriferula* sp. AH1 |
| SBP00061 | Blackberries | *Sulfuriflexus mobilis* |
| SBP00061 | Blackberries | *Sulfurifustis variabilis* |
| SBP00061 | Blackberries | *Sulfurihydrogenibium azorense* |
| SBP00061 | Blackberries | *Sulfurihydrogenibium* sp. YO3AOP1 |
| SBP00061 | Blackberries | *Sulfurimonas gotlandica* |
| SBP00061 | Blackberries | *Sulfurisphaera tokodail* |
| SBP00061 | Blackberries | *Sulfurivermis fontis* |
| SBP00061 | Blackberries | *Sulfurospirillum cavolei* |
| SBP00061 | Blackberries | *Sulfurovum* sp. NBC37-1 |
| SBP00061 | Blackberries | *Symbiobacterium thermophilum* |
| SBP00061 | Blackberries | *Synechococcus* sp. CC9311 |
| SBP00061 | Blackberries | *Synechococcus* sp. PCC 7336 |
| SBP00061 | Blackberries | *Synechococcus* sp. PCC 7502 |
| SBP00061 | Blackberries | *Synechocystis* sp. PCC 6714 |
| SBP00061 | Blackberries | *Syntrophothermus lipocalidus* |
| SBP00061 | Blackberries | *Tamlana* sp. U194 |
| SBP00061 | Blackberries | *Tannerella* sp. oral taxon HOT-286 |
| SBP00061 | Blackberries | Tapara virus |
| SBP00061 | Blackberries | *Tatlockia micdadei* |
| SBP00061 | Blackberries | *Tatumella citrea* |
| SBP00061 | Blackberries | *Tatumella ptyseos* |
| SBP00061 | Blackberries | *Taylorella asinigenitalis* |
| SBP00061 | Blackberries | *Tenacibaculum dicentrarchi* |
| SBP00061 | Blackberries | *Tenacibaculum jejuense* |
| SBP00061 | Blackberries | *Tenacibaculum mesophilum* |
| SBP00061 | Blackberries | *Tenacibaculum* sp. SZ-18 |
| SBP00061 | Blackberries | *Tenacibaculum todarodis* |
| SBP00061 | Blackberries | *Tenericutes bacterium* MZ-XQ |
| SBP00061 | Blackberries | *Tepidanaerobacter acetatoxydans* |
| SBP00061 | Blackberries | *Terriglobus saanensis* |
| SBP00061 | Blackberries | *Tessaracoccus flavescens* |
| SBP00061 | Blackberries | *Tetragenococcus halophilus* |
| SBP00061 | Blackberries | *Thalassococcus* sp. S3 |
| SBP00061 | Blackberries | *Thalassolituus oleivorans* |
| SBP00061 | Blackberries | *Thalassospira indica* |
| SBP00061 | Blackberries | *Thalassospira marina* |
| SBP00061 | Blackberries | *Thalassotalea crassostreae* |
| SBP00061 | Blackberries | *Thauera hydrothermalis* |
| SBP00061 | Blackberries | *Thermoactinomyces vulgaris* |
| SBP00061 | Blackberries | *Thermoactinomycetaceae bacterium* SCSIO 07575 |
| SBP00061 | Blackberries | *Thermoanaerobacterium* sp. RBIITD |
| SBP00061 | Blackberries | *Thermoanaerobacterium thermosaccharolyticum* |
| SBP00061 | Blackberries | *Thermobacillus composti* |
| SBP00061 | Blackberries | *Thermobaculum terrenum* |
| SBP00061 | Blackberries | *Thermoclostridium stercorarium* |
| SBP00061 | Blackberries | *Thermococcus barophilus* |
| SBP00061 | Blackberries | *Thermococcus peptonophilus* |
| SBP00061 | Blackberries | *Thermococcus profundus* |
| SBP00061 | Blackberries | *Thermococcus radiotolerans* |
| SBP00061 | Blackberries | *Thermococcus sibiricus* |
| SBP00061 | Blackberries | *Thermococcus* sp. P6 |
| SBP00061 | Blackberries | *Thermodesulfobium narugense* |
| SBP00061 | Blackberries | *Thermogladius calderae* |
| SBP00061 | Blackberries | *Thermogutta terrifontis* |
| SBP00061 | Blackberries | *Thermomonas* sp. SY21 |
| SBP00061 | Blackberries | *Thermosipho africanus* |
| SBP00061 | Blackberries | *Thermosipho melanesiensis* |
| SBP00061 | Blackberries | *Thermotoga profunda* |
| SBP00061 | Blackberries | *Thermus* sp. YIM 78456 |

TABLE 3-continued

List of species identified in each metagenomic sample of each SBP Sample

| SBP ID | SBP Host Common Name | Genus sp. |
| --- | --- | --- |
| SBP00061 | Blackberries | *Thioalkalivibrio nitratireducens* |
| SBP00061 | Blackberries | *Thiobacilius denitrificans* |
| SBP00061 | Blackberries | *Thiomicrorhabdus* sp. HaS4 |
| SBP00061 | Blackberries | *Thiomonas* sp. X19 |
| SBP00061 | Blackberries | *Thioploca ingrica* |
| SBP00061 | Blackberries | *Tistrella mobilis* |
| SBP00061 | Blackberries | *Treponema brennaborense* |
| SBP00061 | Blackberries | *Treponema caldarium* |
| SBP00061 | Blackberries | *Treponema denticola* |
| SBP00061 | Blackberries | *Treponema primitia* |
| SBP00061 | Blackberries | *Treponema* sp. OMZ 838 |
| SBP00061 | Blackberries | *Trichodesmium erythraeum* |
| SBP00061 | Blackberries | *Trichormus azollae* |
| SBP00061 | Blackberries | *Trichormus variabilis* |
| SBP00061 | Blackberries | *Trueperella bialowiezensis* |
| SBP00061 | Blackberries | *Tumebacillus avium* |
| SBP00061 | Blackberries | *Turicibacter* sp. H121 |
| SBP00061 | Blackberries | *Undibacterium parvum* |
| SBP00061 | Blackberries | *Ureibacillus thermosphaericus* |
| SBP00061 | Blackberries | *Variovorax boronicumulans* |
| SBP00061 | Blackberries | *Variovorax paradoxus* |
| SBP00061 | Blackberries | *Variovorax* sp. HW608 |
| SBP00061 | Blackberries | *Veillonella dispar* |
| SBP00061 | Blackberries | *Veillonella parvula* |
| SBP00061 | Blackberries | *Verminephrobacter eiseniae* |
| SBP00061 | Blackberries | *Verrucomicrobium spinosum* |
| SBP00061 | Blackberries | *Verrucosispora maris* |
| SBP00061 | Blackberries | *Vibrio alfacsensis* |
| SBP00061 | Blackberries | *Vibrio alginolyticus* |
| SBP00061 | Blackberries | *Vibrio anguillarum* |
| SBP00061 | Blackberries | *Vibrio campbellii* |
| SBP00061 | Blackberries | *Vibrio cholerae* |
| SBP00061 | Blackberries | *Vibrio crassostreae* |
| SBP00061 | Blackberries | *Vibrio cyclitrophicus* |
| SBP00061 | Blackberries | *Vibrio fluvialis* |
| SBP00061 | Blackberries | *Vibrio furnissii* |
| SBP00061 | Blackberries | *Vibrio gazogenes* |
| SBP00061 | Blackberries | *Vibrio harveyi* |
| SBP00061 | Blackberries | *Vibrio hyugaensis* |
| SBP00061 | Blackberries | *Vibrio mediterranei* |
| SBP00061 | Blackberries | *Vibrio natriegens* |
| SBP00061 | Blackberries | *Vibrio nigripulchritudo* |
| SBP00061 | Blackberries | *Vibrio owensii* |
| SBP00061 | Blackberries | *Vibrio parahaemolyticus* |
| SBP00061 | Blackberries | *Vibrio rumoiensis* |
| SBP00061 | Blackberries | *Vibrio tasmaniensis* |
| SBP00061 | Blackberries | *Vibrio virus* KVP40 |
| SBP00061 | Blackberries | *Vibrio vulnificus* |
| SBP00061 | Blackberries | *Virgibacillus halodenitrificans* |
| SBP00061 | Blackberries | *Virgibacillus necropolis* |
| SBP00061 | Blackberries | *Virgibacillus phasianinus* |
| SBP00061 | Blackberries | *Virgibacillus* sp. 6R |
| SBP00061 | Blackberries | *Virgibacillus* sp. Bac330 |
| SBP00061 | Blackberries | *Virgibacillus* sp. Bac332 |
| SBP00061 | Blackberries | *Vitreoscilla filiformis* |
| SBP00061 | Blackberries | *Vitreoscilla* sp. C1 |
| SBP00061 | Blackberries | *Vogesella* sp. LIG4 |
| SBP00061 | Blackberries | Walkabout Creek virus |
| SBP00061 | Blackberries | *Weeksella virosa* |
| SBP00061 | Blackberries | *Weissella cibaria* |
| SBP00061 | Blackberries | *Weissella confusa* |
| SBP00061 | Blackberries | *Weissella jogaejeotgali* |
| SBP00061 | Blackberries | *Weissella koreensis* |
| SBP00061 | Blackberries | *Wenzhouxiangella marina* |
| SBP00061 | Blackberries | *Winogradskyella* sp. PC-19 |
| SBP00061 | Blackberries | *Woeseia oceani* |
| SBP00061 | Blackberries | *Wolbachia* endosymbiont of *Cimex lectularius* |
| SBP00061 | Blackberries | *Wolbachia* endosymbiont of *Folsomia candida* |
| SBP00061 | Blackberries | *Xanthobacter autotrophicus* |
| SBP00061 | Blackberries | *Xanthomonas arboricola* |
| SBP00061 | Blackberries | *Xanthomonas campestris* |
| SBP00061 | Blackberries | *Xanthomonas cassavae* |
| SBP00061 | Blackberries | *Xanthomonas citri* |
| SBP00061 | Blackberries | *Xanthomonas fragariae* |
| SBP00061 | Blackberries | *Xanthomonas hortorum* |
| SBP00061 | Blackberries | *Xanthomonas oryzae* |

TABLE 3-continued

List of species identified in each metagenomic sample of each SBP Sample

| SBP ID | SBP Host Common Name | Genus sp. |
| --- | --- | --- |
| SBP00061 | Blackberries | *Xanthomonas vesicatoria* |
| SBP00061 | Blackberries | *Xenorhabdus bovienii* |
| SBP00061 | Blackberries | *Xenorhabdus nematophila* |
| SBP00061 | Blackberries | *Xenorhabdus poinarii* |
| SBP00061 | Blackberries | *Xylella fastidiosa* |
| SBP00061 | Blackberries | *Yangia pacifica* |
| SBP00061 | Blackberries | *Yersinia aldovae* |
| SBP00061 | Blackberries | *Yersinia enterocolitica* |
| SBP00061 | Blackberries | *Yersinia frederiksenii* |
| SBP00061 | Blackberries | *Zobellia galactanivorans* |
| SBP00061 | Blackberries | *Zunongwangia profunda* |
| SBP00062 | Raspberries | [*Brevibacterium*] *frigoritolerans* |
| SBP00062 | Raspberries | [*Clostridium*] *sphenoides* |
| SBP00062 | Raspberries | [*Clostridium*] *ultunense* |
| SBP00062 | Raspberries | [*Enterobacter*] *lignolyticus* |
| SBP00062 | Raspberries | [*Eubacterium*] *cellulosolvens* |
| SBP00062 | Raspberries | [*Eubacterium*] *hallii* |
| SBP00062 | Raspberries | [*Polyangium*] *brachysporum* |
| SBP00062 | Raspberries | *Acanthocystis turfacea chlorella* virus 1 |
| SBP00062 | Raspberries | *Acetoanaerobium sticklandii* |
| SBP00062 | Raspberries | *Acetobacter ascendens* |
| SBP00062 | Raspberries | *Acetobacteraceae bacterium* |
| SBP00062 | Raspberries | *Acetobacterium woodii* |
| SBP00062 | Raspberries | *Acholeplasma palmae* |
| SBP00062 | Raspberries | *Achromobacter denitrificans* |
| SBP00062 | Raspberries | *Achromobacter insolitus* |
| SBP00062 | Raspberries | *Achromobacter* sp. AONIH1 |
| SBP00062 | Raspberries | *Achromobacter* sp. B7 |
| SBP00062 | Raspberries | *Achromobacter spanius* |
| SBP00062 | Raspberries | *Achromobacter xylosoxidans* |
| SBP00062 | Raspberries | *Acidianus brierleyi* |
| SBP00062 | Raspberries | *Acidiferrobacter* sp. SPIII_3 |
| SBP00062 | Raspberries | *Acidipropionibacterium acidipropionici* |
| SBP00062 | Raspberries | *Acidovorax avenae* |
| SBP00062 | Raspberries | *Acidovorax citrulli* |
| SBP00062 | Raspberries | *Acidovorax* sp. 1608163 |
| SBP00062 | Raspberries | *Acidovorax* sp. KKS102 |
| SBP00062 | Raspberries | *Acinetobacter baumannii* |
| SBP00062 | Raspberries | *Acinetobacter calcoaceticus* |
| SBP00062 | Raspberries | *Acinetobacter defluvii* |
| SBP00062 | Raspberries | *Acinetobacter guillouiae* |
| SBP00062 | Raspberries | *Acinetobacter johnsonii* |
| SBP00062 | Raspberries | *Acinetobacter junii* |
| SBP00062 | Raspberries | *Acinetobacter radioresistens* |
| SBP00062 | Raspberries | *Acinetobacter schindleri* |
| SBP00062 | Raspberries | *Acinetobacter* sp. ACNIH1 |
| SBP00062 | Raspberries | *Acinetobacter* sp. ACNIH2 |
| SBP00062 | Raspberries | *Acinetobacter* sp. WCHA45 |
| SBP00062 | Raspberries | *Actinoalloteichus hoggarensis* |
| SBP00062 | Raspberries | *Actinoafloteichus* sp. AHMU CJ021 |
| SBP00062 | Raspberries | *Actinobacteria bacterium* IMCC19121 |
| SBP00062 | Raspberries | *Actinobacteria bacterium* IMCC26077 |
| SBP00062 | Raspberries | *Actinomadura amylolytica* |
| SBP00062 | Raspberries | *Actinomyces slackii* |
| SBP00062 | Raspberries | *Actinomyces* sp. 2129 |
| SBP00062 | Raspberries | *Actinomyces* sp. oral taxon 897 |
| SBP00062 | Raspberries | *Actinomyces* sp. Z16 |
| SBP00062 | Raspberries | *Actinoplanes friuliensis* |
| SBP00062 | Raspberries | *Actinoplanes* sp. ATCC 31351 |
| SBP00062 | Raspberries | *Actinoplanes* sp. N902-109 |
| SBP00062 | Raspberries | *Actinoplanes* sp. OR16 |
| SBP00062 | Raspberries | *Actinotignum schaalii* |
| SBP00062 | Raspberries | *Adlercreutzia equolifaciens* |
| SBP00062 | Raspberries | *Advenella kashmirensis* |
| SBP00062 | Raspberries | *Aerococcus sanguinicola* |
| SBP00062 | Raspberries | *Aeromicrobium erythreum* |
| SBP00062 | Raspberries | *Aeromonas caviae* |
| SBP00062 | Raspberries | *Aeromonas hydrophila* |
| SBP00062 | Raspberries | *Aeromonas media* |
| SBP00062 | Raspberries | *Aeromonas phage* phiAS5 |
| SBP00062 | Raspberries | *Aeromonas rivipollensis* |
| SBP00062 | Raspberries | *Aeromonas* sp. |
| SBP00062 | Raspberries | *Aeromonas veronii* |
| SBP00062 | Raspberries | *Afipia* sp. GAS231 |
| SBP00062 | Raspberries | *Agarilytica rhodophyticola* |
| SBP00062 | Raspberries | *Agrobacterium* sp. |

TABLE 3-continued

List of species identified in each metagenomic sample of each SBP Sample

| SBP ID | SBP Host Common Name | Genus sp. |
|---|---|---|
| SBP00062 | Raspberries | *Agrobacterium tumefaciens* |
| SBP00062 | Raspberries | *Agrobacterium vitis* |
| SBP00062 | Raspberries | *Agrococcus carbonis* |
| SBP00062 | Raspberries | *Agromyces* sp. LHK192 |
| SBP00062 | Raspberries | *Ahniella affigens* |
| SBP00062 | Raspberries | *Akkermansia muciniphila* |
| SBP00062 | Raspberries | *Alcaligenes faecalis* |
| SBP00062 | Raspberries | *Alcanivorax dieselolei* |
| SBP00062 | Raspberries | *Algoriphagus machipongonensis* |
| SBP00062 | Raspberries | *Aliivibrio fischeri* |
| SBP00062 | Raspberries | *Aliivibrio salmonicida* |
| SBP00062 | Raspberries | *Alkalilimnicola ehrlichii* |
| SBP00062 | Raspberries | *Alloactinosynnema* sp. L-07 |
| SBP00062 | Raspberries | *Allokutzneria albata* |
| SBP00062 | Raspberries | *Alteromonas australica* |
| SBP00062 | Raspberries | *Alteromonas macleodii* |
| SBP00062 | Raspberries | *Alteromonas mediterranea* |
| SBP00062 | Raspberries | *Alteromonas* sp. 76-1 |
| SBP00062 | Raspberries | *Alteromonas* sp. RWZA1 |
| SBP00062 | Raspberries | *Aminobacter aminovorans* |
| SBP00062 | Raspberries | *Aminobacter* sp. MSH1 |
| SBP00062 | Raspberries | *Aminomonas paucivorans* |
| SBP00062 | Raspberries | *Ammonifex degensii* |
| SBP00062 | Raspberries | *Amsacta moorei entomopoxvirus* |
| SBP00062 | Raspberries | *Amycolatopsis albispora* |
| SBP00062 | Raspberries | *Amycolatopsis keratiniphila* |
| SBP00062 | Raspberries | *Amycolatopsis methanolica* |
| SBP00062 | Raspberries | *Amycolatopsis* sp. AA4 |
| SBP00062 | Raspberries | *Amycolatopsis* sp. BJA-103 |
| SBP00062 | Raspberries | *Anabaenopsis circularis* |
| SBP00062 | Raspberries | *Anaerococcus mediterraneensis* |
| SBP00062 | Raspberries | *Anaerolinea thermophila* |
| SBP00062 | Raspberries | *Anaeromyxobacter dehalogenans* |
| SBP00062 | Raspberries | *Anaeromyxobacter* sp. K |
| SBP00062 | Raspberries | *Anaplasma phagocytophilum* |
| SBP00062 | Raspberries | *Aneurinibacillus soli* |
| SBP00062 | Raspberries | *Aneurinibacillus* sp. XH2 |
| SBP00062 | Raspberries | *Anoxybacillus flavithermus* |
| SBP00062 | Raspberries | *Anoxybacter fermentans* |
| SBP00062 | Raspberries | *Antarcticibacterium flavum* |
| SBP00062 | Raspberries | *Apibacter* sp. HY041 |
| SBP00062 | Raspberries | *Aquabacterium olei* |
| SBP00062 | Raspberries | *Aquiflexum balticum* |
| SBP00062 | Raspberries | *Aquimarina* sp. AD10 |
| SBP00062 | Raspberries | *Aquimarina* sp. BL5 |
| SBP00062 | Raspberries | *Aquitalea magnusonii* |
| SBP00062 | Raspberries | *Aquitalea* sp. THG-DN7.12 |
| SBP00062 | Raspberries | *Aquitalea* sp. USM4 |
| SBP00062 | Raspberries | *Arachidicoccus* sp. BS20 |
| SBP00062 | Raspberries | *Archaeoglobus fulgidus* |
| SBP00062 | Raspberries | *Archaeoglobus profundus* |
| SBP00062 | Raspberries | *Archangium gephyra* |
| SBP00062 | Raspberries | *Arcobacter bivalviorum* |
| SBP00062 | Raspberries | *Arcobacter nitrofigilis* |
| SBP00062 | Raspberries | *Arenibacter algicola* |
| SBP00062 | Raspberries | *Arthrobacter alpinus* |
| SBP00062 | Raspberries | *Arthrobacter crystallopoietes* |
| SBP00062 | Raspberries | *Arthrobacter* sp. ERGS1:01 |
| SBP00062 | Raspberries | *Arthrobacter* sp. PAMC 25486 |
| SBP00062 | Raspberries | *Arthrobacter* sp. PGP41 |
| SBP00062 | Raspberries | *Atlantibacter hermannii* |
| SBP00062 | Raspberries | *Auraticoccus monumenti* |
| SBP00062 | Raspberries | *Azoarcus communis* |
| SBP00062 | Raspberries | *Azoarcus* sp. SY39 |
| SBP00062 | Raspberries | *Azorhizobium caulinodans* |
| SBP00062 | Raspberries | *Azospirillum brasilense* |
| SBP00062 | Raspberries | *Azospirillum* sp. CFH 70021 |
| SBP00062 | Raspberries | *Azospirillum thiophilum* |
| SBP00062 | Raspberries | *Bacillus amyloliquefaciens* |
| SBP00062 | Raspberries | *Bacillus aryabhattai* |
| SBP00062 | Raspberries | *Bacillus asahii* |
| SBP00062 | Raspberries | *Bacillus atrophaeus* |
| SBP00062 | Raspberries | *Bacillus cellulosilyticus* |
| SBP00062 | Raspberries | *Bacillus cereus* |
| SBP00062 | Raspberries | *Bacillus ciccensis* |
| SBP00062 | Raspberries | *Bacillus circulans* |

TABLE 3-continued

List of species identified in each metagenomic sample of each SBP Sample

| SBP ID | SBP Host Common Name | Genus sp. |
|---|---|---|
| SBP00062 | Raspberries | Bacillus clausii |
| SBP00062 | Raspberries | Bacillus cytotoxicus |
| SBP00062 | Raspberries | Bacillus freudenreichii |
| SBP00062 | Raspberries | Bacillus gobiensis |
| SBP00062 | Raspberries | Bacillus halotolerans |
| SBP00062 | Raspberries | Bacillus horikoshii |
| SBP00062 | Raspberries | Bacillus kochii |
| SBP00062 | Raspberries | Bacillus lehensis |
| SBP00062 | Raspberries | Bacillus lentus |
| SBP00062 | Raspberries | Bacillus megaterium |
| SBP00062 | Raspberries | Bacillus mycoides |
| SBP00062 | Raspberries | Bacillus pseudomycoides |
| SBP00062 | Raspberries | Bacillus pumilus |
| SBP00062 | Raspberries | Bacillus safensis |
| SBP00062 | Raspberries | Bacillus sp. (in: Bacteria) |
| SBP00062 | Raspberries | Bacillus sp. 1NLA3E |
| SBP00062 | Raspberries | Bacillus sp. Y1 |
| SBP00062 | Raspberries | Bacillus subtilis |
| SBP00062 | Raspberries | Bacillus thuringiensis |
| SBP00062 | Raspberries | Bacillus vallismortis |
| SBP00062 | Raspberries | Bacillus velezensis |
| SBP00062 | Raspberries | Bacteriovorax stolpii |
| SBP00062 | Raspberries | Bacteroides caccae |
| SBP00062 | Raspberries | Bacteroides caecimuris |
| SBP00062 | Raspberries | Bacteroides dorei |
| SBP00062 | Raspberries | Bacteroides fragilis |
| SBP00062 | Raspberries | Bacteroides ovatus |
| SBP00062 | Raspberries | Bacteroides thetaiotaomicron |
| SBP00062 | Raspberries | Bacteroides vulgatus |
| SBP00062 | Raspberries | Bacteroides zoogleoformans |
| SBP00062 | Raspberries | Bartonella apis |
| SBP00062 | Raspberries | Bat associated circovirus 4 |
| SBP00062 | Raspberries | Bdellovibrio bacteriovorus |
| SBP00062 | Raspberries | Bdellovibrio exovorus |
| SBP00062 | Raspberries | Beijerinckiaceae bacterium |
| SBP00062 | Raspberries | Belliella baltica |
| SBP00062 | Raspberries | Beutenbergia cavernae |
| SBP00062 | Raspberries | Bifidobacterium angulatum |
| SBP00062 | Raspberries | Bifidobacterium breve |
| SBP00062 | Raspberries | Bifidobacterium dentium |
| SBP00062 | Raspberries | Blackberry Virus F |
| SBP00062 | Raspberries | Blastochloris sp. GI |
| SBP00062 | Raspberries | Blastomonas fulva |
| SBP00062 | Raspberries | Blautia sp. N6H1-15 |
| SBP00062 | Raspberries | Bordetella bronchialis |
| SBP00062 | Raspberries | Bordetella trematum |
| SBP00062 | Raspberries | Borrelia hermsii |
| SBP00062 | Raspberries | Borreliella afzelii |
| SBP00062 | Raspberries | Bosea sp. AS-1 |
| SBP00062 | Raspberries | Bosea vaviloviae |
| SBP00062 | Raspberries | Brachybacterium faecium |
| SBP00062 | Raspberries | Brachybacterium ginsengisoli |
| SBP00062 | Raspberries | Brachybacterium sp. P6-10-X1 |
| SBP00062 | Raspberries | Brachybacterium sp. VR2415 |
| SBP00062 | Raspberries | Brachyspira hampsonii |
| SBP00062 | Raspberries | Brachyspira murdochii |
| SBP00062 | Raspberries | Brachyspira pilosicoli |
| SBP00062 | Raspberries | Bradymonas sediminis |
| SBP00062 | Raspberries | Bradyrhizobium diazoefficiens |
| SBP00062 | Raspberries | Bradyrhizobium erythrophlei |
| SBP00062 | Raspberries | Bradyrhizobium guangdongense |
| SBP00062 | Raspberries | Bradyrhizobium guangxiense |
| SBP00062 | Raspberries | Bradyrhizobium icense |
| SBP00062 | Raspberries | Bradyrhizobium japonicum |
| SBP00062 | Raspberries | Bradyrhizobium lablabi |
| SBP00062 | Raspberries | Bradyrhizobium oligotrophicum |
| SBP00062 | Raspberries | Bradyrhizobium sp. |
| SBP00062 | Raspberries | Bradyrhizobium sp. BTAi1 |
| SBP00062 | Raspberries | Bradyrhizobium sp. CCBAU 51670 |
| SBP00062 | Raspberries | Bradyrhizobium sp. CCBAU 51778 |
| SBP00062 | Raspberries | Bradyrhizobium sp. ORS 278 |
| SBP00062 | Raspberries | Bradyrhizobium sp. ORS 285 |
| SBP00062 | Raspberries | Bradyrhizobium sp. ORS 3257 |
| SBP00062 | Raspberries | Bradyrhizobium sp. S23321 |
| SBP00062 | Raspberries | Bradyrhizobium sp. SK17 |
| SBP00062 | Raspberries | Brassica napus |

TABLE 3-continued

List of species identified in each metagenomic sample of each SBP Sample

| SBP ID | SBP Host Common Name | Genus sp. |
| --- | --- | --- |
| SBP00062 | Raspberries | *Breoghania* sp. L-A4 |
| SBP00062 | Raspberries | *Brevefilum fermentans* |
| SBP00062 | Raspberries | *Brevibacillus agri* |
| SBP00062 | Raspberries | *Brevibacillus brevis* |
| SBP00062 | Raspberries | *Brevibacillus laterosporus* |
| SBP00062 | Raspberries | *Brevibacterium aurantiacum* |
| SBP00062 | Raspberries | *Brevibacterium linens* |
| SBP00062 | Raspberries | *Brevibacterium siliguriense* |
| SBP00062 | Raspberries | *Brevundimonas diminuta* |
| SBP00062 | Raspberries | *Brevundimonas* sp. DS20 |
| SBP00062 | Raspberries | *Brochothrix thermosphacta* |
| SBP00062 | Raspberries | *Buchnera aphidicola* |
| SBP00062 | Raspberries | *Burkholderia anthina* |
| SBP00062 | Raspberries | *Burkholderia cenocepacia* |
| SBP00062 | Raspberries | *Burkholderia cepacia* |
| SBP00062 | Raspberries | *Burkholderia contaminans* |
| SBP00062 | Raspberries | *Burkholderia diffusa* |
| SBP00062 | Raspberries | *Burkholderia gladioli* |
| SBP00062 | Raspberries | *Burkholderia insecticola* |
| SBP00062 | Raspberries | *Burkholderia lata* |
| SBP00062 | Raspberries | *Burkholderia metallica* |
| SBP00062 | Raspberries | *Burkholderia multivorans* |
| SBP00062 | Raspberries | *Burkholderia pseudomallei* |
| SBP00062 | Raspberries | *Burkholderia* sp. MSMB0852 |
| SBP00062 | Raspberries | *Burkholderia* sp. NRF60-BP8 |
| SBP00062 | Raspberries | *Burkholderia* sp. OLGA172 |
| SBP00062 | Raspberries | *Burkholderia stabilis* |
| SBP00062 | Raspberries | *Burkholderia stagnalis* |
| SBP00062 | Raspberries | *Burkholderia territorii* |
| SBP00062 | Raspberries | *Burkholderia ubonensis* |
| SBP00062 | Raspberries | *Burkholderia vietnamiensis* |
| SBP00062 | Raspberries | *Burkholderiales bacterium* JOSHI_001 |
| SBP00062 | Raspberries | *Butyrivibrio fibrisolvens* |
| SBP00062 | Raspberries | *Butyrivibrio hungatei* |
| SBP00062 | Raspberries | *Caldicellulosiruptor kronotskyensis* |
| SBP00062 | Raspberries | *Caldisericum exile* |
| SBP00062 | Raspberries | *Caldithrix abyssi* |
| SBP00062 | Raspberries | *Calothrix brevissima* |
| SBP00062 | Raspberries | *Calothrix parasitica* |
| SBP00062 | Raspberries | *Calothrix* sp. NIES-2098 |
| SBP00062 | Raspberries | *Calothrix* sp. NIES-2100 |
| SBP00062 | Raspberries | *Calothrix* sp. PCC 7507 |
| SBP00062 | Raspberries | *Campylobacter concisus* |
| SBP00062 | Raspberries | *Campylobacter fetus* |
| SBP00062 | Raspberries | *Campylobacter hyointestinalis* |
| SBP00062 | Raspberries | *Campylobacter jejuni* |
| SBP00062 | Raspberries | *Campylobacter pinnipediorum* |
| SBP00062 | Raspberries | *Candidatus Azobacteroides pseudotrichonymphae* |
| SBP00062 | Raspberries | *Candidatus Baumannia cicadellinicola* |
| SBP00062 | Raspberries | *Candidatus Bipolaricaulis anaerobius* |
| SBP00062 | Raspberries | *Candidatus Cloacimonas acidaminovorans* |
| SBP00062 | Raspberries | *Candidatus Cyclonatronum proteinivorum* |
| SBP00062 | Raspberries | *Candidatus Filomicrobium marinum* |
| SBP00062 | Raspberries | *Candidatus Fukatsuia symbiotica* |
| SBP00062 | Raspberries | *Candidatus Kinetoplastibacterium crithidii* |
| SBP00062 | Raspberries | *Candidatus Kuenenia stuttgartiensis* |
| SBP00062 | Raspberries | *Candidatus Methanoplasma termitum* |
| SBP00062 | Raspberries | *Candidatus Nitrosomarinus catalina* |
| SBP00062 | Raspberries | *Candidatus Nitrosotenuis aquarius* |
| SBP00062 | Raspberries | *Candidatus Nucleicultrix amoebiphila* |
| SBP00062 | Raspberries | *Candidatus Pelagibacter* sp. RS39 |
| SBP00062 | Raspberries | *Candidatus Planktophila limnetica* |
| SBP00062 | Raspberries | *Candidatus Planktophila versatilis* |
| SBP00062 | Raspberries | *Candidatus Portiera aleyrodidarum* |
| SBP00062 | Raspberries | *Candidatus Promineofilum breve* |
| SBP00062 | Raspberries | *Candidatus Rhodoluna limnophila* |
| SBP00062 | Raspberries | *Candidatus Rickettsiella viridis* |
| SBP00062 | Raspberries | *Candidatus Sodalis pierantonius* |
| SBP00062 | Raspberries | *Candidatus Thiodictyon syntrophicum* |
| SBP00062 | Raspberries | *Candidatus Thioglobus singularis* |
| SBP00062 | Raspberries | *Capnocytophaga canimorsus* |
| SBP00062 | Raspberries | *Capnocytophaga gingivalis* |
| SBP00062 | Raspberries | *Capnocytophaga* sp. H4358 |
| SBP00062 | Raspberries | *Capnocytophaga sputigena* |
| SBP00062 | Raspberries | *Carnobacterium maltaromaticum* |
| SBP00062 | Raspberries | *Carnobacterium* sp. 17-4 |

TABLE 3-continued

List of species identified in each metagenomic sample of each SBP Sample

| SBP ID | SBP Host Common Name | Genus sp. |
|---|---|---|
| SBP00062 | Raspberries | *Catenulispora acidiphila* |
| SBP00062 | Raspberries | *Caulobacter segnis* |
| SBP00062 | Raspberries | *Caulobacter* sp. K31 |
| SBP00062 | Raspberries | *Caviid betaherpesvirus* 2 |
| SBP00062 | Raspberries | *Celeribacter baekdonensis* |
| SBP00062 | Raspberries | *Celeribacter ethanolicus* |
| SBP00062 | Raspberries | *Celeribacter marinus* |
| SBP00062 | Raspberries | *Cellulomonas flavigena* |
| SBP00062 | Raspberries | *Cellulophaga lytica* |
| SBP00062 | Raspberries | *Cellulosimicrobium cellulans* |
| SBP00062 | Raspberries | *Cellvibrio japonicus* |
| SBP00062 | Raspberries | *Chamaesiphon minutus* |
| SBP00062 | Raspberries | *Chania multitudinisentens* |
| SBP00062 | Raspberries | *Chelativorans* sp. BNC1 |
| SBP00062 | Raspberries | *Chelatococcus* sp. CO-6 |
| SBP00062 | Raspberries | *Chitinophaga pinensis* |
| SBP00062 | Raspberries | *Chitinophaga* sp. MD30 |
| SBP00062 | Raspberries | *Chlorobium chlorochromatii* |
| SBP00062 | Raspberries | *Chondromyces crocatus* |
| SBP00062 | Raspberries | *Chromatiaceae bacterium* 2141T.STBD.0c.01a |
| SBP00062 | Raspberries | *Chromobacterium* sp. ATCC 53434 |
| SBP00062 | Raspberries | *Chromobacterium vaccinii* |
| SBP00062 | Raspberries | *Chroococcidiopsis thermalis* |
| SBP00062 | Raspberries | *Chryseobacterium antarcticum* |
| SBP00062 | Raspberries | *Chryseobacterium bernardetil* |
| SBP00062 | Raspberries | *Chryseobacterium carnipullorum* |
| SBP00062 | Raspberries | *Chryseobacterium gleum* |
| SBP00062 | Raspberries | *Chryseobacterium haifense* |
| SBP00062 | Raspberries | *Chryseobacterium indologenes* |
| SBP00062 | Raspberries | *Chryseobacterium jeonii* |
| SBP00062 | Raspberries | *Chryseobacterium joostei* |
| SBP00062 | Raspberries | *Chryseobacterium lactis* |
| SBP00062 | Raspberries | *Chryseobacterium nakagawai* |
| SBP00062 | Raspberries | *Chryseobacterium piperi* |
| SBP00062 | Raspberries | *Chryseobacterium shandongense* |
| SBP00062 | Raspberries | *Chryseobacterium* sp. 17S1E7 |
| SBP00062 | Raspberries | *Chryseobacterium* sp. 6424 |
| SBP00062 | Raspberries | *Chryseobacterium* sp. T16E-39 |
| SBP00062 | Raspberries | *Chryseobacterium taklimakanense* |
| SBP00062 | Raspberries | *Citrobacter freundii* |
| SBP00062 | Raspberries | *Citrobacter koseri* |
| SBP00062 | Raspberries | *Clavibacter michiganensis* |
| SBP00062 | Raspberries | *Clostridiales bacterium* 70B-A |
| SBP00062 | Raspberries | *Clostridiales bacterium* CCNA10 |
| SBP00062 | Raspberries | *Clostridioides difficile* |
| SBP00062 | Raspberries | *Clostridium aceticum* |
| SBP00062 | Raspberries | *Clostridium acetobutylicum* |
| SBP00062 | Raspberries | *Clostridium argentinense* |
| SBP00062 | Raspberries | *Clostridium beijerinckii* |
| SBP00062 | Raspberries | *Clostridium botulinum* |
| SBP00062 | Raspberries | *Clostridium carboxidivorans* |
| SBP00062 | Raspberries | *Clostridium estertheticum* |
| SBP00062 | Raspberries | *Clostridium ljungdahlii* |
| SBP00062 | Raspberries | *Clostridium novyi* |
| SBP00062 | Raspberries | *Clostridium pasteurianum* |
| SBP00062 | Raspberries | *Clostridium perfringens* |
| SBP00062 | Raspberries | *Clostridium septicum* |
| SBP00062 | Raspberries | *Clostridium* sp. AWRP |
| SBP00062 | Raspberries | *Clostridium* sp. CT4 |
| SBP00062 | Raspberries | *Clostridium* sp. DL-VIII |
| SBP00062 | Raspberries | *Clostridium taeniosporum* |
| SBP00062 | Raspberries | *Clostridium tetani* |
| SBP00062 | Raspberries | *Collimonas arenae* |
| SBP00062 | Raspberries | *Collimonas fungivorans* |
| SBP00062 | Raspberries | *Colwellia psychrerythraea* |
| SBP00062 | Raspberries | *Colwellia* sp. MT41 |
| SBP00062 | Raspberries | *Comamonas aquatica* |
| SBP00062 | Raspberries | *Comamonas serinivorans* |
| SBP00062 | Raspberries | *Commensalibacter* sp. AMU001 |
| SBP00062 | Raspberries | *Conexibacter woesei* |
| SBP00062 | Raspberries | *Corallococcus coralloides* |
| SBP00062 | Raspberries | *Corynebacterium argentoratense* |
| SBP00062 | Raspberries | *Corynebacterium callunae* |
| SBP00062 | Raspberries | *Corynebacterium casei* |
| SBP00062 | Raspberries | *Corynebacterium diphtheriae* |
| SBP00062 | Raspberries | *Corynebacterium flavescens* |

TABLE 3-continued

List of species identified in each metagenomic sample of each SBP Sample

| SBP ID | SBP Host Common Name | Genus sp. |
| --- | --- | --- |
| SBP00062 | Raspberries | *Corynebacterium frankenforstense* |
| SBP00062 | Raspberries | *Corynebacterium glutamicum* |
| SBP00062 | Raspberries | *Corynebacterium glyciniphilum* |
| SBP00062 | Raspberries | *Corynebacterium halotolerans* |
| SBP00062 | Raspberries | *Corynebacterium imitans* |
| SBP00062 | Raspberries | *Corynebacterium kroppenstedtii* |
| SBP00062 | Raspberries | *Corynebacterium maris* |
| SBP00062 | Raspberries | *Corynebacterium mycetoides* |
| SBP00062 | Raspberries | *Corynebacterium phocae* |
| SBP00062 | Raspberries | *Corynebacterium provencense* |
| SBP00062 | Raspberries | *Corynebacterium renale* |
| SBP00062 | Raspberries | *Corynebacterium riegelii* |
| SBP00062 | Raspberries | *Corynebacterium simulans* |
| SBP00062 | Raspberries | *Corynebacterium singulare* |
| SBP00062 | Raspberries | *Corynebacterium* sp. 2183 |
| SBP00062 | Raspberries | *Corynebacterium* sp. 2184 |
| SBP00062 | Raspberries | *Corynebacterium stationis* |
| SBP00062 | Raspberries | *Corynebacterium terpenotabidum* |
| SBP00062 | Raspberries | *Corynebacterium ulcerans* |
| SBP00062 | Raspberries | *Corynebacterium variabile* |
| SBP00062 | Raspberries | *Corynebacterium xerosis* |
| SBP00062 | Raspberries | *Coxiella burnetii* |
| SBP00062 | Raspberries | *Croceicoccus marinus* |
| SBP00062 | Raspberries | *Cronobacter phage* vB_CsaM_GAP32 |
| SBP00062 | Raspberries | *Cronobacter sakazakii* |
| SBP00062 | Raspberries | *Cryobacterium* sp. GCJ02 |
| SBP00062 | Raspberries | *Cryobacterium* sp. LW097 |
| SBP00062 | Raspberries | *Cupriavidus basilensis* |
| SBP00062 | Raspberries | *Cupriavidus gilardii* |
| SBP00062 | Raspberries | *Cupriavidus metallidurans* |
| SBP00062 | Raspberries | *Cupriavidus necator* |
| SBP00062 | Raspberries | *Cupriavidus* sp. USMAA2-4 |
| SBP00062 | Raspberries | *Cupriavidus taiwanensis* |
| SBP00062 | Raspberries | *Curtobacterium pusillum* |
| SBP00062 | Raspberries | *Curvibacter* sp. AEP1-3 |
| SBP00062 | Raspberries | *Cutibacterium acnes* |
| SBP00062 | Raspberries | *Cyanothece* sp. ATCC 51142 |
| SBP00062 | Raspberries | *Cyanothece* sp. PCC 7424 |
| SBP00062 | Raspberries | *Cyanothece* sp. PCC 7425 |
| SBP00062 | Raspberries | *Cyprinid* herpesvirus 3 |
| SBP00062 | Raspberries | *Cystobacter fuscus* |
| SBP00062 | Raspberries | *Cytophaga hutchinsonii* |
| SBP00062 | Raspberries | *Dactylococcopsis salina* |
| SBP00062 | Raspberries | *Dechloromonas aromatica* |
| SBP00062 | Raspberries | *Dehalobacter* sp. DCA |
| SBP00062 | Raspberries | *Dehalobacterium formicoaceticum* |
| SBP00062 | Raspberries | *Dehalococcoides mccartyi* |
| SBP00062 | Raspberries | *Dehalogenimonas formicexedens* |
| SBP00062 | Raspberries | *Deinococcus actinosclerus* |
| SBP00062 | Raspberries | *Deinococcus deserti* |
| SBP00062 | Raspberries | *Deinococcus ficus* |
| SBP00062 | Raspberries | *Deinococcus maricopensis* |
| SBP00062 | Raspberries | *Deinococcus peraridilitoris* |
| SBP00062 | Raspberries | *Deinococcus radiodurans* |
| SBP00062 | Raspberries | *Deinococcus swuensis* |
| SBP00062 | Raspberries | *Delftia acidovorans* |
| SBP00062 | Raspberries | *Delftia* sp. |
| SBP00062 | Raspberries | *Delftia* sp. Cs1-4 |
| SBP00062 | Raspberries | *Delftia* sp. HK171 |
| SBP00062 | Raspberries | *Delftia tsuruhatensis* |
| SBP00062 | Raspberries | *Denitrovibrio acetiphilus* |
| SBP00062 | Raspberries | *Dermabacter vaginalis* |
| SBP00062 | Raspberries | *Dermatophilus congolensis* |
| SBP00062 | Raspberries | *Desulfitobacterium dehalogenans* |
| SBP00062 | Raspberries | *Desulfitobacterium metallireducens* |
| SBP00062 | Raspberries | *Desulfobacter hydrogenophilus* |
| SBP00062 | Raspberries | *Desulfohalobium retbaense* |
| SBP00062 | Raspberries | *Desulfosporosinus acidiphilus* |
| SBP00062 | Raspberries | *Desulfosporosinus orientis* |
| SBP00062 | Raspberries | *Desulfotalea psychrophila* |
| SBP00062 | Raspberries | *Desulfotomaculum ferrireducens* |
| SBP00062 | Raspberries | *Desulfotomaculum reducens* |
| SBP00062 | Raspberries | *Desulfuromonas soudanensis* |
| SBP00062 | Raspberries | *Desulfuromonas* sp. DDH964 |
| SBP00062 | Raspberries | *Devosia* sp. A16 |
| SBP00062 | Raspberries | *Diaphorobacter polyhydroxybutyrativorans* |

TABLE 3-continued

List of species identified in each metagenomic sample of each SBP Sample

| SBP ID | SBP Host Common Name | Genus sp. |
| --- | --- | --- |
| SBP00062 | Raspberries | *Dickeya dianthicola* |
| SBP00062 | Raspberries | *Dietzia lutea* |
| SBP00062 | Raspberries | *Dietzia psychralcaliphila* |
| SBP00062 | Raspberries | *Dietzia* sp. JS16-p6b |
| SBP00062 | Raspberries | *Dietzia* sp. oral taxon 368 |
| SBP00062 | Raspberries | *Dietzia timorensis* |
| SBP00062 | Raspberries | *Dinoroseobacter shibae* |
| SBP00062 | Raspberries | *Diolcogaster facetosa bracovirus* |
| SBP00062 | Raspberries | *Dokdonella koreensis* |
| SBP00062 | Raspberries | *Dokdonia* sp. PRO95 |
| SBP00062 | Raspberries | *Dyadobacter fermentans* |
| SBP00062 | Raspberries | *Dyella japonica* |
| SBP00062 | Raspberries | *Dyella* sp. M7H15-1 |
| SBP00062 | Raspberries | *Dyella thiooxydans* |
| SBP00062 | Raspberries | *Echinicola rosea* |
| SBP00062 | Raspberries | *Edwardsiella hoshinae* |
| SBP00062 | Raspberries | *Eggerthella* sp. YY7918 |
| SBP00062 | Raspberries | *Egibacter rhizosphaerae* |
| SBP00062 | Raspberries | *Elizabethkingia anophelis* |
| SBP00062 | Raspberries | *Elizabethkingia meningoseptica* |
| SBP00062 | Raspberries | *Endozoicomonas montiporae* |
| SBP00062 | Raspberries | *Ensifer adhaerens* |
| SBP00062 | Raspberries | *Enterobacter asburiae* |
| SBP00062 | Raspberries | *Enterobacter cloacae* |
| SBP00062 | Raspberries | *Enterobacter ludwigii* |
| SBP00062 | Raspberries | *Enterobacter* sp. Crenshaw |
| SBP00062 | Raspberries | *Enterobacter* sp. N18-03635 |
| SBP00062 | Raspberries | *Enterobacter* sp. ODB01 |
| SBP00062 | Raspberries | *Enterococcus faecalis* |
| SBP00062 | Raspberries | *Enterococcus faecium* |
| SBP00062 | Raspberries | *Enterococcus mundtii* |
| SBP00062 | Raspberries | *Ereboglobus luteus* |
| SBP00062 | Raspberries | *Erwinia phage* vB_EamM_ChrisDB |
| SBP00062 | Raspberries | *Erysipelothrix larvae* |
| SBP00062 | Raspberries | *Erysipelotrichaceae bacterium* GAM147 |
| SBP00062 | Raspberries | *Erythrobacter* sp. Alg231-14 |
| SBP00062 | Raspberries | *Escherichia coli* |
| SBP00062 | Raspberries | *Eubacterium maltosivorans* |
| SBP00062 | Raspberries | *Euzebya* sp. DY32-46 |
| SBP00062 | Raspberries | *Fabibacter pacificus* |
| SBP00062 | Raspberries | *Faecalibacterium prausnitzii* |
| SBP00062 | Raspberries | *Ferrimonas balearica* |
| SBP00062 | Raspberries | *Ferroglobus placidus* |
| SBP00062 | Raspberries | *Fervidobacterium islandicum* |
| SBP00062 | Raspberries | *Fictibacillus phosphorivorans* |
| SBP00062 | Raspberries | *Filifactor alocis* |
| SBP00062 | Raspberries | *Filimonas lacunae* |
| SBP00062 | Raspberries | *Fischerella* sp. NIES-3754 |
| SBP00062 | Raspberries | *Fischerella* sp. NIES-4106 |
| SBP00062 | Raspberries | *Flammeovirga* sp. L12M1 |
| SBP00062 | Raspberries | *Flammeovirga* sp. MY04 |
| SBP00062 | Raspberries | *Flavisolibacter* sp. 17J28-1 |
| SBP00062 | Raspberries | *Flavivirga eckloniae* |
| SBP00062 | Raspberries | *Flavobacteriaceae bacterium* MAR_2010_188 |
| SBP00062 | Raspberries | *Flavobacteriaceae bacterium* UJ101 |
| SBP00062 | Raspberries | *Flavobacterium anhuiense* |
| SBP00062 | Raspberries | *Flavobacterium arcticum* |
| SBP00062 | Raspberries | *Flavobacterium columnare* |
| SBP00062 | Raspberries | *Flavobacterium commune* |
| SBP00062 | Raspberries | *Flavobacterium crocinum* |
| SBP00062 | Raspberries | *Flavobacterium faecale* |
| SBP00062 | Raspberries | *Flavobacterium gilvum* |
| SBP00062 | Raspberries | *Flavobacterium kingsejongi* |
| SBP00062 | Raspberries | *Formosa* sp. Hel1_31_208 |
| SBP00062 | Raspberries | *Formosa* sp. Hel3_A1_48 |
| SBP00062 | Raspberries | *Francisella hispaniensis* |
| SBP00062 | Raspberries | *Francisella* sp. TX077308 |
| SBP00062 | Raspberries | *Frankia alni* |
| SBP00062 | Raspberries | *Frankia inefficax* |
| SBP00062 | Raspberries | *Frankia* sp. EAN1pec |
| SBP00062 | Raspberries | *Frankia* symbiont of *Datisca glomerata* |
| SBP00062 | Raspberries | *Frateuria aurantia* |
| SBP00062 | Raspberries | *Frischella perrara* |
| SBP00062 | Raspberries | *Frondihabitans* sp. PAMC 28766 |
| SBP00062 | Raspberries | *Fuerstia marisgermanicae* |
| SBP00062 | Raspberries | *Fusobacterium hwasookii* |

TABLE 3-continued

List of species identified in each metagenomic sample of each SBP Sample

| SBP ID | SBP Host Common Name | Genus sp. |
|---|---|---|
| SBP00062 | Raspberries | *Fusobacterium necrophorum* |
| SBP00062 | Raspberries | *Fusobacterium nucleatum* |
| SBP00062 | Raspberries | *Fusobacterium periodonticum* |
| SBP00062 | Raspberries | *Fusobacterium varium* |
| SBP00062 | Raspberries | *Gallaecimonas* sp. HK-28 |
| SBP00062 | Raspberries | *Gallibacterium anatis* |
| SBP00062 | Raspberries | gamma proteobacterium HdN1 |
| SBP00062 | Raspberries | Gammaproteobacteria bacterium ESL0073 |
| SBP00062 | Raspberries | *Gardnerella vaginalis* |
| SBP00062 | Raspberries | *Gemella morbillorum* |
| SBP00062 | Raspberries | *Geminocystis herdmanii* |
| SBP00062 | Raspberries | *Geminocystis* sp. NIES-3708 |
| SBP00062 | Raspberries | *Gemmata obscuriglobus* |
| SBP00062 | Raspberries | *Gemmatimonas aurantiaca* |
| SBP00062 | Raspberries | *Gemmatirosa kalamazoonesis* |
| SBP00062 | Raspberries | *Geobacillus subterraneus* |
| SBP00062 | Raspberries | *Geobacter anodireducens* |
| SBP00062 | Raspberries | *Geobacter metallireducens* |
| SBP00062 | Raspberries | *Geobacter uraniireducens* |
| SBP00062 | Raspberries | *Geodermatophilus obscurus* |
| SBP00062 | Raspberries | *Georgenia* sp. ZLJ0423 |
| SBP00062 | Raspberries | *Geosporobacter ferrireducens* |
| SBP00062 | Raspberries | *Gillisia* sp. Hel1_33_143 |
| SBP00062 | Raspberries | *Glaciecola nitratireducens* |
| SBP00062 | Raspberries | *Glaciecola* sp. 4H-3-7 + YE-5 |
| SBP00062 | Raspberries | *Gloeocapsa* sp. PCC 7428 |
| SBP00062 | Raspberries | *Gluconacetobacter diazotrophicus* |
| SBP00062 | Raspberries | *Gluconobacter albidus* |
| SBP00062 | Raspberries | *Gluconobacter oxydans* |
| SBP00062 | Raspberries | *Glutamicibacter arilaitensis* |
| SBP00062 | Raspberries | *Glutamicibacter nicotianae* |
| SBP00062 | Raspberries | *Gordonia bronchialis* |
| SBP00062 | Raspberries | *Gordonia iterans* |
| SBP00062 | Raspberries | *Gordonia* sp. 1D |
| SBP00062 | Raspberries | *Gordonia* sp. KTR9 |
| SBP00062 | Raspberries | *Gordonia* sp. MMS17-SY073 |
| SBP00062 | Raspberries | *Gordonia* sp. YC-JH1 |
| SBP00062 | Raspberries | *Gordonia terrae* |
| SBP00062 | Raspberries | *Gordonibacter massiliensis* |
| SBP00062 | Raspberries | *Gramella salexigens* |
| SBP00062 | Raspberries | *Haemophilus influenzae* |
| SBP00062 | Raspberries | *Hafnia alvei* |
| SBP00062 | Raspberries | *Halanaeroarchaeum sulfurireducens* |
| SBP00062 | Raspberries | *Haliangium ochraceum* |
| SBP00062 | Raspberries | *Haliscomenobacter hydrossis* |
| SBP00062 | Raspberries | *Halobiforma lacisalsi* |
| SBP00062 | Raspberries | *Halomonas aestuarii* |
| SBP00062 | Raspberries | *Halomonas chromatireducens* |
| SBP00062 | Raspberries | *Halomonas huangheensis* |
| SBP00062 | Raspberries | *Halomonas* sp. JS92-SW72 |
| SBP00062 | Raspberries | *Halorhodospira halophila* |
| SBP00062 | Raspberries | *Halorubrum ezzemoulense* |
| SBP00062 | Raspberries | *Halorubrum* sp. PV6 |
| SBP00062 | Raspberries | *Halotalea alkalilenta* |
| SBP00062 | Raspberries | *Haloterrigena daqingensis* |
| SBP00062 | Raspberries | *Haloterrigena jeotgali* |
| SBP00062 | Raspberries | *Haloterrigena turkmenica* |
| SBP00062 | Raspberries | *Hartmannibacter diazotrophicus* |
| SBP00062 | Raspberries | *Hathewaya histolytica* |
| SBP00062 | Raspberries | *Helicobacter bilis* |
| SBP00062 | Raspberries | *Helicobacter cholecystus* |
| SBP00062 | Raspberries | *Helicobacter felis* |
| SBP00062 | Raspberries | *Helicobacter mustelae* |
| SBP00062 | Raspberries | *Helicobacter pylori* |
| SBP00062 | Raspberries | *Herbaspirillum hiltneri* |
| SBP00062 | Raspberries | *Herbaspirillum huttiense* |
| SBP00062 | Raspberries | *Herbaspirillum robiniae* |
| SBP00062 | Raspberries | *Herbaspirillum rubrisubalbicans* |
| SBP00062 | Raspberries | *Herbaspirillum seropedicae* |
| SBP00062 | Raspberries | *Herbaspirillum* sp. meg3 |
| SBP00062 | Raspberries | *Herminiimonas arsenicoxydans* |
| SBP00062 | Raspberries | Hubei sobemo-like virus 37 |
| SBP00062 | Raspberries | Human betaherpesvirus 5 |
| SBP00062 | Raspberries | *Hungatella hathewayi* |
| SBP00062 | Raspberries | *Hydrogenophaga crassostreae* |
| SBP00062 | Raspberries | *Hydrogenophaga* sp. RAC07 |

TABLE 3-continued

List of species identified in each metagenomic sample of each SBP Sample

| SBP ID | SBP Host Common Name | Genus sp. |
|---|---|---|
| SBP00062 | Raspberries | Hydrogenophilus thermoluteolus |
| SBP00062 | Raspberries | Hylemonella gracilis |
| SBP00062 | Raspberries | Hymenobacter nivis |
| SBP00062 | Raspberries | Hymenobacter sp. 17J68-5 |
| SBP00062 | Raspberries | Hymenobacter sp. DG25B |
| SBP00062 | Raspberries | Hymenobacter sp. sh-6 |
| SBP00062 | Raspberries | Idiomarina piscisalsi |
| SBP00062 | Raspberries | Ignicoccus hospitalis |
| SBP00062 | Raspberries | Intestinimonas butyriciproducens |
| SBP00062 | Raspberries | Intrasporangium calvum |
| SBP00062 | Raspberries | Jannaschia sp. CCS1 |
| SBP00062 | Raspberries | Janthinobacterium agaricidamnosum |
| SBP00062 | Raspberries | Janthinobacterium sp. LM6 |
| SBP00062 | Raspberries | Janthinobacterium svalbardensis |
| SBP00062 | Raspberries | Jatrophihabitans sp. GAS493 |
| SBP00062 | Raspberries | Jeongeupia sp. USM3 |
| SBP00062 | Raspberries | Jeotgalibaca sp. PTS2502 |
| SBP00062 | Raspberries | Jiangella alkaliphila |
| SBP00062 | Raspberries | Jiangella sp. DSM 45060 |
| SBP00062 | Raspberries | Jonesia denitrificans |
| SBP00062 | Raspberries | Kangiella profundi |
| SBP00062 | Raspberries | Kineococcus radiotolerans |
| SBP00062 | Raspberries | Kitasatospora albolonga |
| SBP00062 | Raspberries | Kitasatospora aureofaciens |
| SBP00062 | Raspberries | Kitasatospora setae |
| SBP00062 | Raspberries | Kitasatospora sp. MMS16-BH015 |
| SBP00062 | Raspberries | Klebsiella aerogenes |
| SBP00062 | Raspberries | Klebsiella michiganensis |
| SBP00062 | Raspberries | Klebsiella pneumoniae |
| SBP00062 | Raspberries | Klebsiella quasipneumoniae |
| SBP00062 | Raspberries | Klebsiella sp. FDAARGOS_511 |
| SBP00062 | Raspberries | Klebsiella variicola |
| SBP00062 | Raspberries | Kocuria indica |
| SBP00062 | Raspberries | Kocuria rosea |
| SBP00062 | Raspberries | Kocuria turfanensis |
| SBP00062 | Raspberries | Komagataeibacter nataicola |
| SBP00062 | Raspberries | Kosakonia cowanii |
| SBP00062 | Raspberries | Kribbella flavida |
| SBP00062 | Raspberries | Kytococcus sedentarius |
| SBP00062 | Raspberries | Lachnoclostridium sp. YL32 |
| SBP00062 | Raspberries | Lacinutrix sp. Bg11-31 |
| SBP00062 | Raspberries | Lacinutrix venerupis |
| SBP00062 | Raspberries | Lactobacillus allii |
| SBP00062 | Raspberries | Lactobacillus amylovorus |
| SBP00062 | Raspberries | Lactobacillus animalis |
| SBP00062 | Raspberries | Lactobacillus apis |
| SBP00062 | Raspberries | Lactobacillus brevis |
| SBP00062 | Raspberries | Lactobacillus casei |
| SBP00062 | Raspberries | Lactobacillus coryniformis |
| SBP00062 | Raspberries | Lactobacillus crispatus |
| SBP00062 | Raspberries | Lactobacillus curvatus |
| SBP00062 | Raspberries | Lactobacillus delbrueckii |
| SBP00062 | Raspberries | Lactobacillus johnsonii |
| SBP00062 | Raspberries | Lactobacillus kunkeei |
| SBP00062 | Raspberries | Lactobacillus paracasei |
| SBP00062 | Raspberries | Lactobacillus reuteri |
| SBP00062 | Raspberries | Lactobacillus rhamnosus |
| SBP00062 | Raspberries | Lactobacillus terrae |
| SBP00062 | Raspberries | Lactobacillus zymae |
| SBP00062 | Raspberries | Lactococcus garvieae |
| SBP00062 | Raspberries | Lactococcus lactis |
| SBP00062 | Raspberries | Leadbetterella byssophila |
| SBP00062 | Raspberries | Leclercia adecarboxylata |
| SBP00062 | Raspberries | Legionella cherrii |
| SBP00062 | Raspberries | Legionella clemsonensis |
| SBP00062 | Raspberries | Legionella hackeliae |
| SBP00062 | Raspberries | Legionella lansingensis |
| SBP00062 | Raspberries | Legionella longbeachae |
| SBP00062 | Raspberries | Legionella oakridgensis |
| SBP00062 | Raspberries | Legionella pneumophila |
| SBP00062 | Raspberries | Legionella sainthelensi |
| SBP00062 | Raspberries | Leisingera aquaemixtae |
| SBP00062 | Raspberries | Lelliottia amnigena |
| SBP00062 | Raspberries | Lelliottia jeotgali |
| SBP00062 | Raspberries | Lelliottia nimipressuralis |
| SBP00062 | Raspberries | Lentibacillus amyloliquefaciens |

TABLE 3-continued

List of species identified in each metagenomic sample of each SBP Sample

| SBP ID | SBP Host Common Name | Genus sp. |
|---|---|---|
| SBP00062 | Raspberries | *Lentzea guizhouensis* |
| SBP00062 | Raspberries | *Leptolyngbya boryana* |
| SBP00062 | Raspberries | *Leptolyngbya* sp. NIES-3755 |
| SBP00062 | Raspberries | *Leptolyngbya* sp. PCC 6402 |
| SBP00062 | Raspberries | *Leptolyngbya* sp. PCC 7376 |
| SBP00062 | Raspberries | *Leptospira borgpetersenii* |
| SBP00062 | Raspberries | *Leptospira interrogans* |
| SBP00062 | Raspberries | *Leptospira santarosai* |
| SBP00062 | Raspberries | *Leptospirillum ferrooxidans* |
| SBP00062 | Raspberries | *Leucania separata* nucleopolyhedrovirus |
| SBP00062 | Raspberries | *Leucobacter triazinivorans* |
| SBP00062 | Raspberries | *Libanicoccus massiliensis* |
| SBP00062 | Raspberries | *Limnochorda pilosa* |
| SBP00062 | Raspberries | *Listeria innocua* |
| SBP00062 | Raspberries | *Listeria monocytogenes* |
| SBP00062 | Raspberries | *Luteimonas* sp. JM171 |
| SBP00062 | Raspberries | *Luteitalea pratensis* |
| SBP00062 | Raspberries | *Lutibacter* sp. LPB0138 |
| SBP00062 | Raspberries | *Lysinibacillus* sp. 2017 |
| SBP00062 | Raspberries | *Lysinibacillus* sp. Marseille-P5727 |
| SBP00062 | Raspberries | *Lysinibacillus* sp. SGAir0095 |
| SBP00062 | Raspberries | *Lysinibacillus sphaericus* |
| SBP00062 | Raspberries | *Lysobacter antibioticus* |
| SBP00062 | Raspberries | *Lysobacter capsici* |
| SBP00062 | Raspberries | *Lysobacter enzymogenes* |
| SBP00062 | Raspberries | *Magnetococcus marinus* |
| SBP00062 | Raspberries | *Magnetospirillum gryphiswaldense* |
| SBP00062 | Raspberries | *Magnetospirillum magneticum* |
| SBP00062 | Raspberries | *Magnetospirillum* sp. ME-1 |
| SBP00062 | Raspberries | *Maribacter* sp. MJ134 |
| SBP00062 | Raspberries | *Maribacter* sp. T28 |
| SBP00062 | Raspberries | *Marinifilaceae bacterium* SPP2 |
| SBP00062 | Raspberries | *Mariniflexile* sp. TRM1-10 |
| SBP00062 | Raspberries | *Marinobacter hydrocarbonoclasticus* |
| SBP00062 | Raspberries | *Marinobacter psychrophilus* |
| SBP00062 | Raspberries | *Marinobacter salarius* |
| SBP00062 | Raspberries | *Marinobacter* sp. es.042 |
| SBP00062 | Raspberries | *Marinobacterium aestuarii* |
| SBP00062 | Raspberries | *Marinomonas mediterranea* |
| SBP00062 | Raspberries | *Marinovum algicola* |
| SBP00062 | Raspberries | *Mariprofundus aestuarium* |
| SBP00062 | Raspberries | *Marivirga tractuosa* |
| SBP00062 | Raspberries | *Marmoricola scoriae* |
| SBP00062 | Raspberries | *Martelella endophytica* |
| SBP00062 | Raspberries | *Massilia albidiflava* |
| SBP00062 | Raspberries | *Massilia oculi* |
| SBP00062 | Raspberries | *Massilia umbonata* |
| SBP00062 | Raspberries | *Massilia violaceinigra* |
| SBP00062 | Raspberries | *Melaminivora* sp. SC2-9 |
| SBP00062 | Raspberries | *Mesorhizobium amorphae* |
| SBP00062 | Raspberries | *Mesorhizobium ciceri* |
| SBP00062 | Raspberries | *Mesorhizobium loti* |
| SBP00062 | Raspberries | *Mesorhizobium* sp. M1B.F.Ca.ET.045.04.1.1 |
| SBP00062 | Raspberries | *Mesorhizobium* sp. M2A.F.Ca.ET.043.05.1.1 |
| SBP00062 | Raspberries | *Mesorhizobium* sp. M2A.F.Ca.ET.046.03.2.1 |
| SBP00062 | Raspberries | *Mesorhizobium* sp. M3A.F.Ca.ET.080.04.2.1 |
| SBP00062 | Raspberries | *Mesorhizobium* sp. M4B.F.Ca.ET.058.02.1.1 |
| SBP00062 | Raspberries | *Methanobacterium formicicum* |
| SBP00062 | Raspberries | *Methanobacterium* sp. MB1 |
| SBP00062 | Raspberries | *Methanobrevibacter ruminantium* |
| SBP00062 | Raspberries | *Methanobrevibacter smithii* |
| SBP00062 | Raspberries | *Methanobrevibacter* sp. YE315 |
| SBP00062 | Raspberries | *Methanocaldococcus jannaschii* |
| SBP00062 | Raspberries | *Methanocaldococcus vulcanius* |
| SBP00062 | Raspberries | *Methanococcoides methylutens* |
| SBP00062 | Raspberries | *Methanococcus maripaludis* |
| SBP00062 | Raspberries | *Methanococcus voltae* |
| SBP00062 | Raspberries | *Methanoculleus bourgensis* |
| SBP00062 | Raspberries | methanogenic archaeon ISO4-H5 |
| SBP00062 | Raspberries | *Methanolobus psychrophilus* |
| SBP00062 | Raspberries | *Methanopyrus* sp. KOL6 |
| SBP00062 | Raspberries | *Methanosaeta harundinacea* |
| SBP00062 | Raspberries | *Methanosalsum zhilinae* |
| SBP00062 | Raspberries | *Methanosarcina barkeri* |
| SBP00062 | Raspberries | *Methanosarcina lacustris* |
| SBP00062 | Raspberries | *Methanosarcina mazei* |

TABLE 3-continued

List of species identified in each metagenomic sample of each SBP Sample

| SBP ID | SBP Host Common Name | Genus sp. |
| --- | --- | --- |
| SBP00062 | Raspberries | *Methanosarcina siciliae* |
| SBP00062 | Raspberries | *Methanosarcina* sp. MTP4 |
| SBP00062 | Raspberries | *Methanosphaera* sp. BMS |
| SBP00062 | Raspberries | *Methanothrix soehngenii* |
| SBP00062 | Raspberries | *Methanotorris igneus* |
| SBP00062 | Raspberries | *Methylibium petroleiphilum* |
| SBP00062 | Raspberries | *Methylobacillus flagellatus* |
| SBP00062 | Raspberries | *Methylobacterium brachiatum* |
| SBP00062 | Raspberries | *Methylobacterium radiotolerans* |
| SBP00062 | Raspberries | *Methylobacterium* sp. 17Sr1-28 |
| SBP00062 | Raspberries | *Methylobacterium* sp. 17Sr1-43 |
| SBP00062 | Raspberries | *Methylocaldum marinum* |
| SBP00062 | Raspberries | *Methylocella silvestris* |
| SBP00062 | Raspberries | *Methylocella tundrae* |
| SBP00062 | Raspberries | *Methylococcus capsulatus* |
| SBP00062 | Raspberries | *Methylomicrobium album* |
| SBP00062 | Raspberries | *Methylomicrobium alcaliphilum* |
| SBP00062 | Raspberries | *Methylomicrobium* sp. wino1 |
| SBP00062 | Raspberries | *Methylomonas denitrificans* |
| SBP00062 | Raspberries | *Methylomonas methanica* |
| SBP00062 | Raspberries | *Methylomonas* sp. DH-1 |
| SBP00062 | Raspberries | *Methylomusa anaerophila* |
| SBP00062 | Raspberries | *Methylorubrum extorquens* |
| SBP00062 | Raspberries | *Methylorubrum populi* |
| SBP00062 | Raspberries | *Methylovirgula ligni* |
| SBP00062 | Raspberries | *Methylovulum psychrotolerans* |
| SBP00062 | Raspberries | *Micavibrio aeruginosavorus* |
| SBP00062 | Raspberries | *Microbacterium chocolatum* |
| SBP00062 | Raspberries | *Microbacterium lemovicicum* |
| SBP00062 | Raspberries | *Microbacterium* sp. No. 7 |
| SBP00062 | Raspberries | *Microbulbifer aggregans* |
| SBP00062 | Raspberries | *Micrococcus luteus* |
| SBP00062 | Raspberries | *Microcoleus* sp. PCC 7113 |
| SBP00062 | Raspberries | *Microlunatus soli* |
| SBP00062 | Raspberries | *Micromonospora coxensis* |
| SBP00062 | Raspberries | *Micromonospora echinofusca* |
| SBP00062 | Raspberries | *Micromonospora echinospora* |
| SBP00062 | Raspberries | *Micromonospora purpureochromogenes* |
| SBP00062 | Raspberries | *Micromonospora siamensis* |
| SBP00062 | Raspberries | *Micromonospora viridifaciens* |
| SBP00062 | Raspberries | *Micromonospora zamorensis* |
| SBP00062 | Raspberries | *Microterricola viridarii* |
| SBP00062 | Raspberries | *Microvirga* sp. 17 mud 1-3 |
| SBP00062 | Raspberries | *Microvirgula aerodenitrificans* |
| SBP00062 | Raspberries | *Mitsuaria* sp. 7 |
| SBP00062 | Raspberries | *Modestobacter marinus* |
| SBP00062 | Raspberries | *Mogibacterium diversum* |
| SBP00062 | Raspberries | *Moorea producens* |
| SBP00062 | Raspberries | *Moraxella bovoculi* |
| SBP00062 | Raspberries | *Moraxella osloensis* |
| SBP00062 | Raspberries | *Morganella morganii* |
| SBP00062 | Raspberries | *Mucilaginibacter gotjawali* |
| SBP00062 | Raspberries | *Mucilaginibacter* sp. BJC16-A31 |
| SBP00062 | Raspberries | *Muricauda lutaonensis* |
| SBP00062 | Raspberries | *Mycoavidus cysteinexigens* |
| SBP00062 | Raspberries | *Mycobacterium canettii* |
| SBP00062 | Raspberries | *Mycobacterium intracellulare* |
| SBP00062 | Raspberries | *Mycobacterium kansasii* |
| SBP00062 | Raspberries | *Mycobacterium paragordonae* |
| SBP00062 | Raspberries | *Mycobacterium shigaense* |
| SBP00062 | Raspberries | *Mycobacterium* sp. djl-10 |
| SBP00062 | Raspberries | *Mycobacterium* sp. EPa45 |
| SBP00062 | Raspberries | *Mycobacterium* sp. JLS |
| SBP00062 | Raspberries | *Mycobacteroides abscessus* |
| SBP00062 | Raspberries | *Mycobacteroides salmoniphilum* |
| SBP00062 | Raspberries | *Mycobacteroides saopaulense* |
| SBP00062 | Raspberries | *Mycolicibacterium chitae* |
| SBP00062 | Raspberries | *Mycolicibacterium chubuense* |
| SBP00062 | Raspberries | *Mycolicibacterium rhodesiae* |
| SBP00062 | Raspberries | *Mycolicibacterium smegmatis* |
| SBP00062 | Raspberries | *Mycolicibacterium thermoresistibile* |
| SBP00062 | Raspberries | *Mycolicibacterium vanbaalenii* |
| SBP00062 | Raspberries | *Mycoplasma californicum* |
| SBP00062 | Raspberries | *Mycoplasma cloacale* |
| SBP00062 | Raspberries | *Mycoplasma dispar* |
| SBP00062 | Raspberries | *Mycoplasma iowae* |

TABLE 3-continued

List of species identified in each metagenomic sample of each SBP Sample

| SBP ID | SBP Host Common Name | Genus sp. |
| --- | --- | --- |
| SBP00062 | Raspberries | *Mycoplasma suis* |
| SBP00062 | Raspberries | *Mycoplasma yeatsii* |
| SBP00062 | Raspberries | *Myroides odoratus* |
| SBP00062 | Raspberries | *Myxococcus fulvus* |
| SBP00062 | Raspberries | *Myxococcus macrosporus* |
| SBP00062 | Raspberries | *Myxococcus xanthus* |
| SBP00062 | Raspberries | *Nakamurella multipartita* |
| SBP00062 | Raspberries | *Nakamurella panacisegetis* |
| SBP00062 | Raspberries | *Nakamurella* sp. s14-144 |
| SBP00062 | Raspberries | *Natrialba magadii* |
| SBP00062 | Raspberries | *Natrinema versiforme* |
| SBP00062 | Raspberries | *Natronorubrum bangense* |
| SBP00062 | Raspberries | *Neisseria animaloris* |
| SBP00062 | Raspberries | *Neisseria* sp. KEM232 |
| SBP00062 | Raspberries | *Neisseria zoodegmatis* |
| SBP00062 | Raspberries | *Neisseriaceae bacterium* DSM 100970 |
| SBP00062 | Raspberries | *Neodiprion lecontei* nucleopolyhedrovirus |
| SBP00062 | Raspberries | *Neorhizobium galegae* |
| SBP00062 | Raspberries | *Neorhizobium* sp. NCHU2750 |
| SBP00062 | Raspberries | *Niabella soli* |
| SBP00062 | Raspberries | *Nitratireductor basaltis* |
| SBP00062 | Raspberries | *Nitratireductor* sp. OM-1 |
| SBP00062 | Raspberries | *Nitratiruptor* sp. SB155-2 |
| SBP00062 | Raspberries | *Nitrosococcus halophilus* |
| SBP00062 | Raspberries | *Nitrosococcus watsonii* |
| SBP00062 | Raspberries | *Nitrososphaera viennensis* |
| SBP00062 | Raspberries | *Nitrosospira multiformis* |
| SBP00062 | Raspberries | *Nitrospira japonica* |
| SBP00062 | Raspberries | *Nitrospira moscoviensis* |
| SBP00062 | Raspberries | *Nitrospirillum amazonense* |
| SBP00062 | Raspberries | *Nocardia brasiliensis* |
| SBP00062 | Raspberries | *Nocardia cyriacigeorgica* |
| SBP00062 | Raspberries | *Nocardioides dokdonensis* |
| SBP00062 | Raspberries | *Nocardioides* sp. CF8 |
| SBP00062 | Raspberries | *Nocardioides* sp. JS614 |
| SBP00062 | Raspberries | *Nocardiopsis dassonvillei* |
| SBP00062 | Raspberries | *Nocardiopsis gilva* |
| SBP00062 | Raspberries | *Nodularia spumigena* |
| SBP00062 | Raspberries | *Nonlabens dokdonensis* |
| SBP00062 | Raspberries | *Nonlabens* sp. Hel1_33_55 |
| SBP00062 | Raspberries | *Nonlabens* sp. MJ115 |
| SBP00062 | Raspberries | *Nonomuraea* sp. ATCC 55076 |
| SBP00062 | Raspberries | *Nostoc flagelliforme* |
| SBP00062 | Raspberries | *Nostoc linckia* |
| SBP00062 | Raspberries | *Nostoc piscinale* |
| SBP00062 | Raspberries | *Nostoc punctiforme* |
| SBP00062 | Raspberries | *Nostoc* sp. 'Lobaria pulmonaria (5183) cyanobiont |
| SBP00062 | Raspberries | *Nostoc* sp. CENA543 |
| SBP00062 | Raspberries | *Nostoc* sp. NIES-3756 |
| SBP00062 | Raspberries | *Nostoc* sp. NIES-4103 |
| SBP00062 | Raspberries | *Oceanithermus profundus* |
| SBP00062 | Raspberries | *Oceanobacillus iheyensis* |
| SBP00062 | Raspberries | *Oceanobacillus kimchii* |
| SBP00062 | Raspberries | *Octadecabacter antarcticus* |
| SBP00062 | Raspberries | *Octadecabacter arcticus* |
| SBP00062 | Raspberries | *Octadecabacter temperatus* |
| SBP00062 | Raspberries | *Oleiphilus messinensis* |
| SBP00062 | Raspberries | *Oleispira antarctica* |
| SBP00062 | Raspberries | *Oligella urethralis* |
| SBP00062 | Raspberries | *Oligotropha carboxidovorans* |
| SBP00062 | Raspberries | *Olleya aquimaris* |
| SBP00062 | Raspberries | *Olsenella umbonata* |
| SBP00062 | Raspberries | *Opitutaceae bacterium* TAV5 |
| SBP00062 | Raspberries | *Opitutus* sp. GAS368 |
| SBP00062 | Raspberries | *Opitutus terrae* |
| SBP00062 | Raspberries | *Ornithinimicrobium* sp. AMA3305 |
| SBP00062 | Raspberries | *Orpheovirus* IHUMI-LCC2 |
| SBP00062 | Raspberries | *Oscillatoria acuminata* |
| SBP00062 | Raspberries | *Oscillatoria nigro-viridis* |
| SBP00062 | Raspberries | *Oscillatoriales cyanobacterium* JSC-12 |
| SBP00062 | Raspberries | *Oscillibacter valericigenes* |
| SBP00062 | Raspberries | *Ottowia oryzae* |
| SBP00062 | Raspberries | *Ottowia* sp. oral taxon 894 |
| SBP00062 | Raspberries | *Owenweeksia hongkongensis* |
| SBP00062 | Raspberries | *Oxalobacter formigenes* |
| SBP00062 | Raspberries | *Paenibacillus baekrokdamisoli* |

TABLE 3-continued

List of species identified in each metagenomic sample of each SBP Sample

| SBP ID | SBP Host Common Name | Genus sp. |
|---|---|---|
| SBP00062 | Raspberries | *Paenibacillus bovis* |
| SBP00062 | Raspberries | *Paenibacillus crassostreae* |
| SBP00062 | Raspberries | *Paenibacillus donghaensis* |
| SBP00062 | Raspberries | *Paenibacillus graminis* |
| SBP00062 | Raspberries | *Paenibacillus ihbetae* |
| SBP00062 | Raspberries | *Paenibacillus mucilaginosus* |
| SBP00062 | Raspberries | *Paenibacillus odorifer* |
| SBP00062 | Raspberries | *Paenibacillus polymyxa* |
| SBP00062 | Raspberries | *Paenibacillus riograndensis* |
| SBP00062 | Raspberries | *Paenibacillus* sp. 18JY67-1 |
| SBP00062 | Raspberries | *Paenibacillus* sp. CAA11 |
| SBP00062 | Raspberries | *Paenibacillus* sp. FSL H7-0357 |
| SBP00062 | Raspberries | *Paenibacillus* sp. FSL H7-0737 |
| SBP00062 | Raspberries | *Paenibacillus* sp. FSL R7-0331 |
| SBP00062 | Raspberries | *Paenibacillus* sp. IHB B 3084 |
| SBP00062 | Raspberries | *Paenibacillus* sp. MBLB1234 |
| SBP00062 | Raspberries | *Paenibacillus terrae* |
| SBP00062 | Raspberries | *Paenisporosarcina antarctica* |
| SBP00062 | Raspberries | *Paludisphaera borealis* |
| SBP00062 | Raspberries | *Pandoraea apista* |
| SBP00062 | Raspberries | *Pandoraea faecigallinarum* |
| SBP00062 | Raspberries | *Pandoraea norimbergensis* |
| SBP00062 | Raspberries | *Pandoraea oxalativorans* |
| SBP00062 | Raspberries | *Pandoraea pnomenusa* |
| SBP00062 | Raspberries | *Pandoraea thiooxydans* |
| SBP00062 | Raspberries | *Pandoravirus dulcis* |
| SBP00062 | Raspberries | *Pandoravirus inopinatum* |
| SBP00062 | Raspberries | *Pandoravirus macleodensis* |
| SBP00062 | Raspberries | *Pandoravirus neocaledonia* |
| SBP00062 | Raspberries | *Pandoravirus quercus* |
| SBP00062 | Raspberries | *Pandoravirus salinus* |
| SBP00062 | Raspberries | *Pantoea agglomerans* |
| SBP00062 | Raspberries | *Pantoea ananatis* |
| SBP00062 | Raspberries | *Pantoea vagans* |
| SBP00062 | Raspberries | *Paraburkholderia caffelnilytica* |
| SBP00062 | Raspberries | *Paraburkholderia fungorum* |
| SBP00062 | Raspberries | *Paraburkholderia phenoliruptrix* |
| SBP00062 | Raspberries | *Paraburkholderia phytofirmans* |
| SBP00062 | Raspberries | *Paraburkholderia rhizoxinica* |
| SBP00062 | Raspberries | *Paraburkholderia* sp. DCR13 |
| SBP00062 | Raspberries | *Paraburkholderia terricola* |
| SBP00062 | Raspberries | *Paracoccus contaminans* |
| SBP00062 | Raspberries | *Paracoccus* sp. Arc7-R13 |
| SBP00062 | Raspberries | *Paracoccus* sp. BM15 |
| SBP00062 | Raspberries | *Paracoccus* sp. CBA4604 |
| SBP00062 | Raspberries | *Pararhodospirillum photometricum* |
| SBP00062 | Raspberries | *Pasteurella multocida* |
| SBP00062 | Raspberries | *Pectobacterium parmentieri* |
| SBP00062 | Raspberries | *Pectobacterium polaris* |
| SBP00062 | Raspberries | *Pediococcus acidilactici* |
| SBP00062 | Raspberries | *Pediococcus damnosus* |
| SBP00062 | Raspberries | *Pediococcus pentosaceus* |
| SBP00062 | Raspberries | *Pedobacter cryoconitis* |
| SBP00062 | Raspberries | *Pedobacter heparinus* |
| SBP00062 | Raspberries | *Pedobacter* sp. G11 |
| SBP00062 | Raspberries | *Pelobacter* sp. SFB93 |
| SBP00062 | Raspberries | *Pelolinea submarina* |
| SBP00062 | Raspberries | *Petrimonas mucosa* |
| SBP00062 | Raspberries | *Phaeobacter gallaeciensis* |
| SBP00062 | Raspberries | *Phaeobacter inhibens* |
| SBP00062 | Raspberries | *Photobacterium damselae* |
| SBP00062 | Raspberries | *Photorhabdus laumondii* |
| SBP00062 | Raspberries | *Phycisphaera mikurensis* |
| SBP00062 | Raspberries | *Pimelobacter simplex* |
| SBP00062 | Raspberries | *Pirellula staleyi* |
| SBP00062 | Raspberries | *Planctomyces* sp. SH-PL62 |
| SBP00062 | Raspberries | *Planococcus* sp. MB-3u-03 |
| SBP00062 | Raspberries | *Plantactinospora* sp. BC1 |
| SBP00062 | Raspberries | *Plantactinospora* sp. KBS50 |
| SBP00062 | Raspberries | *Plantibacter* sp. |
| SBP00062 | Raspberries | *Plautia stali* |
| SBP00062 | Raspberries | *Polaribacter* sp. KT25b |
| SBP00062 | Raspberries | *Polaribacter* sp. MED152 |
| SBP00062 | Raspberries | *Polaribacter* sp. SA4-10 |
| SBP00062 | Raspberries | *Polaribacter* sp. SA4-12 |
| SBP00062 | Raspberries | *Polaromonas naphthalenivorans* |

TABLE 3-continued

List of species identified in each metagenomic sample of each SBP Sample

| SBP ID | SBP Host Common Name | Genus sp. |
| --- | --- | --- |
| SBP00062 | Raspberries | *Polaromonas* sp. SP1 |
| SBP00062 | Raspberries | *Polymorphum gilvum* |
| SBP00062 | Raspberries | *Polynucleobacter necessarius* |
| SBP00062 | Raspberries | *Polynucleobacter wuianus* |
| SBP00062 | Raspberries | *Pontibacter korlensis* |
| SBP00062 | Raspberries | *Porphyromonas gingivalis* |
| SBP00062 | Raspberries | *Pragia fontium* |
| SBP00062 | Raspberries | *Prevotella denticola* |
| SBP00062 | Raspberries | *Prevotella scopos* |
| SBP00062 | Raspberries | *Prochlorococcus marinus* |
| SBP00062 | Raspberries | *Prosthecochloris aestuarii* |
| SBP00062 | Raspberries | *Prosthecochloris* sp. HL-130-GSB |
| SBP00062 | Raspberries | *Proteus hauseri* |
| SBP00062 | Raspberries | *Proteus mirabilis* |
| SBP00062 | Raspberries | *Providencia heimbachae* |
| SBP00062 | Raspberries | *Providencia rettgeri* |
| SBP00062 | Raspberries | *Pseudanabaena* sp. PCC 7367 |
| SBP00062 | Raspberries | *Pseudarcicella* sp. HME7025 |
| SBP00062 | Raspberries | *Pseudoalteromonas arctica* |
| SBP00062 | Raspberries | *Pseudoalteromonas phenolica* |
| SBP00062 | Raspberries | *Pseudoalteromonas piscicida* |
| SBP00062 | Raspberries | *Pseudoalteromonas rubra* |
| SBP00062 | Raspberries | *Pseudoalteromonas* sp. 1_2015MBL_MicDiv |
| SBP00062 | Raspberries | *Pseudoalteromonas translucida* |
| SBP00062 | Raspberries | *Pseudodesulfovibrio aespoeensis* |
| SBP00062 | Raspberries | *Pseudodesulfovibrio profundus* |
| SBP00062 | Raspberries | *Pseudohongiella spirulinae* |
| SBP00062 | Raspberries | *Pseudolabrys taiwanensis* |
| SBP00062 | Raspberries | *Pseudomonas aeruginosa* |
| SBP00062 | Raspberries | *Pseudomonas alkylphenolica* |
| SBP00062 | Raspberries | *Pseudomonas amygdali* |
| SBP00062 | Raspberries | *Pseudomonas antarctica* |
| SBP00062 | Raspberries | *Pseudomonas azotoformans* |
| SBP00062 | Raspberries | *Pseudomonas brassicacearum* |
| SBP00062 | Raspberries | *Pseudomonas cedrina* |
| SBP00062 | Raspberries | *Pseudomonas chlororaphis* |
| SBP00062 | Raspberries | *Pseudomonas entomophila* |
| SBP00062 | Raspberries | *Pseudomonas extremorientalis* |
| SBP00062 | Raspberries | *Pseudomonas fluorescens* |
| SBP00062 | Raspberries | *Pseudomonas frederiksbergensis* |
| SBP00062 | Raspberries | *Pseudomonas furukawaii* |
| SBP00062 | Raspberries | *Pseudomonas guangdongensis* |
| SBP00062 | Raspberries | *Pseudomonas knackmussii* |
| SBP00062 | Raspberries | *Pseudomonas koreensis* |
| SBP00062 | Raspberries | *Pseudomonas libanensis* |
| SBP00062 | Raspberries | *Pseudomonas monteilii* |
| SBP00062 | Raspberries | *Pseudomonas orientalis* |
| SBP00062 | Raspberries | *Pseudomonas oryzihabitans* |
| SBP00062 | Raspberries | *Pseudomonas plecoglossicida* |
| SBP00062 | Raspberries | *Pseudomonas poae* |
| SBP00062 | Raspberries | *Pseudomonas protegens* |
| SBP00062 | Raspberries | *Pseudomonas pseudoalcaligenes* |
| SBP00062 | Raspberries | *Pseudomonas psychrotolerans* |
| SBP00062 | Raspberries | *Pseudomonas putida* |
| SBP00062 | Raspberries | *Pseudomonas reinekei* |
| SBP00062 | Raspberries | *Pseudomonas resinovorans* |
| SBP00062 | Raspberries | *Pseudomonas rhizosphaerae* |
| SBP00062 | Raspberries | *Pseudomonas savastanoi* |
| SBP00062 | Raspberries | *Pseudomonas silesiensis* |
| SBP00062 | Raspberries | *Pseudomonas simiae* |
| SBP00062 | Raspberries | *Pseudomonas soli* |
| SBP00062 | Raspberries | *Pseudomonas* sp. |
| SBP00062 | Raspberries | *Pseudomonas* sp. 7SR1 |
| SBP00062 | Raspberries | *Pseudomonas* sp. ATCC 13867 |
| SBP00062 | Raspberries | *Pseudomonas* sp. CC6-YY-74 |
| SBP00062 | Raspberries | *Pseudomonas* sp. CCOS 191 |
| SBP00062 | Raspberries | *Pseudomonas* sp. DY-1 |
| SBP00062 | Raspberries | *Pseudomonas* sp. FDAARGOS_380 |
| SBP00062 | Raspberries | *Pseudomonas* sp. GR 6-02 |
| SBP00062 | Raspberries | *Pseudomonas* sp. K2W31S-8 |
| SBP00062 | Raspberries | *Pseudomonas* sp. LBUM920 |
| SBP00062 | Raspberries | *Pseudomonas* sp. Leaf58 |
| SBP00062 | Raspberries | *Pseudomonas* sp. MYb193 |
| SBP00062 | Raspberries | *Pseudomonas* sp. NC02 |
| SBP00062 | Raspberries | *Pseudomonas* sp. NS1(2017) |
| SBP00062 | Raspberries | *Pseudomonas* sp. R5-89-07 |

TABLE 3-continued

List of species identified in each metagenomic sample of each SBP Sample

| SBP ID | SBP Host Common Name | Genus sp. |
|---|---|---|
| SBP00062 | Raspberries | *Pseudomonas* sp. S09G 359 |
| SBP00062 | Raspberries | *Pseudomonas* sp. URMO17WK12:I11 |
| SBP00062 | Raspberries | *Pseudomonas* sp. Z003-0.4C(8344-21) |
| SBP00062 | Raspberries | *Pseudomonas stutzeri* |
| SBP00062 | Raspberries | *Pseudomonas synxantha* |
| SBP00062 | Raspberries | *Pseudomonas syringae* |
| SBP00062 | Raspberries | *Pseudomonas tolaasii* |
| SBP00062 | Raspberries | *Pseudomonas trivialis* |
| SBP00062 | Raspberries | *Pseudomonas umsongensis* |
| SBP00062 | Raspberries | *Pseudomonas viridiflava* |
| SBP00062 | Raspberries | *Pseudomonas* virus PAE1 |
| SBP00062 | Raspberries | *Pseudomonas xanthomarina* |
| SBP00062 | Raspberries | *Pseudomonas xinjiangensis* |
| SBP00062 | Raspberries | *Pseudomonas yamanorum* |
| SBP00062 | Raspberries | *Pseudonocardia autotrophica* |
| SBP00062 | Raspberries | *Pseudonocardia dioxanivorans* |
| SBP00062 | Raspberries | *Pseudonocardia* sp. AL041005-10 |
| SBP00062 | Raspberries | *Pseudopedobacter saltans* |
| SBP00062 | Raspberries | *Pseudorhodoplanes sinuspersici* |
| SBP00062 | Raspberries | *Pseudoxanthomonas spadix* |
| SBP00062 | Raspberries | *Pseudoxanthomonas suwonensis* |
| SBP00062 | Raspberries | *Psychrobacter* sp. DAB_AL43B |
| SBP00062 | Raspberries | *Psychrobacter* sp. P11G3 |
| SBP00062 | Raspberries | *Psychrobacter* sp. PRwf-1 |
| SBP00062 | Raspberries | *Psychrobacter* sp. YP14 |
| SBP00062 | Raspberries | *Pyrobaculum aerophilum* |
| SBP00062 | Raspberries | *Pyrobaculum islandicum* |
| SBP00062 | Raspberries | *Pyrococcus horikoshii* |
| SBP00062 | Raspberries | *Rahnella aquatilis* |
| SBP00062 | Raspberries | *Rahnella* sp. ERMR1:05 |
| SBP00062 | Raspberries | *Ralstonia insidiosa* |
| SBP00062 | Raspberries | *Ralstonia mannitolilytica* |
| SBP00062 | Raspberries | *Ralstonia pickettii* |
| SBP00062 | Raspberries | *Ralstonia solanacearum* |
| SBP00062 | Raspberries | *Ramlibacter tataouinensis* |
| SBP00062 | Raspberries | *Raoultella ornithinolytica* |
| SBP00062 | Raspberries | *Raoultella planticola* |
| SBP00062 | Raspberries | *Raoultella terrigena* |
| SBP00062 | Raspberries | *Raphidiopsis curvata* |
| SBP00062 | Raspberries | *Rathayibacter festucae* |
| SBP00062 | Raspberries | *Rathayibacter rathayi* |
| SBP00062 | Raspberries | *Renibacterium salmoninarum* |
| SBP00062 | Raspberries | *Rheinheimera* sp. LHK132 |
| SBP00062 | Raspberries | *Rhizobacter gummiphilus* |
| SBP00062 | Raspberries | *Rhizobium etli* |
| SBP00062 | Raspberries | *Rhizobium leguminosarum* |
| SBP00062 | Raspberries | *Rhizobium* sp. ACO-34A |
| SBP00062 | Raspberries | *Rhizobium* sp. IRBG74 |
| SBP00062 | Raspberries | *Rhizobium* sp. NT-26 |
| SBP00062 | Raspberries | *Rhodanobacter denitrificans* |
| SBP00062 | Raspberries | *Rhodanobacteraceae bacterium* Dysh456 |
| SBP00062 | Raspberries | *Rhodobacter sphaeroides* |
| SBP00062 | Raspberries | *Rhodococcus fascians* |
| SBP00062 | Raspberries | *Rhodococcus hoagii* |
| SBP00062 | Raspberries | *Rhodococcus jostii* |
| SBP00062 | Raspberries | *Rhodococcus opacus* |
| SBP00062 | Raspberries | *Rhodococcus qingshengii* |
| SBP00062 | Raspberries | *Rhodococcus ruber* |
| SBP00062 | Raspberries | *Rhodococcus* sp. P1Y |
| SBP00062 | Raspberries | *Rhodococcus* sp. WB1 |
| SBP00062 | Raspberries | *Rhodococcus* sp. X156 |
| SBP00062 | Raspberries | *Rhodoferax koreense* |
| SBP00062 | Raspberries | *Rhodoferax saidenbachensis* |
| SBP00062 | Raspberries | *Rhodopirellula baltica* |
| SBP00062 | Raspberries | *Rhodoplanes* sp. Z2-YC6860 |
| SBP00062 | Raspberries | *Rhodopseudomonas palustris* |
| SBP00062 | Raspberries | *Riemerella anatipestifer* |
| SBP00062 | Raspberries | *Rivularia* sp. PCC 7116 |
| SBP00062 | Raspberries | *Roseateles depolymerans* |
| SBP00062 | Raspberries | *Roseburia intestinalis* |
| SBP00062 | Raspberries | *Roseibacterium elongatum* |
| SBP00062 | Raspberries | *Roseiflexus* sp. RS-1 |
| SBP00062 | Raspberries | *Rubrivivax gelatinosus* |
| SBP00062 | Raspberries | Rubus yellow net virus |
| SBP00062 | Raspberries | *Ruegeria pomeroyi* |
| SBP00062 | Raspberries | *Ruminococcus albus* |

TABLE 3-continued

List of species identified in each metagenomic sample of each SBP Sample

| SBP ID | SBP Host Common Name | Genus sp. |
| --- | --- | --- |
| SBP00062 | Raspberries | *Ruminococcus bicirculans* |
| SBP00062 | Raspberries | *Runella* sp. SP2 |
| SBP00062 | Raspberries | *Saccharomonospora cyanea* |
| SBP00062 | Raspberries | *Saccharomonospora glauca* |
| SBP00062 | Raspberries | *Saccharomonospora viridis* |
| SBP00062 | Raspberries | *Saccharothrix espanaensis* |
| SBP00062 | Raspberries | *Saimiriine* alphaherpesvirus 1 |
| SBP00062 | Raspberries | *Salegentibacter* sp. T436 |
| SBP00062 | Raspberries | *Salinicoccus halodurans* |
| SBP00062 | Raspberries | *Salinimonas* sp. HMF8227 |
| SBP00062 | Raspberries | *Salinispora arenicola* |
| SBP00062 | Raspberries | *Salinispora tropica* |
| SBP00062 | Raspberries | *Salmonella enterica* |
| SBP00062 | Raspberries | *Salmonella* virus Stitch |
| SBP00062 | Raspberries | *Scytonema* sp. HK-05 |
| SBP00062 | Raspberries | *Sedimentitalea* sp. W43 |
| SBP00062 | Raspberries | *Sediminispirochaeta smaragdinae* |
| SBP00062 | Raspberries | *Segniliparus rotundus* |
| SBP00062 | Raspberries | *Selenomonas sputigena* |
| SBP00062 | Raspberries | *Serinicoccus chungangensis* |
| SBP00062 | Raspberries | *Serratia liquefaciens* |
| SBP00062 | Raspberries | *Serratia marcescens* |
| SBP00062 | Raspberries | *Serratia odorifera* |
| SBP00062 | Raspberries | *Serratia* sp. 3ACOL1 |
| SBP00062 | Raspberries | *Serratia* sp. FGI94 |
| SBP00062 | Raspberries | *Serratia* sp. YD25 |
| SBP00062 | Raspberries | *Shewanella baltica* |
| SBP00062 | Raspberries | *Shewanella decolorationis* |
| SBP00062 | Raspberries | *Shewanella halifaxensis* |
| SBP00062 | Raspberries | *Shewanella japonica* |
| SBP00062 | Raspberries | *Shewanella livingstonensis* |
| SBP00062 | Raspberries | *Shewanella loihica* |
| SBP00062 | Raspberries | *Shewanella oneidensis* |
| SBP00062 | Raspberries | *Shewanella pealeana* |
| SBP00062 | Raspberries | *Shewanella spongiae* |
| SBP00062 | Raspberries | *Shewanella violacea* |
| SBP00062 | Raspberries | *Shigella flexneri* |
| SBP00062 | Raspberries | *Siansivirga zeaxanthinifaciens* |
| SBP00062 | Raspberries | *Sideroxydans lithotrophicus* |
| SBP00062 | Raspberries | *Singulisphaera acidiphila* |
| SBP00062 | Raspberries | *Sinorhizobium fredii* |
| SBP00062 | Raspberries | *Sinorhizobium* sp. RAC02 |
| SBP00062 | Raspberries | *Solitalea canadensis* |
| SBP00062 | Raspberries | *Sorangium cellulosum* |
| SBP00062 | Raspberries | *Sphaerochaeta coccoides* |
| SBP00062 | Raspberries | *Sphaerospermopsis kisseleviana* |
| SBP00062 | Raspberries | *Sphingobacteriaceae bacterium* GW460-11-11-14-LB5 |
| SBP00062 | Raspberries | *Sphingobacterium daejeonense* |
| SBP00062 | Raspberries | *Sphingobacterium mizutaii* |
| SBP00062 | Raspberries | *Sphingobacterium* sp. 21 |
| SBP00062 | Raspberries | *Sphingobium* sp. EP60837 |
| SBP00062 | Raspberries | *Sphingobium* sp. SCG-1 |
| SBP00062 | Raspberries | *Sphingobium* sp. SYK-6 |
| SBP00062 | Raspberries | *Sphingomonas panacis* |
| SBP00062 | Raspberries | *Sphingomonas sanxanigenens* |
| SBP00062 | Raspberries | *Sphingomonas* sp. AAPS |
| SBP00062 | Raspberries | *Sphingomonas* sp. LK11 |
| SBP00062 | Raspberries | *Sphingomonas wittichii* |
| SBP00062 | Raspberries | *Sphingopyxis alaskensis* |
| SBP00062 | Raspberries | *Sphingopyxis macrogoltabida* |
| SBP00062 | Raspberries | *Sphingopyxis* sp. QXT-31 |
| SBP00062 | Raspberries | *Sphingopyxis* sp. WSSA3p |
| SBP00062 | Raspberries | *Spiribacter curvatus* |
| SBP00062 | Raspberries | *Spiroplasma alleghenense* |
| SBP00062 | Raspberries | *Spiroplasma apis* |
| SBP00062 | Raspberries | *Spiroplasma culicicola* |
| SBP00062 | Raspberries | *Spiroplasma kunkelii* |
| SBP00062 | Raspberries | *Spirosoma aerolatum* |
| SBP00062 | Raspberries | *Spirosoma rigui* |
| SBP00062 | Raspberries | *Sporosarcina psychrophila* |
| SBP00062 | Raspberries | *Sporosarcina ureae* |
| SBP00062 | Raspberries | *Stanieria cyanosphaera* |
| SBP00062 | Raspberries | *Stanieria* sp. NIES-3757 |
| SBP00062 | Raspberries | *Staphylococcus aureus* |
| SBP00062 | Raspberries | *Staphylococcus epidermidis* |
| SBP00062 | Raspberries | *Staphylococcus haemolyticus* |

TABLE 3-continued

List of species identified in each metagenomic sample of each SBP Sample

| SBP ID | SBP Host Common Name | Genus sp. |
| --- | --- | --- |
| SBP00062 | Raspberries | *Staphylococcus nepalensis* |
| SBP00062 | Raspberries | *Staphylococcus pseudintermedius* |
| SBP00062 | Raspberries | *Staphylococcus saprophyticus* |
| SBP00062 | Raspberries | *Staphylococcus sciuri* |
| SBP00062 | Raspberries | *Staphylococcus simiae* |
| SBP00062 | Raspberries | *Staphylococcus succinus* |
| SBP00062 | Raspberries | *Stappia* sp. ES.058 |
| SBP00062 | Raspberries | *Starkeya novella* |
| SBP00062 | Raspberries | *Stella vacuolata* |
| SBP00062 | Raspberries | *Stenotrophomonas maltophilia* |
| SBP00062 | Raspberries | *Stenotrophomonas rhizophila* |
| SBP00062 | Raspberries | *Stenotrophomonas* sp. |
| SBP00062 | Raspberries | *Stenotrophomonas* sp. ESTM1D_MKCIP4_1 |
| SBP00062 | Raspberries | *Stenotrophomonas* sp. G4 |
| SBP00062 | Raspberries | *Stenotrophomonas* sp. MYb57 |
| SBP00062 | Raspberries | *Stenotrophomonas* sp. SAU14A_NAIMI4_5 |
| SBP00062 | Raspberries | *Stenotrophomonas* sp. SAU14A_NAIMI4_8 |
| SBP00062 | Raspberries | *Stenotrophomonas* sp. WZN-1 |
| SBP00062 | Raspberries | *Stenotrophomonas* sp. YAU14A_MKIMI4_1 |
| SBP00062 | Raspberries | *Stenotrophomonas* sp. ZAC14D2_NAIMI4_6 |
| SBP00062 | Raspberries | *Stigmatella aurantiaca* |
| SBP00062 | Raspberries | *Streptacidiphilus* sp. DSM 106435 |
| SBP00062 | Raspberries | *Streptococcus anginosus* |
| SBP00062 | Raspberries | *Streptococcus cristatus* |
| SBP00062 | Raspberries | *Streptococcus mitis* |
| SBP00062 | Raspberries | *Streptococcus pantholopis* |
| SBP00062 | Raspberries | *Streptococcus parasanguinis* |
| SBP00062 | Raspberries | *Streptococcus pluranimalium* |
| SBP00062 | Raspberries | *Streptococcus pneumoniae* |
| SBP00062 | Raspberries | *Streptococcus porcinus* |
| SBP00062 | Raspberries | *Streptococcus pyogenes* |
| SBP00062 | Raspberries | *Streptomyces albireticuli* |
| SBP00062 | Raspberries | *Streptomyces albulus* |
| SBP00062 | Raspberries | *Streptomyces ambofaciens* |
| SBP00062 | Raspberries | *Streptomyces asterosporus* |
| SBP00062 | Raspberries | *Streptomyces atratus* |
| SBP00062 | Raspberries | *Streptomyces avermitilis* |
| SBP00062 | Raspberries | *Streptomyces bingchenggensis* |
| SBP00062 | Raspberries | *Streptomyces cattleya* |
| SBP00062 | Raspberries | *Streptomyces clavuligerus* |
| SBP00062 | Raspberries | *Streptomyces collinus* |
| SBP00062 | Raspberries | *Streptomyces exfoliatus* |
| SBP00062 | Raspberries | *Streptomyces formicae* |
| SBP00062 | Raspberries | *Streptomyces glaucescens* |
| SBP00062 | Raspberries | *Streptomyces griseorubiginosus* |
| SBP00062 | Raspberries | *Streptomyces griseoviridis* |
| SBP00062 | Raspberries | *Streptomyces hundungensis* |
| SBP00062 | Raspberries | *Streptomyces hygroscopicus* |
| SBP00062 | Raspberries | *Streptomyces lavendulae* |
| SBP00062 | Raspberries | *Streptomyces lunaelactis* |
| SBP00062 | Raspberries | *Streptomyces luteoverticillatus* |
| SBP00062 | Raspberries | *Streptomyces lydicus* |
| SBP00062 | Raspberries | *Streptomyces malaysiensis* |
| SBP00062 | Raspberries | *Streptomyces niveus* |
| SBP00062 | Raspberries | *Streptomyces noursei* |
| SBP00062 | Raspberries | *Streptomyces olivoreticuli* |
| SBP00062 | Raspberries | *Streptomyces pactum* |
| SBP00062 | Raspberries | *Streptomyces pluripotens* |
| SBP00062 | Raspberries | *Streptomyces pristinaespiralis* |
| SBP00062 | Raspberries | *Streptomyces puniciscabiei* |
| SBP00062 | Raspberries | *Streptomyces rimosus* |
| SBP00062 | Raspberries | *Streptomyces roseochromogenus* |
| SBP00062 | Raspberries | *Streptomyces rubrolavendulae* |
| SBP00062 | Raspberries | *Streptomyces scabiei* |
| SBP00062 | Raspberries | *Streptomyces* sp. 2323.1 |
| SBP00062 | Raspberries | *Streptomyces* sp. 3211 |
| SBP00062 | Raspberries | *Streptomyces* sp. ADI95-16 |
| SBP00062 | Raspberries | *Streptomyces* sp. CB09001 |
| SBP00062 | Raspberries | *Streptomyces* sp. CdTB01 |
| SBP00062 | Raspberries | *Streptomyces* sp. CMB-StM0423 |
| SBP00062 | Raspberries | *Streptomyces* sp. fd1-xmd |
| SBP00062 | Raspberries | *Streptomyces* sp. GSSD-12 |
| SBP00062 | Raspberries | *Streptomyces* sp. HNM0039 |
| SBP00062 | Raspberries | *Streptomyces* sp. M2 |
| SBP00062 | Raspberries | *Streptomyces* sp. PAMC 26508 |
| SBP00062 | Raspberries | *Streptomyces* sp. S063 |

TABLE 3-continued

| List of species identified in each metagenomic sample of each SBP Sample | | |
|---|---|---|
| SBP ID | SBP Host Common Name | Genus sp. |
| SBP00062 | Raspberries | *Streptomyces* sp. SAT1 |
| SBP00062 | Raspberries | *Streptomyces* sp. Sge12 |
| SBP00062 | Raspberries | *Streptomyces* sp. SirexAA-E |
| SBP00062 | Raspberries | *Streptomyces* sp. SM18 |
| SBP00062 | Raspberries | *Streptomyces* sp. TLI_053 |
| SBP00062 | Raspberries | *Streptomyces* sp. WAC 01438 |
| SBP00062 | Raspberries | *Streptomyces* sp. WAC 01529 |
| SBP00062 | Raspberries | *Streptomyces* sp. WAC 06738 |
| SBP00062 | Raspberries | *Streptomyces* sp. YIM 121038 |
| SBP00062 | Raspberries | *Streptomyces* sp. Z022 |
| SBP00062 | Raspberries | *Streptomyces spongiicola* |
| SBP00062 | Raspberries | *Streptomyces venezuelae* |
| SBP00062 | Raspberries | *Streptomyces violaceusniger* |
| SBP00062 | Raspberries | *Streptomyces xiamenensis* |
| SBP00062 | Raspberries | *Streptomyces xinghaiensis* |
| SBP00062 | Raspberries | *Streptosporangium roseum* |
| SBP00062 | Raspberries | *Sudan ebolavirus* |
| SBP00062 | Raspberries | *Sulfitobacter* sp. BSw21498 |
| SBP00062 | Raspberries | *Sulfitobacter* sp. JLO8 |
| SBP00062 | Raspberries | *Sulfolobus acidocaldarius* |
| SBP00062 | Raspberries | *Sulfolobus islandicus* |
| SBP00062 | Raspberries | *Sulfuricella denitrificans* |
| SBP00062 | Raspberries | *Sulfurimonas gotlandica* |
| SBP00062 | Raspberries | *Sulfurivermis fontis* |
| SBP00062 | Raspberries | *Synechococcus* sp. CC9311 |
| SBP00062 | Raspberries | *Synechococcus* sp. KORDI-100 |
| SBP00062 | Raspberries | *Synechococcus* sp. RCC307 |
| SBP00062 | Raspberries | *Synechococcus* sp. WH 8020 |
| SBP00062 | Raspberries | *Syntrophus aciditrophicus* |
| SBP00062 | Raspberries | *Tatumella ptyseos* |
| SBP00062 | Raspberries | *Tenacibaculum maritimum* |
| SBP00062 | Raspberries | *Tenacibaculum mesophilum* |
| SBP00062 | Raspberries | *Tenacibaculum todarodis* |
| SBP00062 | Raspberries | *Tenericutes bacterium* MZ-XQ |
| SBP00062 | Raspberries | *Terriglobus saanensis* |
| SBP00062 | Raspberries | *Tessaracoccus flavescens* |
| SBP00062 | Raspberries | *Tessaracoccus* sp. Marseille-P5995 |
| SBP00062 | Raspberries | *Tetragenococcus halophilus* |
| SBP00062 | Raspberries | *Thalassococcus* sp. S3 |
| SBP00062 | Raspberries | *Thalassospira marina* |
| SBP00062 | Raspberries | *Thauera* sp. MZ1T |
| SBP00062 | Raspberries | *Thermanaeromonas toyohensis* |
| SBP00062 | Raspberries | *Thermanaerovibrio velox* |
| SBP00062 | Raspberries | *Thermincola potens* |
| SBP00062 | Raspberries | *Thermoactinomyces vulgaris* |
| SBP00062 | Raspberries | *Thermobacillus composti* |
| SBP00062 | Raspberries | *Thermobifida fusca* |
| SBP00062 | Raspberries | *Thermococcus chitonophagus* |
| SBP00062 | Raspberries | *Thermococcus pacificus* |
| SBP00062 | Raspberries | *Thermococcus* sp. 2319x1 |
| SBP00062 | Raspberries | *Thermococcus* sp. AM4 |
| SBP00062 | Raspberries | *Thermococcus* sp. EXT12c |
| SBP00062 | Raspberries | *Thermococcus thioreducens* |
| SBP00062 | Raspberries | *Thermodesulfobium narugense* |
| SBP00062 | Raspberries | *Thermogladius calderae* |
| SBP00062 | Raspberries | *Thermogutta terrifontis* |
| SBP00062 | Raspberries | *Thermomonas* sp. SY21 |
| SBP00062 | Raspberries | *Thermoproteus* tenax virus 1 |
| SBP00062 | Raspberries | *Thermosulfidibacter takaii* |
| SBP00062 | Raspberries | *Thioalkalivibrio nitratireducens* |
| SBP00062 | Raspberries | *Thioalkalivibrio* sp. K90mix |
| SBP00062 | Raspberries | *Thioalkalivibrio sulfidiphilus* |
| SBP00062 | Raspberries | *Thiobacillus denitrificans* |
| SBP00062 | Raspberries | *Thiocystis violascens* |
| SBP00062 | Raspberries | *Thiomicrospira aerophila* |
| SBP00062 | Raspberries | *Tistrella mobilis* |
| SBP00062 | Raspberries | TM7 phylum sp. oral taxon 488 |
| SBP00062 | Raspberries | *Tolumonas auensis* |
| SBP00062 | Raspberries | *Treponema caldarium* |
| SBP00062 | Raspberries | *Treponema primitia* |
| SBP00062 | Raspberries | *Trichodesmium erythraeum* |
| SBP00062 | Raspberries | *Trichormus azollae* |
| SBP00062 | Raspberries | *Trichormus variabilis* |
| SBP00062 | Raspberries | *Tropheryma whipplei* |
| SBP00062 | Raspberries | *Tsukamurella paurometabola* |
| SBP00062 | Raspberries | *Variovorax boronicumulans* |

TABLE 3-continued

List of species identified in each metagenomic sample of each SBP Sample

| SBP ID | SBP Host Common Name | Genus sp. |
|---|---|---|
| SBP00062 | Raspberries | *Variovorax paradoxus* |
| SBP00062 | Raspberries | *Variovorax* sp. HW608 |
| SBP00062 | Raspberries | *Variovorax* sp. PAMC 28711 |
| SBP00062 | Raspberries | *Veillonella parvula* |
| SBP00062 | Raspberries | *Verrucomicrabium spinosum* |
| SBP00062 | Raspberries | *Verrucosispora maris* |
| SBP00062 | Raspberries | *Vibrio anguillarum* |
| SBP00062 | Raspberries | *Vibrio aphrogenes* |
| SBP00062 | Raspberries | *Vibrio breoganii* |
| SBP00062 | Raspberries | *Vibrio campbellii* |
| SBP00062 | Raspberries | *Vibrio chagasii* |
| SBP00062 | Raspberries | *Vibrio cholerae* |
| SBP00062 | Raspberries | *Vibrio coralliilyticus* |
| SBP00062 | Raspberries | *Vibrio hyugaensis* |
| SBP00062 | Raspberries | *Vibrio mediterranei* |
| SBP00062 | Raspberries | *Vibrio nigripulchritudo* |
| SBP00062 | Raspberries | *Vibrio parahaemolyticus* |
| SBP00062 | Raspberries | *Vibrio rotiferianus* |
| SBP00062 | Raspberries | *Vibrio scophthalmi* |
| SBP00062 | Raspberries | *Vibrio splendidus* |
| SBP00062 | Raspberries | *Vibrio tritonius* |
| SBP00062 | Raspberries | *Vibrio vulnificus* |
| SBP00062 | Raspberries | *Victivallales bacterium* CCUG 44730 |
| SBP00062 | Raspberries | *Virgibacillus halodenitrificans* |
| SBP00062 | Raspberries | *Virgibacillus phasianinus* |
| SBP00062 | Raspberries | *Vitreoscilla* sp. C1 |
| SBP00062 | Raspberries | *Vulgatibacter incomptus* |
| SBP00062 | Raspberries | *Weissella confusa* |
| SBP00062 | Raspberries | *Weissella jogaejeotgali* |
| SBP00062 | Raspberries | Wenling picorna-like virus 3 |
| SBP00062 | Raspberries | *Winogradskyella* sp. J14-2 |
| SBP00062 | Raspberries | *Winogradskyella* sp. PG-2 |
| SBP00062 | Raspberries | *Woeseia oceani* |
| SBP00062 | Raspberries | *Xanthomonas albilineans* |
| SBP00062 | Raspberries | *Xanthomonas campestris* |
| SBP00062 | Raspberries | *Xanthomonas citri* |
| SBP00062 | Raspberries | *Xanthomonas euvesicatoria* |
| SBP00062 | Raspberries | *Xanthomonas oryzae* |
| SBP00062 | Raspberries | *Xanthomonas translucens* |
| SBP00062 | Raspberries | *Xenorhabdus doucetiae* |
| SBP00062 | Raspberries | *Xenorhabdus hominickii* |
| SBP00062 | Raspberries | *Xenorhabdus poinarii* |
| SBP00062 | Raspberries | *Xylella fastidiosa* |
| SBP00062 | Raspberries | *Yersinia enterocolitica* |
| SBP00062 | Raspberries | *Yersinia pseudotuberculosis* |
| SBP00062 | Raspberries | *Yersinia ruckeri* |
| SBP00062 | Raspberries | *Zhongshania aliphaticivorans* |
| SBP00062 | Raspberries | *Zobellia galactanivorans* |
| SBP00062 | Raspberries | *Zunongwangia profunda* |
| SBP00083 | Asparagus | [*Brevibacterium*] *frigoritolerans* |
| SBP00083 | Asparagus | [*Brevibacterium*] *frigoritolerans* |
| SBP00083 | Asparagus | [*Enterobacter*] *lignolyticus* |
| SBP00083 | Asparagus | [*Enterobacter*] *lignolyticus* |
| SBP00083 | Asparagus | [*Mannheimia*] *succiniciproducens* |
| SBP00083 | Asparagus | [*Mannheimia*] *succiniciproducens* |
| SBP00083 | Asparagus | *Achromobacter denitrificans* |
| SBP00083 | Asparagus | *Achromobacter denitrificans* |
| SBP00083 | Asparagus | *Achromobacter insolitus* |
| SBP00083 | Asparagus | *Achromobacter insolitus* |
| SBP00083 | Asparagus | *Achromobacter* sp. AONIH1 |
| SBP00083 | Asparagus | *Achromobacter* sp. AONIH1 |
| SBP00083 | Asparagus | *Achromobacter* sp. B7 |
| SBP00083 | Asparagus | *Achromobacter* sp. B7 |
| SBP00083 | Asparagus | *Achromobacter* sp. MFA1 R4 |
| SBP00083 | Asparagus | *Achromobacter* sp. MFA1 R4 |
| SBP00083 | Asparagus | *Achromobacter spanius* |
| SBP00083 | Asparagus | *Achromobacter spanius* |
| SBP00083 | Asparagus | *Achromobacter xylosoxidans* |
| SBP00083 | Asparagus | *Achromobacter xylosoxidans* |
| SBP00083 | Asparagus | *Acidovorax avenae* |
| SBP00083 | Asparagus | *Acidovorax avenae* |
| SBP00083 | Asparagus | *Acidovorax* sp. KKS102 |
| SBP00083 | Asparagus | *Acidovorax* sp. KKS102 |
| SBP00083 | Asparagus | *Acinetobacter baumannii* |
| SBP00083 | Asparagus | *Acinetobacter baumannii* |
| SBP00083 | Asparagus | *Acinetobacter calcoaceticus* |

TABLE 3-continued

List of species identified in each metagenomic sample of each SBP Sample

| SBP ID | SBP Host Common Name | Genus sp. |
| --- | --- | --- |
| SBP00083 | Asparagus | *Acinetobacter calcoaceticus* |
| SBP00083 | Asparagus | *Acinetobacter haemolyticus* |
| SBP00083 | Asparagus | *Acinetobacter haemolyticus* |
| SBP00083 | Asparagus | *Acinetobacter johnsonii* |
| SBP00083 | Asparagus | *Acinetobacter johnsonii* |
| SBP00083 | Asparagus | *Acinetobacter junii* |
| SBP00083 | Asparagus | *Acinetobacter junii* |
| SBP00083 | Asparagus | *Acinetobacter lactucae* |
| SBP00083 | Asparagus | *Acinetobacter lactucae* |
| SBP00083 | Asparagus | *Acinetobacter nosocomialis* |
| SBP00083 | Asparagus | *Acinetobacter nosocomialis* |
| SBP00083 | Asparagus | *Acinetobacter oleivorans* |
| SBP00083 | Asparagus | *Acinetobacter oleivorans* |
| SBP00083 | Asparagus | *Acinetobacter pittii* |
| SBP00083 | Asparagus | *Acinetobacter pittii* |
| SBP00083 | Asparagus | *Acinetobacter radioresistens* |
| SBP00083 | Asparagus | *Acinetobacter radioresistens* |
| SBP00083 | Asparagus | *Acinetobacter soli* |
| SBP00083 | Asparagus | *Acinetobacter soli* |
| SBP00083 | Asparagus | *Acinetobacter* sp. ACNIH1 |
| SBP00083 | Asparagus | *Acinetobacter* sp. ACNIH1 |
| SBP00083 | Asparagus | *Acinetobacter ursingii* |
| SBP00083 | Asparagus | *Acinetobacter ursingii* |
| SBP00083 | Asparagus | *Acinetobacter venetianus* |
| SBP00083 | Asparagus | *Acinetobacter venetianus* |
| SBP00083 | Asparagus | *Actinoalloteichus hymeniacidonis* |
| SBP00083 | Asparagus | *Actinoalloteichus hymeniacidonis* |
| SBP00083 | Asparagus | *Actinoplanes* sp. ATCC 31351 |
| SBP00083 | Asparagus | *Actinoplanes* sp. ATCC 31351 |
| SBP00083 | Asparagus | *Advenella kashmirensis* |
| SBP00083 | Asparagus | *Advenella kashmirensis* |
| SBP00083 | Asparagus | *Aeromicrobium erythreum* |
| SBP00083 | Asparagus | *Aeromicrobium erythreum* |
| SBP00083 | Asparagus | *Aeromonas hydrophila* |
| SBP00083 | Asparagus | *Aeromonas hydrophila* |
| SBP00083 | Asparagus | *Aeromonas media* |
| SBP00083 | Asparagus | *Aeromonas media* |
| SBP00083 | Asparagus | *Aeromonas salmonicida* |
| SBP00083 | Asparagus | *Aeromonas salmonicida* |
| SBP00083 | Asparagus | *Aeromonas schubertii* |
| SBP00083 | Asparagus | *Aeromonas schubertii* |
| SBP00083 | Asparagus | *Aeromonas* sp. ASNIH4 |
| SBP00083 | Asparagus | *Aeromonas* sp. ASNIH4 |
| SBP00083 | Asparagus | *Aeromonas veronii* |
| SBP00083 | Asparagus | *Aeromonas veronii* |
| SBP00083 | Asparagus | *Aggregatibacter aphrophilus* |
| SBP00083 | Asparagus | *Aggregatibacter aphrophilus* |
| SBP00083 | Asparagus | *Aggregatibacter segnis* |
| SBP00083 | Asparagus | *Aggregatibacter segnis* |
| SBP00083 | Asparagus | *Agrobacterium fabrum* |
| SBP00083 | Asparagus | *Agrobacterium fabrum* |
| SBP00083 | Asparagus | *Agrobacterium rhizogenes* |
| SBP00083 | Asparagus | *Agrobacterium rhizogenes* |
| SBP00083 | Asparagus | *Agrobacterium* sp. |
| SBP00083 | Asparagus | *Agrobacterium* sp. |
| SBP00083 | Asparagus | *Agrobacterium tumefaciens* |
| SBP00083 | Asparagus | *Agrobacterium tumefaciens* |
| SBP00083 | Asparagus | *Agrobacterium vitis* |
| SBP00083 | Asparagus | *Agrobacterium vitis* |
| SBP00083 | Asparagus | *Agrococcus carbonis* |
| SBP00083 | Asparagus | *Agrococcus carbonis* |
| SBP00083 | Asparagus | *Agromyces aureus* |
| SBP00083 | Asparagus | *Agromyces aureus* |
| SBP00083 | Asparagus | *Alcaligenes faecalis* |
| SBP00083 | Asparagus | *Alcaligenes faecalis* |
| SBP00083 | Asparagus | *Alcanivorax pacificus* |
| SBP00083 | Asparagus | *Alcanivorax pacificus* |
| SBP00083 | Asparagus | *Alicycliphilus denitrificans* |
| SBP00083 | Asparagus | *Alicycliphilus denitrificans* |
| SBP00083 | Asparagus | *Aliivibrio fischeri* |
| SBP00083 | Asparagus | *Aliivibrio fischeri* |
| SBP00083 | Asparagus | *Aliivibrio salmonicida* |
| SBP00083 | Asparagus | *Aliivibrio salmonicida* |
| SBP00083 | Asparagus | *Aliivibrio wodanis* |
| SBP00083 | Asparagus | *Aliivibrio wodanis* |
| SBP00083 | Asparagus | *Alteromonas macleodii* |

TABLE 3-continued

List of species identified in each metagenomic sample of each SBP Sample

| SBP ID | SBP Host Common Name | Genus sp. |
|---|---|---|
| SBP00083 | Asparagus | *Alteromonas macleodii* |
| SBP00083 | Asparagus | *Amycolatopsis albispora* |
| SBP00083 | Asparagus | *Amycolatopsis albispora* |
| SBP00083 | Asparagus | *Amycolatopsis mediterranei* |
| SBP00083 | Asparagus | *Amycolatopsis mediterranei* |
| SBP00083 | Asparagus | *Amycolatopsis methanolica* |
| SBP00083 | Asparagus | *Amycolatopsis methanolica* |
| SBP00083 | Asparagus | *Aquabacterium olei* |
| SBP00083 | Asparagus | *Aquabacterium olei* |
| SBP00083 | Asparagus | *Archangium gephyra* |
| SBP00083 | Asparagus | *Archangium gephyra* |
| SBP00083 | Asparagus | *Arsenophonus nasoniae* |
| SBP00083 | Asparagus | *Arsenophonus nasoniae* |
| SBP00083 | Asparagus | *Arthrobacter* sp. PGP41 |
| SBP00083 | Asparagus | *Arthrobacter* sp. PGP41 |
| SBP00083 | Asparagus | *Atlantibacter hermannii* |
| SBP00083 | Asparagus | *Atlantibacter hermannii* |
| SBP00083 | Asparagus | *Aureimonas* sp. AU20 |
| SBP00083 | Asparagus | *Aureimonas* sp. AU20 |
| SBP00083 | Asparagus | *Avibacterium volantium* |
| SBP00083 | Asparagus | *Avibacterium volantium* |
| SBP00083 | Asparagus | *Azoarcus communis* |
| SBP00083 | Asparagus | *Azoarcus communis* |
| SBP00083 | Asparagus | *Azospirillum brasilense* |
| SBP00083 | Asparagus | *Azospirillum brasilense* |
| SBP00083 | Asparagus | *Azospirillum lipoferum* |
| SBP00083 | Asparagus | *Azospirillum lipoferum* |
| SBP00083 | Asparagus | *Azotobacter chroococcum* |
| SBP00083 | Asparagus | *Azotobacter chroococcum* |
| SBP00083 | Asparagus | *Azotobacter vinelandii* |
| SBP00083 | Asparagus | *Azotobacter vinelandii* |
| SBP00083 | Asparagus | *Bacillus aerophilus* |
| SBP00083 | Asparagus | *Bacillus aerophilus* |
| SBP00083 | Asparagus | *Bacillus albus* |
| SBP00083 | Asparagus | *Bacillus albus* |
| SBP00083 | Asparagus | *Bacillus altitudinis* |
| SBP00083 | Asparagus | *Bacillus altitudinis* |
| SBP00083 | Asparagus | *Bacillus amyloliquefaciens* |
| SBP00083 | Asparagus | *Bacillus amyloliquefaciens* |
| SBP00083 | Asparagus | *Bacillus anthracis* |
| SBP00083 | Asparagus | *Bacillus anthracis* |
| SBP00083 | Asparagus | *Bacillus asahii* |
| SBP00083 | Asparagus | *Bacillus asahii* |
| SBP00083 | Asparagus | *Bacillus atrophaeus* |
| SBP00083 | Asparagus | *Bacillus atrophaeus* |
| SBP00083 | Asparagus | *Bacillus bombysepticus* |
| SBP00083 | Asparagus | *Bacillus bombysepticus* |
| SBP00083 | Asparagus | *Bacillus butanolivorans* |
| SBP00083 | Asparagus | *Bacillus butanolivorans* |
| SBP00083 | Asparagus | *Bacillus cellulosilyticus* |
| SBP00083 | Asparagus | *Bacillus cellulosilyticus* |
| SBP00083 | Asparagus | *Bacillus cereus* |
| SBP00083 | Asparagus | *Bacillus cereus* |
| SBP00083 | Asparagus | *Bacillus circulans* |
| SBP00083 | Asparagus | *Bacillus circulans* |
| SBP00083 | Asparagus | *Bacillus cytotoxicus* |
| SBP00083 | Asparagus | *Bacillus cytotoxicus* |
| SBP00083 | Asparagus | *Bacillus flexus* |
| SBP00083 | Asparagus | *Bacillus flexus* |
| SBP00083 | Asparagus | *Bacillus foraminis* |
| SBP00083 | Asparagus | *Bacillus foraminis* |
| SBP00083 | Asparagus | *Bacillus gobiensis* |
| SBP00083 | Asparagus | *Bacillus gobiensis* |
| SBP00083 | Asparagus | *Bacillus infantis* |
| SBP00083 | Asparagus | *Bacillus infantis* |
| SBP00083 | Asparagus | *Bacillus litoralis* |
| SBP00083 | Asparagus | *Bacillus litoralis* |
| SBP00083 | Asparagus | *Bacillus marisflavi* |
| SBP00083 | Asparagus | *Bacillus marisflavi* |
| SBP00083 | Asparagus | *Bacillus megaterium* |
| SBP00083 | Asparagus | *Bacillus megaterium* |
| SBP00083 | Asparagus | *Bacillus mobilis* |
| SBP00083 | Asparagus | *Bacillus mobilis* |
| SBP00083 | Asparagus | *Bacillus mycoides* |
| SBP00083 | Asparagus | *Bacillus mycoides* |
| SBP00083 | Asparagus | *Bacillus paralicheniformis* |

TABLE 3-continued

List of species identified in each metagenomic sample of each SBP Sample

| SBP ID | SBP Host Common Name | Genus sp. |
|---|---|---|
| SBP00083 | Asparagus | *Bacillus paralicheniformis* |
| SBP00083 | Asparagus | *Bacillus paranthracis* |
| SBP00083 | Asparagus | *Bacillus paranthracis* |
| SBP00083 | Asparagus | *Bacillus pseudomycoides* |
| SBP00083 | Asparagus | *Bacillus pseudomycoides* |
| SBP00083 | Asparagus | *Bacillus pumilus* |
| SBP00083 | Asparagus | *Bacillus pumilus* |
| SBP00083 | Asparagus | *Bacillus safensis* |
| SBP00083 | Asparagus | *Bacillus safensis* |
| SBP00083 | Asparagus | *Bacillus simplex* |
| SBP00083 | Asparagus | *Bacillus simplex* |
| SBP00083 | Asparagus | *Bacillus* sp. (in: Bacteria) |
| SBP00083 | Asparagus | *Bacillus* sp. (in: Bacteria) |
| SBP00083 | Asparagus | *Bacillus* sp. ABP14 |
| SBP00083 | Asparagus | *Bacillus* sp. ABP14 |
| SBP00083 | Asparagus | *Bacillus* sp. FDAARGOS_235 |
| SBP00083 | Asparagus | *Bacillus* sp. FDAARGOS_235 |
| SBP00083 | Asparagus | *Bacillus* sp. FJAT-22090 |
| SBP00083 | Asparagus | *Bacillus* sp. FJAT-22090 |
| SBP00083 | Asparagus | *Bacillus* sp. HBCD-sjtu |
| SBP00083 | Asparagus | *Bacillus* sp. HBCD-sjtu |
| SBP00083 | Asparagus | *Bacillus* sp. WP8 |
| SBP00083 | Asparagus | *Bacillus* sp. WP8 |
| SBP00083 | Asparagus | *Bacillus* sp. Y1 |
| SBP00083 | Asparagus | *Bacillus* sp. Y1 |
| SBP00083 | Asparagus | *Bacillus subtilis* |
| SBP00083 | Asparagus | *Bacillus subtilis* |
| SBP00083 | Asparagus | *Bacillus thuringiensis* |
| SBP00083 | Asparagus | *Bacillus thuringiensis* |
| SBP00083 | Asparagus | *Bacillus vallismortis* |
| SBP00083 | Asparagus | *Bacillus vallismortis* |
| SBP00083 | Asparagus | *Bacillus velezensis* |
| SBP00083 | Asparagus | *Bacillus velezensis* |
| SBP00083 | Asparagus | *Bacillus wiedmannii* |
| SBP00083 | Asparagus | *Bacillus wiedmannii* |
| SBP00083 | Asparagus | *Bacillus xiamenensis* |
| SBP00083 | Asparagus | *Bacillus xiamenensis* |
| SBP00083 | Asparagus | BeAn 58058 virus |
| SBP00083 | Asparagus | BeAn 58058 virus |
| SBP00083 | Asparagus | *Beutenbergia cavernae* |
| SBP00083 | Asparagus | *Beutenbergia cavernae* |
| SBP00083 | Asparagus | *Bordetella petrii* |
| SBP00083 | Asparagus | *Bordetella petrii* |
| SBP00083 | Asparagus | *Bordetella pseudohinzii* |
| SBP00083 | Asparagus | *Bordetella pseudohinzii* |
| SBP00083 | Asparagus | *Bordetella trematum* |
| SBP00083 | Asparagus | *Bordetella trematum* |
| SBP00083 | Asparagus | *Brachybacterium* sp. VR2415 |
| SBP00083 | Asparagus | *Brachybacterium* sp. VR2415 |
| SBP00083 | Asparagus | *Bradyrhizobium icense* |
| SBP00083 | Asparagus | *Bradyrhizobium icense* |
| SBP00083 | Asparagus | *Bradyrhizobium ottawaense* |
| SBP00083 | Asparagus | *Bradyrhizobium ottawaense* |
| SBP00083 | Asparagus | *Bradyrhizobium* sp. S23321 |
| SBP00083 | Asparagus | *Bradyrhizobium* sp. S23321 |
| SBP00083 | Asparagus | *Brenneria goodwinii* |
| SBP00083 | Asparagus | *Brenneria goodwinii* |
| SBP00083 | Asparagus | *Brenneria rubrifaciens* |
| SBP00083 | Asparagus | *Brenneria rubrifaciens* |
| SBP00083 | Asparagus | *Brevibacillus brevis* |
| SBP00083 | Asparagus | *Brevibacillus brevis* |
| SBP00083 | Asparagus | *Brevibacillus laterosporus* |
| SBP00083 | Asparagus | *Brevibacillus laterosporus* |
| SBP00083 | Asparagus | *Brevibacterium linens* |
| SBP00083 | Asparagus | *Brevibacterium linens* |
| SBP00083 | Asparagus | *Brevirhabdus pacifica* |
| SBP00083 | Asparagus | *Brevirhabdus pacifica* |
| SBP00083 | Asparagus | *Brevundimonas* sp. DS20 |
| SBP00083 | Asparagus | *Brevundimonas* sp. DS20 |
| SBP00083 | Asparagus | *Buchnera aphidicola* |
| SBP00083 | Asparagus | *Buchnera aphidicola* |
| SBP00083 | Asparagus | *Burkholderia ambifaria* |
| SBP00083 | Asparagus | *Burkholderia ambifaria* |
| SBP00083 | Asparagus | *Burkholderia anthina* |
| SBP00083 | Asparagus | *Burkholderia anthina* |
| SBP00083 | Asparagus | *Burkholderia cenocepacia* |

TABLE 3-continued

List of species identified in each metagenomic sample of each SBP Sample

| SBP ID | SBP Host Common Name | Genus sp. |
|---|---|---|
| SBP00083 | Asparagus | *Burkholderia cenocepacia* |
| SBP00083 | Asparagus | *Burkholderia cepacia* |
| SBP00083 | Asparagus | *Burkholderia cepacia* |
| SBP00083 | Asparagus | *Burkholderia contaminans* |
| SBP00083 | Asparagus | *Burkholderia contaminans* |
| SBP00083 | Asparagus | *Burkholderia gladioli* |
| SBP00083 | Asparagus | *Burkholderia gladioli* |
| SBP00083 | Asparagus | *Burkholderia multivorans* |
| SBP00083 | Asparagus | *Burkholderia multivorans* |
| SBP00083 | Asparagus | *Burkholderia pseudomallei* |
| SBP00083 | Asparagus | *Burkholderia pseudomallei* |
| SBP00083 | Asparagus | *Burkholderia* sp. Bp7605 |
| SBP00083 | Asparagus | *Burkholderia* sp. Bp7605 |
| SBP00083 | Asparagus | *Burkholderia* sp. CCGE1002 |
| SBP00083 | Asparagus | *Burkholderia* sp. CCGE1002 |
| SBP00083 | Asparagus | *Burkholderia stabilis* |
| SBP00083 | Asparagus | *Burkholderia stabilis* |
| SBP00083 | Asparagus | *Burkholderia ubonensis* |
| SBP00083 | Asparagus | *Burkholderia ubonensis* |
| SBP00083 | Asparagus | *Burkholderia vietnamiensis* |
| SBP00083 | Asparagus | *Burkholderia vietnamiensis* |
| SBP00083 | Asparagus | *Burkholderiales bacterium* JOSHI_001 |
| SBP00083 | Asparagus | *Burkholderiales bacterium* JOSHI_001 |
| SBP00083 | Asparagus | *Buttiauxella* sp. 3AFRM03 |
| SBP00083 | Asparagus | *Buttiauxella* sp. 3AFRM03 |
| SBP00083 | Asparagus | *Calothrix parietina* |
| SBP00083 | Asparagus | *Calothrix parietina* |
| SBP00083 | Asparagus | *Candidatus Baumannia cicadellinicola* |
| SBP00083 | Asparagus | *Candidatus Baumannia cicadellinicola* |
| SBP00083 | Asparagus | *Candidatus Fukatsuia symbiotica* |
| SBP00083 | Asparagus | *Candidatus Fukatsuia symbiotica* |
| SBP00083 | Asparagus | *Candidatus Hoaglandella endobia* |
| SBP00083 | Asparagus | *Candidatus Hoaglandella endobia* |
| SBP00083 | Asparagus | *Candidatus Methylopumilus planktonicus* |
| SBP00083 | Asparagus | *Candidatus Methylopumilus planktonicus* |
| SBP00083 | Asparagus | *Candidatus Pantoea carbekii* |
| SBP00083 | Asparagus | *Candidatus Pantoea carbekii* |
| SBP00083 | Asparagus | *Candidatus Sodalis pierantonius* |
| SBP00083 | Asparagus | *Candidatus Sodalis pierantonius* |
| SBP00083 | Asparagus | *Catenulispora acidiphila* |
| SBP00083 | Asparagus | *Catenulispora acidiphila* |
| SBP00083 | Asparagus | *Caulobacter flavus* |
| SBP00083 | Asparagus | *Caulobacter flavus* |
| SBP00083 | Asparagus | *Cedecea lapagei* |
| SBP00083 | Asparagus | *Cedecea lapagei* |
| SBP00083 | Asparagus | *Cedecea neteri* |
| SBP00083 | Asparagus | *Cedecea neteri* |
| SBP00083 | Asparagus | *Cellulosimicrobium cellulans* |
| SBP00083 | Asparagus | *Cellulosimicrobium cellulans* |
| SBP00083 | Asparagus | *Cellulosimicrobium* sp. TH-20 |
| SBP00083 | Asparagus | *Cellulosimicrobium* sp. TH-20 |
| SBP00083 | Asparagus | *Cellvibrio japonicus* |
| SBP00083 | Asparagus | *Cellvibrio japonicus* |
| SBP00083 | Asparagus | *Cellvibrio* sp. PSBB006 |
| SBP00083 | Asparagus | *Cellvibrio* sp. PSBB006 |
| SBP00083 | Asparagus | *Chania multitudinisentens* |
| SBP00083 | Asparagus | *Chania multitudinisentens* |
| SBP00083 | Asparagus | *Chitinophaga pinensis* |
| SBP00083 | Asparagus | *Chitinophaga pinensis* |
| SBP00083 | Asparagus | *Chromohalobacter salexigens* |
| SBP00083 | Asparagus | *Chromohalobacter salexigens* |
| SBP00083 | Asparagus | *Chryseobacterium balustinum* |
| SBP00083 | Asparagus | *Chryseobacterium balustinum* |
| SBP00083 | Asparagus | *Chryseobacterium indologenes* |
| SBP00083 | Asparagus | *Chryseobacterium indologenes* |
| SBP00083 | Asparagus | *Chryseobacterium indoltheticum* |
| SBP00083 | Asparagus | *Chryseobacterium indoltheticum* |
| SBP00083 | Asparagus | *Chryseobacterium* sp. IHB B 17019 |
| SBP00083 | Asparagus | *Chryseobacterium* sp. IHB B 17019 |
| SBP00083 | Asparagus | *Citrobacter amalonaticus* |
| SBP00083 | Asparagus | *Citrobacter amalonaticus* |
| SBP00083 | Asparagus | *Citrobacter braakii* |
| SBP00083 | Asparagus | *Citrobacter braakii* |
| SBP00083 | Asparagus | *Citrobacter farmeri* |
| SBP00083 | Asparagus | *Citrobacter farmeri* |
| SBP00083 | Asparagus | *Citrobacter freundii* |

TABLE 3-continued

List of species identified in each metagenomic sample of each SBP Sample

| SBP ID | SBP Host Common Name | Genus sp. |
|---|---|---|
| SBP00083 | Asparagus | *Citrobacter freundii* |
| SBP00083 | Asparagus | *Citrobacter freundii* complex sp. CFNIH2 |
| SBP00083 | Asparagus | *Citrobacter freundii* complex sp. CFNIH2 |
| SBP00083 | Asparagus | *Citrobacter freundii* complex sp. CFNIH3 |
| SBP00083 | Asparagus | *Citrobacter freundii* complex sp. CFNIH3 |
| SBP00083 | Asparagus | *Citrobacter freundii* complex sp. CFNIH9 |
| SBP00083 | Asparagus | *Citrobacter freundii* complex sp. CFNIH9 |
| SBP00083 | Asparagus | *Citrobacter koseri* |
| SBP00083 | Asparagus | *Citrobacter koseri* |
| SBP00083 | Asparagus | *Citrobacter pasteurii* |
| SBP00083 | Asparagus | *Citrobacter pasteurii* |
| SBP00083 | Asparagus | *Citrobacter portucalensis* |
| SBP00083 | Asparagus | *Citrobacter portucalensis* |
| SBP00083 | Asparagus | *Citrobacter rodentium* |
| SBP00083 | Asparagus | *Citrobacter rodentium* |
| SBP00083 | Asparagus | *Citrobacter* sp. CFNIH10 |
| SBP00083 | Asparagus | *Citrobacter* sp. CFNIH10 |
| SBP00083 | Asparagus | *Citrobacter* sp. CRE-46 |
| SBP00083 | Asparagus | *Citrobacter* sp. CRE-46 |
| SBP00083 | Asparagus | *Citrobacter* sp. FDAARGOS_156 |
| SBP00083 | Asparagus | *Citrobacter* sp. FDAARGOS_156 |
| SBP00083 | Asparagus | *Citrobacter werkmanii* |
| SBP00083 | Asparagus | *Citrobacter werkmanii* |
| SBP00083 | Asparagus | *Citrobacter youngae* |
| SBP00083 | Asparagus | *Citrobacter youngae* |
| SBP00083 | Asparagus | *Citromicrobium* sp. JL477 |
| SBP00083 | Asparagus | *Citromicrobium* sp. JL477 |
| SBP00083 | Asparagus | *Collimonas pratensis* |
| SBP00083 | Asparagus | *Collimonas pratensis* |
| SBP00083 | Asparagus | *Comamonas serinivorans* |
| SBP00083 | Asparagus | *Comamonas serinivorans* |
| SBP00083 | Asparagus | *Conexibacter woesei* |
| SBP00083 | Asparagus | *Conexibacter woesei* |
| SBP00083 | Asparagus | *Corallococcus coralloides* |
| SBP00083 | Asparagus | *Corallococcus coralloides* |
| SBP00083 | Asparagus | *Corynebacterium aurimucosum* |
| SBP00083 | Asparagus | *Corynebacterium aurimucosum* |
| SBP00083 | Asparagus | *Corynebacterium jeikeium* |
| SBP00083 | Asparagus | *Corynebacterium jeikeium* |
| SBP00083 | Asparagus | *Corynebacterium segmentosum* |
| SBP00083 | Asparagus | *Corynebacterium segmentosum* |
| SBP00083 | Asparagus | *Corynebacterium sphenisci* |
| SBP00083 | Asparagus | *Corynebacterium sphenisci* |
| SBP00083 | Asparagus | *Corynebacterium stationis* |
| SBP00083 | Asparagus | *Corynebacterium stationis* |
| SBP00083 | Asparagus | *Cronobacter condimenti* |
| SBP00083 | Asparagus | *Cronobacter condimenti* |
| SBP00083 | Asparagus | *Cronobacter dublinensis* |
| SBP00083 | Asparagus | *Cronobacter dublinensis* |
| SBP00083 | Asparagus | *Cronobacter malonaticus* |
| SBP00083 | Asparagus | *Cronobacter malonaticus* |
| SBP00083 | Asparagus | *Cronobacter muytjensii* |
| SBP00083 | Asparagus | *Cronobacter muytjensii* |
| SBP00083 | Asparagus | *Cronobacter sakazakii* |
| SBP00083 | Asparagus | *Cronobacter sakazakii* |
| SBP00083 | Asparagus | *Cronobacter turicensis* |
| SBP00083 | Asparagus | *Cronobacter turicensis* |
| SBP00083 | Asparagus | *Cronobacter universalis* |
| SBP00083 | Asparagus | *Cronobacter universalis* |
| SBP00083 | Asparagus | *Cupriavidus basilensis* |
| SBP00083 | Asparagus | *Cupriavidus basilensis* |
| SBP00083 | Asparagus | *Cupriavidus metallidurans* |
| SBP00083 | Asparagus | *Cupriavidus metallidurans* |
| SBP00083 | Asparagus | *Cupriavidus necator* |
| SBP00083 | Asparagus | *Cupriavidus necator* |
| SBP00083 | Asparagus | *Cupriavidus oxalaticus* |
| SBP00083 | Asparagus | *Cupriavidus oxalaticus* |
| SBP00083 | Asparagus | *Cupriavidus pauculus* |
| SBP00083 | Asparagus | *Cupriavidus pauculus* |
| SBP00083 | Asparagus | *Cupriavidus pinatubonensis* |
| SBP00083 | Asparagus | *Cupriavidus pinatubonensis* |
| SBP00083 | Asparagus | *Cupriavidus taiwanensis* |
| SBP00083 | Asparagus | *Cupriavidus taiwanensis* |
| SBP00083 | Asparagus | *Curtobacterium pusillum* |
| SBP00083 | Asparagus | *Curtobacterium pusillum* |
| SBP00083 | Asparagus | *Curtobacterium* sp. BH-2-1-1 |

TABLE 3-continued

List of species identified in each metagenomic sample of each SBP Sample

| SBP ID | SBP Host Common Name | Genus sp. |
|---|---|---|
| SBP00083 | Asparagus | *Curtobacterium* sp. BH-2-1-1 |
| SBP00083 | Asparagus | *Curtobacterium* sp. MR_MD2014 |
| SBP00083 | Asparagus | *Curtobacterium* sp. MR_MD2014 |
| SBP00083 | Asparagus | *Curtobacterium* sp. SGAir0471 |
| SBP00083 | Asparagus | *Curtobacterium* sp. SGAir0471 |
| SBP00083 | Asparagus | *Cutibacterium acnes* |
| SBP00083 | Asparagus | *Cutibacterium acnes* |
| SBP00083 | Asparagus | *Cystobacter fuscus* |
| SBP00083 | Asparagus | *Cystobacter fuscus* |
| SBP00083 | Asparagus | *Delftia* sp. |
| SBP00083 | Asparagus | *Delftia* sp. |
| SBP00083 | Asparagus | *Delftia tsuruhatensis* |
| SBP00083 | Asparagus | *Delftia tsuruhatensis* |
| SBP00083 | Asparagus | *Devosia* sp. H5989 |
| SBP00083 | Asparagus | *Devosia* sp. H5989 |
| SBP00083 | Asparagus | *Dickeya chrysanthemi* |
| SBP00083 | Asparagus | *Dickeya chrysanthemi* |
| SBP00083 | Asparagus | *Dickeya dadantii* |
| SBP00083 | Asparagus | *Dickeya dadantii* |
| SBP00083 | Asparagus | *Dickeya dianthicola* |
| SBP00083 | Asparagus | *Dickeya dianthicola* |
| SBP00083 | Asparagus | *Dickeya fangzhongdai* |
| SBP00083 | Asparagus | *Dickeya fangzhongdai* |
| SBP00083 | Asparagus | *Dickeya paradisiaca* |
| SBP00083 | Asparagus | *Dickeya paradisiaca* |
| SBP00083 | Asparagus | *Dickeya solani* |
| SBP00083 | Asparagus | *Dickeya solani* |
| SBP00083 | Asparagus | *Dickeya* sp. MK7 |
| SBP00083 | Asparagus | *Dickeya* sp. MK7 |
| SBP00083 | Asparagus | *Dickeya* sp. NCPPB 3274 |
| SBP00083 | Asparagus | *Dickeya* sp. NCPPB 3274 |
| SBP00083 | Asparagus | *Dickeya* sp. NCPPB 569 |
| SBP00083 | Asparagus | *Dickeya* sp. NCPPB 569 |
| SBP00083 | Asparagus | *Dickeya* sp. Secpp 1600 |
| SBP00083 | Asparagus | *Dickeya* sp. Secpp 1600 |
| SBP00083 | Asparagus | *Dickeya zeae* |
| SBP00083 | Asparagus | *Dickeya zeae* |
| SBP00083 | Asparagus | *Diptera* sp. BOLD: AAB3286 |
| SBP00083 | Asparagus | *Diptera* sp. BOLD: AAB3286 |
| SBP00083 | Asparagus | *Dokdonella koreensis* |
| SBP00083 | Asparagus | *Dokdonella koreensis* |
| SBP00083 | Asparagus | *Edwardsiella hoshinae* |
| SBP00083 | Asparagus | *Edwardsiella hoshinae* |
| SBP00083 | Asparagus | *Edwardsiella ictaluri* |
| SBP00083 | Asparagus | *Edwardsiella ictaluri* |
| SBP00083 | Asparagus | *Edwardsiella tarda* |
| SBP00083 | Asparagus | *Edwardsiella tarda* |
| SBP00083 | Asparagus | *Elizabethkingia anophelis* |
| SBP00083 | Asparagus | *Elizabethkingia anophelis* |
| SBP00083 | Asparagus | *Endozoicomonas montiporae* |
| SBP00083 | Asparagus | *Endozoicomonas montiporae* |
| SBP00083 | Asparagus | *Ensifer sojae* |
| SBP00083 | Asparagus | *Ensifer sojae* |
| SBP00083 | Asparagus | *Enterobacter asburiae* |
| SBP00083 | Asparagus | *Enterobacter asburiae* |
| SBP00083 | Asparagus | *Enterobacter bugandensis* |
| SBP00083 | Asparagus | *Enterobacter bugandensis* |
| SBP00083 | Asparagus | *Enterobacter cancerogenus* |
| SBP00083 | Asparagus | *Enterobacter cancerogenus* |
| SBP00083 | Asparagus | *Enterobacter cloacae* |
| SBP00083 | Asparagus | *Enterobacter cloacae* |
| SBP00083 | Asparagus | *Enterobacter cloacae* complex sp. |
| SBP00083 | Asparagus | *Enterobacter cloacae* complex sp. |
| SBP00083 | Asparagus | *Enterobacter cloacae* complex sp. ECNIH7 |
| SBP00083 | Asparagus | *Enterobacter cloacae* complex sp. ECNIH7 |
| SBP00083 | Asparagus | *Enterobacter cloacae* complex sp. FDA-CDC-AR_0132 |
| SBP00083 | Asparagus | *Enterobacter cloacae* complex sp. FDA-CDC-AR_0132 |
| SBP00083 | Asparagus | *Enterobacter cloacae* complex sp. FDA-CDC-AR_0164 |
| SBP00083 | Asparagus | *Enterobacter cloacae* complex sp. FDA-CDC-AR_0164 |
| SBP00083 | Asparagus | *Enterobacter hormaechei* |
| SBP00083 | Asparagus | *Enterobacter hormaechei* |
| SBP00083 | Asparagus | *Enterobacter kobei* |
| SBP00083 | Asparagus | *Enterobacter kobei* |
| SBP00083 | Asparagus | *Enterobacter ludwigii* |
| SBP00083 | Asparagus | *Enterobacter ludwigii* |
| SBP00083 | Asparagus | *Enterobacter phage Arya* |

TABLE 3-continued

List of species identified in each metagenomic sample of each SBP Sample

| SBP ID | SBP Host Common Name | Genus sp. |
|---|---|---|
| SBP00083 | Asparagus | *Enterobacter phage Arya* |
| SBP00083 | Asparagus | *Enterobacter roggenkampii* |
| SBP00083 | Asparagus | *Enterobacter roggenkampii* |
| SBP00083 | Asparagus | *Enterobacter soli* |
| SBP00083 | Asparagus | *Enterobacter soli* |
| SBP00083 | Asparagus | *Enterobacter* sp. 638 |
| SBP00083 | Asparagus | *Enterobacter* sp. 638 |
| SBP00083 | Asparagus | *Enterobacter* sp. Crenshaw |
| SBP00083 | Asparagus | *Enterobacter* sp. Crenshaw |
| SBP00083 | Asparagus | *Enterobacter* sp. DKU_NT_01 |
| SBP00083 | Asparagus | *Enterobacter* sp. DKU_NT_01 |
| SBP00083 | Asparagus | *Enterobacter* sp. E20 |
| SBP00083 | Asparagus | *Enterobacter* sp. E20 |
| SBP00083 | Asparagus | *Enterobacter* sp. FY-07 |
| SBP00083 | Asparagus | *Enterobacter* sp. FY-07 |
| SBP00083 | Asparagus | *Enterobacter* sp. HK169 |
| SBP00083 | Asparagus | *Enterobacter* sp. HK169 |
| SBP00083 | Asparagus | *Enterobacter* sp. N18-03635 |
| SBP00083 | Asparagus | *Enterobacter* sp. N18-03635 |
| SBP00083 | Asparagus | *Enterobacter* sp. ODB01 |
| SBP00083 | Asparagus | *Enterobacter* sp. ODB01 |
| SBP00083 | Asparagus | *Enterobacter* sp. R4-368 |
| SBP00083 | Asparagus | *Enterobacter* sp. R4-368 |
| SBP00083 | Asparagus | *Enterobacter* sp. RFL1396 |
| SBP00083 | Asparagus | *Enterobacter* sp. RFL1396 |
| SBP00083 | Asparagus | *Enterobacter* sp. SA187 |
| SBP00083 | Asparagus | *Enterobacter* sp. SA187 |
| SBP00083 | Asparagus | *Enterobacteriaceae bacterium* ENNIH1 |
| SBP00083 | Asparagus | *Enterobacteriaceae bacterium* ENNIH1 |
| SBP00083 | Asparagus | *Enterobacteriaceae bacterium* strain FGI 57 |
| SBP00083 | Asparagus | *Enterobacteriaceae bacterium* strain FGI 57 |
| SBP00083 | Asparagus | *Enterobacteriaceae bacterium* w17 |
| SBP00083 | Asparagus | *Enterobacteriaceae bacterium* w17 |
| SBP00083 | Asparagus | *Enterobacteriaceae bacterium* w6 |
| SBP00083 | Asparagus | *Enterobacteriaceae bacterium* w6 |
| SBP00083 | Asparagus | *Enterococcus casseliflavus* |
| SBP00083 | Asparagus | *Enterococcus casseliflavus* |
| SBP00083 | Asparagus | *Enterococcus gallinarum* |
| SBP00083 | Asparagus | *Enterococcus gallinarum* |
| SBP00083 | Asparagus | *Enterococcus mundtii* |
| SBP00083 | Asparagus | *Enterococcus mundtii* |
| SBP00083 | Asparagus | *Enterococcus* sp. CR-Ec1 |
| SBP00083 | Asparagus | *Enterococcus* sp. CR-Ec1 |
| SBP00083 | Asparagus | *Enterococcus* sp. FDAARGOS_375 |
| SBP00083 | Asparagus | *Enterococcus* sp. FDAARGOS_375 |
| SBP00083 | Asparagus | *Epibacterium mobile* |
| SBP00083 | Asparagus | *Epibacterium mobile* |
| SBP00083 | Asparagus | *Erwinia amylovora* |
| SBP00083 | Asparagus | *Erwinia amylovora* |
| SBP00083 | Asparagus | *Erwinia billingiae* |
| SBP00083 | Asparagus | *Erwinia billingiae* |
| SBP00083 | Asparagus | *Erwinia gerundensis* |
| SBP00083 | Asparagus | *Erwinia gerundensis* |
| SBP00083 | Asparagus | *Erwinia persicina* |
| SBP00083 | Asparagus | *Erwinia persicina* |
| SBP00083 | Asparagus | *Erwinia pyrifoliae* |
| SBP00083 | Asparagus | *Erwinia pyrifoliae* |
| SBP00083 | Asparagus | *Erwinia* sp. |
| SBP00083 | Asparagus | *Erwinia* sp. |
| SBP00083 | Asparagus | *Erwinia* sp. Ejp617 |
| SBP00083 | Asparagus | *Erwinia* sp. Ejp617 |
| SBP00083 | Asparagus | *Erwinia tasmaniensis* |
| SBP00083 | Asparagus | *Erwinia tasmaniensis* |
| SBP00083 | Asparagus | *Escherichia albertii* |
| SBP00083 | Asparagus | *Escherichia albertii* |
| SBP00083 | Asparagus | *Escherichia coli* |
| SBP00083 | Asparagus | *Escherichia coli* |
| SBP00083 | Asparagus | *Escherichia fergusonii* |
| SBP00083 | Asparagus | *Escherichia fergusonii* |
| SBP00083 | Asparagus | *Escherichia marmotae* |
| SBP00083 | Asparagus | *Escherichia marmotae* |
| SBP00083 | Asparagus | *Escherichia* sp. E4742 |
| SBP00083 | Asparagus | *Escherichia* sp. E4742 |
| SBP00083 | Asparagus | *Exiguobacterium antarcticum* |
| SBP00083 | Asparagus | *Exiguobacterium antarcticum* |
| SBP00083 | Asparagus | *Exiguobacterium mexicanum* |

TABLE 3-continued

List of species identified in each metagenomic sample of each SBP Sample

| SBP ID | SBP Host Common Name | Genus sp. |
|---|---|---|
| SBP00083 | Asparagus | *Exiguobacterium mexicanum* |
| SBP00083 | Asparagus | *Exiguobacterium sibiricum* |
| SBP00083 | Asparagus | *Exiguobacterium sibiricum* |
| SBP00083 | Asparagus | *Exiguobacterium* sp. AT1b |
| SBP00083 | Asparagus | *Exiguobacterium* sp. AT1b |
| SBP00083 | Asparagus | *Exiguobacterium* sp. MH3 |
| SBP00083 | Asparagus | *Exiguobacterium* sp. MH3 |
| SBP00083 | Asparagus | *Exiguobacterium* sp. N4-1P |
| SBP00083 | Asparagus | *Exiguobacterium* sp. N4-1P |
| SBP00083 | Asparagus | *Exiguobacterium* sp. U13-1 |
| SBP00083 | Asparagus | *Exiguobacterium* sp. U13-1 |
| SBP00083 | Asparagus | *Exiguobacterium* sp. ZWU0009 |
| SBP00083 | Asparagus | *Exiguobacterium* sp. ZWU0009 |
| SBP00083 | Asparagus | *Fibrella* sp. ES10-3-2-2 |
| SBP00083 | Asparagus | *Fibrella* sp. ES10-3-2-2 |
| SBP00083 | Asparagus | *Fimbriimonas ginsengisoli* |
| SBP00083 | Asparagus | *Fimbriimonas ginsengisoli* |
| SBP00083 | Asparagus | *Flavobacterium anhuiense* |
| SBP00083 | Asparagus | *Flavobacterium anhuiense* |
| SBP00083 | Asparagus | *Flavobacterium crocinum* |
| SBP00083 | Asparagus | *Flavobacterium crocinum* |
| SBP00083 | Asparagus | *Flavobacterium johnsoniae* |
| SBP00083 | Asparagus | *Flavobacterium johnsoniae* |
| SBP00083 | Asparagus | *Flavobacterium* sp. 140616W15 |
| SBP00083 | Asparagus | *Flavobacterium* sp. 140616W15 |
| SBP00083 | Asparagus | *Flavobacterium* sp. HYN0086 |
| SBP00083 | Asparagus | *Flavobacterium* sp. HYN0086 |
| SBP00083 | Asparagus | *Frankia* symbiont of *Datisca glomerata* |
| SBP00083 | Asparagus | *Frankia* symbiont of *Datisca glomerata* |
| SBP00083 | Asparagus | *Frateuria aurantia* |
| SBP00083 | Asparagus | *Frateuria aurantia* |
| SBP00083 | Asparagus | *Friedmanniella luteola* |
| SBP00083 | Asparagus | *Friedmanniella luteola* |
| SBP00083 | Asparagus | *Fuerstia marisgermanicae* |
| SBP00083 | Asparagus | *Fuerstia marisgermanicae* |
| SBP00083 | Asparagus | *Gardnerella vaginalis* |
| SBP00083 | Asparagus | *Gardnerella vaginalis* |
| SBP00083 | Asparagus | *Gemmata obscuriglobus* |
| SBP00083 | Asparagus | *Gemmata obscuriglobus* |
| SBP00083 | Asparagus | *Gemmatirosa kalamazoonesis* |
| SBP00083 | Asparagus | *Gemmatirosa kalamazoonesis* |
| SBP00083 | Asparagus | *Geodermatophilus obscurus* |
| SBP00083 | Asparagus | *Geodermatophilus obscurus* |
| SBP00083 | Asparagus | *Gibbsiella quercinecans* |
| SBP00083 | Asparagus | *Gibbsiella quercinecans* |
| SBP00083 | Asparagus | *Gilliamella apicola* |
| SBP00083 | Asparagus | *Gilliamella apicola* |
| SBP00083 | Asparagus | *Glaesserella* sp. 15-184 |
| SBP00083 | Asparagus | *Glaesserella* sp. 15-184 |
| SBP00083 | Asparagus | *Glutamicibacter arilaitensis* |
| SBP00083 | Asparagus | *Glutamicibacter arilaitensis* |
| SBP00083 | Asparagus | *Glutamicibacter halophytocola* |
| SBP00083 | Asparagus | *Glutamicibacter halophytocola* |
| SBP00083 | Asparagus | *Glutamicibacter nicotianae* |
| SBP00083 | Asparagus | *Glutamicibacter nicotianae* |
| SBP00083 | Asparagus | *Glycocaulis alkaliphilus* |
| SBP00083 | Asparagus | *Glycocaulis alkaliphilus* |
| SBP00083 | Asparagus | *Gordonia terrae* |
| SBP00083 | Asparagus | *Gordonia terrae* |
| SBP00083 | Asparagus | *Grimontia hollisae* |
| SBP00083 | Asparagus | *Grimontia hollisae* |
| SBP00083 | Asparagus | *Haemophilus influenzae* |
| SBP00083 | Asparagus | *Haemophilus influenzae* |
| SBP00083 | Asparagus | *Haemophilus parainfluenzae* |
| SBP00083 | Asparagus | *Haemophilus parainfluenzae* |
| SBP00083 | Asparagus | *Hafnia alvei* |
| SBP00083 | Asparagus | *Hafnia alvei* |
| SBP00083 | Asparagus | *Hafnia paralvei* |
| SBP00083 | Asparagus | *Hafnia paralvei* |
| SBP00083 | Asparagus | *Hafnia* sp. CBA7124 |
| SBP00083 | Asparagus | *Hafnia* sp. CBA7124 |
| SBP00083 | Asparagus | *Halomicronema hongdechloris* |
| SBP00083 | Asparagus | *Halomicronema hongdechloris* |
| SBP00083 | Asparagus | *Halomonas chromatireducens* |
| SBP00083 | Asparagus | *Halomonas chromatireducens* |
| SBP00083 | Asparagus | *Halomonas venusta* |

TABLE 3-continued

List of species identified in each metagenomic sample of each SBP Sample

| SBP ID | SBP Host Common Name | Genus sp. |
| --- | --- | --- |
| SBP00083 | Asparagus | *Halomonas venusta* |
| SBP00083 | Asparagus | *Halotalea alkalilenta* |
| SBP00083 | Asparagus | *Halotalea alkalilenta* |
| SBP00083 | Asparagus | *Herbaspirillum huttiense* |
| SBP00083 | Asparagus | *Herbaspirillum huttiense* |
| SBP00083 | Asparagus | *Histophilus somni* |
| SBP00083 | Asparagus | *Histophilus somni* |
| SBP00083 | Asparagus | *Humibacter* sp. BT305 |
| SBP00083 | Asparagus | *Humibacter* sp. BT305 |
| SBP00083 | Asparagus | *Hydrogenophaga crassostreae* |
| SBP00083 | Asparagus | *Hydrogenophaga crassostreae* |
| SBP00083 | Asparagus | *Hydrogenophaga* sp. PBC |
| SBP00083 | Asparagus | *Hydrogenophaga* sp. PBC |
| SBP00083 | Asparagus | *Hydrogenophaga* sp. RAC07 |
| SBP00083 | Asparagus | *Hydrogenophaga* sp. RAC07 |
| SBP00083 | Asparagus | *Hydrogenophilus thermoluteolus* |
| SBP00083 | Asparagus | *Hydrogenophilus thermoluteolus* |
| SBP00083 | Asparagus | *Idiomarina loihiensis* |
| SBP00083 | Asparagus | *Idiomarina loihiensis* |
| SBP00083 | Asparagus | *Isoptericola dokdonensis* |
| SBP00083 | Asparagus | *Isoptericola dokdonensis* |
| SBP00083 | Asparagus | *Janthinobacterium* sp. B9-8 |
| SBP00083 | Asparagus | *Janthinobacterium* sp. B9-8 |
| SBP00083 | Asparagus | *Janthinobacterium svalbardensis* |
| SBP00083 | Asparagus | *Janthinobacterium svalbardensis* |
| SBP00083 | Asparagus | *Jiangella* sp. DSM 45060 |
| SBP00083 | Asparagus | *Jiangella* sp. DSM 45060 |
| SBP00083 | Asparagus | *Ketobacter alkanivorans* |
| SBP00083 | Asparagus | *Ketobacter alkanivorans* |
| SBP00083 | Asparagus | *Klebsiella aerogenes* |
| SBP00083 | Asparagus | *Klebsiella aerogenes* |
| SBP00083 | Asparagus | *Klebsiella michiganensis* |
| SBP00083 | Asparagus | *Klebsiella michiganensis* |
| SBP00083 | Asparagus | *Klebsiella oxytoca* |
| SBP00083 | Asparagus | *Klebsiella oxytoca* |
| SBP00083 | Asparagus | *Klebsiella pneumoniae* |
| SBP00083 | Asparagus | *Klebsiella pneumoniae* |
| SBP00083 | Asparagus | *Klebsiella quasipneumoniae* |
| SBP00083 | Asparagus | *Klebsiella quasipneumoniae* |
| SBP00083 | Asparagus | *Klebsiella quasivariicola* |
| SBP00083 | Asparagus | *Klebsiella quasivariicola* |
| SBP00083 | Asparagus | *Klebsiella* sp. FDAARGOS_511 |
| SBP00083 | Asparagus | *Klebsiella* sp. FDAARGOS_511 |
| SBP00083 | Asparagus | *Klebsiella* sp. M5al |
| SBP00083 | Asparagus | *Klebsiella* sp. M5al |
| SBP00083 | Asparagus | *Klebsiella* sp. P1CD1 |
| SBP00083 | Asparagus | *Klebsiella* sp. P1CD1 |
| SBP00083 | Asparagus | *Klebsiella* sp. PO552 |
| SBP00083 | Asparagus | *Klebsiella* sp. PO552 |
| SBP00083 | Asparagus | *Klebsiella* sp. WCHKl090001 |
| SBP00083 | Asparagus | *Klebsiella* sp. WCHKl090001 |
| SBP00083 | Asparagus | *Klebsiella variicola* |
| SBP00083 | Asparagus | *Klebsiella variicola* |
| SBP00083 | Asparagus | *Kluyvera intermedia* |
| SBP00083 | Asparagus | *Kluyvera intermedia* |
| SBP00083 | Asparagus | *Kocuria flava* |
| SBP00083 | Asparagus | *Kocuria flava* |
| SBP00083 | Asparagus | *Kocuria rosea* |
| SBP00083 | Asparagus | *Kocuria rosea* |
| SBP00083 | Asparagus | *Kosakonia cowanii* |
| SBP00083 | Asparagus | *Kosakonia cowanii* |
| SBP00083 | Asparagus | *Kosakonia oryzae* |
| SBP00083 | Asparagus | *Kosakonia oryzae* |
| SBP00083 | Asparagus | *Kosakonia radicincitans* |
| SBP00083 | Asparagus | *Kosakonia radicincitans* |
| SBP00083 | Asparagus | *Kosakonia sacchari* |
| SBP00083 | Asparagus | *Kosakonia sacchari* |
| SBP00083 | Asparagus | *Kosakonia* sp. CCTCC M2018092 |
| SBP00083 | Asparagus | *Kosakonia* sp. CCTCC M2018092 |
| SBP00083 | Asparagus | *Lactobacillus animalis* |
| SBP00083 | Asparagus | *Lactobacillus animalis* |
| SBP00083 | Asparagus | *Lactobacillus brevis* |
| SBP00083 | Asparagus | *Lactobacillus brevis* |
| SBP00083 | Asparagus | *Lactobacillus curvatus* |
| SBP00083 | Asparagus | *Lactobacillus curvatus* |
| SBP00083 | Asparagus | *Lactobacillus koreensis* |

TABLE 3-continued

List of species identified in each metagenomic sample of each SBP Sample

| SBP ID | SBP Host Common Name | Genus sp. |
| --- | --- | --- |
| SBP00083 | Asparagus | *Lactobacillus koreensis* |
| SBP00083 | Asparagus | *Lactobacillus plantarum* |
| SBP00083 | Asparagus | *Lactobacillus plantarum* |
| SBP00083 | Asparagus | *Lactobacillus sakei* |
| SBP00083 | Asparagus | *Lactobacillus sakei* |
| SBP00083 | Asparagus | *Lactococcus lactis* |
| SBP00083 | Asparagus | *Lactococcus lactis* |
| SBP00083 | Asparagus | *Leclercia adecarboxylata* |
| SBP00083 | Asparagus | *Leclercia adecarboxylata* |
| SBP00083 | Asparagus | *Leclercia* sp. LSNIH1 |
| SBP00083 | Asparagus | *Leclercia* sp. LSNIH1 |
| SBP00083 | Asparagus | *Leclercia* sp. LSNIH3 |
| SBP00083 | Asparagus | *Leclercia* sp. LSNIH3 |
| SBP00083 | Asparagus | *Lelliottia amnigena* |
| SBP00083 | Asparagus | *Lelliottia amnigena* |
| SBP00083 | Asparagus | *Lelliottia jeotgali* |
| SBP00083 | Asparagus | *Lelliottia jeotgali* |
| SBP00083 | Asparagus | *Lelliottia nimipressuralis* |
| SBP00083 | Asparagus | *Lelliottia nimipressuralis* |
| SBP00083 | Asparagus | *Lelliottia* sp. WB101 |
| SBP00083 | Asparagus | *Lelliottia* sp. WB101 |
| SBP00083 | Asparagus | *Leminorella richardii* |
| SBP00083 | Asparagus | *Leminorella richardii* |
| SBP00083 | Asparagus | *Leptolyngbya* sp. PCC 7376 |
| SBP00083 | Asparagus | *Leptolyngbya* sp. PCC 7376 |
| SBP00083 | Asparagus | *Leuconostoc carnosum* |
| SBP00083 | Asparagus | *Leuconostoc carnosum* |
| SBP00083 | Asparagus | *Leuconostoc citreum* |
| SBP00083 | Asparagus | *Leuconostoc citreum* |
| SBP00083 | Asparagus | *Leuconostoc mesenteroides* |
| SBP00083 | Asparagus | *Leuconostoc mesenteroides* |
| SBP00083 | Asparagus | *Limnobaculum parvum* |
| SBP00083 | Asparagus | *Limnobaculum parvum* |
| SBP00083 | Asparagus | *Lonsdalea britannica* |
| SBP00083 | Asparagus | *Lonsdalea britannica* |
| SBP00083 | Asparagus | *Lysinibacillus fusiformis* |
| SBP00083 | Asparagus | *Lysinibacillus fusiformis* |
| SBP00083 | Asparagus | *Lysinibacillus* sp. 2017 |
| SBP00083 | Asparagus | *Lysinibacillus* sp. 2017 |
| SBP00083 | Asparagus | *Lysinibacillus* sp. Marseille-P5727 |
| SBP00083 | Asparagus | *Lysinibacillus* sp. Marseille-P5727 |
| SBP00083 | Asparagus | *Lysinibacillus* sp. SGAir0095 |
| SBP00083 | Asparagus | *Lysinibacillus* sp. SGAir0095 |
| SBP00083 | Asparagus | *Lysinibacillus* sp. YS11 |
| SBP00083 | Asparagus | *Lysinibacillus* sp. YS11 |
| SBP00083 | Asparagus | *Lysinibacillus sphaericus* |
| SBP00083 | Asparagus | *Lysinibacillus sphaericus* |
| SBP00083 | Asparagus | *Lysinibacillus varians* |
| SBP00083 | Asparagus | *Lysinibacillus varians* |
| SBP00083 | Asparagus | *Lysinimonas* sp. 2DFWR-13 |
| SBP00083 | Asparagus | *Lysinimonas* sp. 2DFWR-13 |
| SBP00083 | Asparagus | *Lysobacter enzymogenes* |
| SBP00083 | Asparagus | *Lysobacter enzymogenes* |
| SBP00083 | Asparagus | *Lysobacter gummosus* |
| SBP00083 | Asparagus | *Lysobacter gummosus* |
| SBP00083 | Asparagus | *Lysobacter maris* |
| SBP00083 | Asparagus | *Lysobacter maris* |
| SBP00083 | Asparagus | *Magnetospirillum gryphiswaldense* |
| SBP00083 | Asparagus | *Magnetospirillum gryphiswaldense* |
| SBP00083 | Asparagus | *Mannheimia varigena* |
| SBP00083 | Asparagus | *Mannheimia varigena* |
| SBP00083 | Asparagus | *Marinobacter salarius* |
| SBP00083 | Asparagus | *Marinobacter salarius* |
| SBP00083 | Asparagus | *Marinobacterium aestuarii* |
| SBP00083 | Asparagus | *Marinobacterium aestuarii* |
| SBP00083 | Asparagus | *Marinomonas mediterranea* |
| SBP00083 | Asparagus | *Marinomonas mediterranea* |
| SBP00083 | Asparagus | *Marinomonas* sp. MWYL1 |
| SBP00083 | Asparagus | *Marinomonas* sp. MWYL1 |
| SBP00083 | Asparagus | *Marmoricola scoriae* |
| SBP00083 | Asparagus | *Marmoricola scoriae* |
| SBP00083 | Asparagus | *Martelella* sp. AD-3 |
| SBP00083 | Asparagus | *Martelella* sp. AD-3 |
| SBP00083 | Asparagus | *Massilia oculi* |
| SBP00083 | Asparagus | *Massilia oculi* |
| SBP00083 | Asparagus | *Massilia putida* |

TABLE 3-continued

List of species identified in each metagenomic sample of each SBP Sample

| SBP ID | SBP Host Common Name | Genus sp. |
|---|---|---|
| SBP00083 | Asparagus | *Massilia putida* |
| SBP00083 | Asparagus | *Massilia* sp. WG5 |
| SBP00083 | Asparagus | *Massilia* sp. WG5 |
| SBP00083 | Asparagus | *Mesorhizobium loti* |
| SBP00083 | Asparagus | *Mesorhizobium loti* |
| SBP00083 | Asparagus | *Mesorhizobium* sp. M1D.F.Ca.ET.043.01.1.1 |
| SBP00083 | Asparagus | *Mesorhizobium* sp. M1D.F.Ca.ET.043.01.1.1 |
| SBP00083 | Asparagus | *Mesorhizobium* sp. M9A.F.Ca.ET.002.03.1.2 |
| SBP00083 | Asparagus | *Mesorhizobium* sp. M9A.F.Ca.ET.002.03.1.2 |
| SBP00083 | Asparagus | *Metakosakonia* sp. MRY16-398 |
| SBP00083 | Asparagus | *Metakosakonia* sp. MRY16-398 |
| SBP00083 | Asparagus | *Methylobacterium aquaticum* |
| SBP00083 | Asparagus | *Methylobacterium aquaticum* |
| SBP00083 | Asparagus | *Methylobacterium brachiatum* |
| SBP00083 | Asparagus | *Methylobacterium brachiatum* |
| SBP00083 | Asparagus | *Methylobacterium* sp. 4-46 |
| SBP00083 | Asparagus | *Methylobacterium* sp. 4-46 |
| SBP00083 | Asparagus | *Methylomonas denitrificans* |
| SBP00083 | Asparagus | *Methylomonas denitrificans* |
| SBP00083 | Asparagus | *Methylophaga nitratireducenticrescens* |
| SBP00083 | Asparagus | *Methylophaga nitratireducenticrescens* |
| SBP00083 | Asparagus | *Methylorubrum extorquens* |
| SBP00083 | Asparagus | *Methylorubrum extorquens* |
| SBP00083 | Asparagus | *Methylorubrum populi* |
| SBP00083 | Asparagus | *Methylorubrum populi* |
| SBP00083 | Asparagus | *Microbacterium aurum* |
| SBP00083 | Asparagus | *Microbacterium aurum* |
| SBP00083 | Asparagus | *Microbacterium foliorum* |
| SBP00083 | Asparagus | *Microbacterium foliorum* |
| SBP00083 | Asparagus | *Microbacterium oxydans* |
| SBP00083 | Asparagus | *Microbacterium oxydans* |
| SBP00083 | Asparagus | *Microbacterium sediminis* |
| SBP00083 | Asparagus | *Microbacterium sediminis* |
| SBP00083 | Asparagus | *Microbacterium* sp. 1.5R |
| SBP00083 | Asparagus | *Microbacterium* sp. 1.5R |
| SBP00083 | Asparagus | *Microbacterium* sp. ABRD_28 |
| SBP00083 | Asparagus | *Microbacterium* sp. ABRD_28 |
| SBP00083 | Asparagus | *Microbacterium* sp. CGR1 |
| SBP00083 | Asparagus | *Microbacterium* sp. CGR1 |
| SBP00083 | Asparagus | *Microbacterium* sp. PM5 |
| SBP00083 | Asparagus | *Microbacterium* sp. PM5 |
| SBP00083 | Asparagus | *Microbacterium* sp. str. 'China' |
| SBP00083 | Asparagus | *Microbacterium* sp. str. 'China' |
| SBP00083 | Asparagus | *Microbacterium* sp. XT11 |
| SBP00083 | Asparagus | *Microbacterium* sp. XT11 |
| SBP00083 | Asparagus | *Microbacterium* sp. Y-01 |
| SBP00083 | Asparagus | *Microbacterium* sp. Y-01 |
| SBP00083 | Asparagus | *Microvirga ossetica* |
| SBP00083 | Asparagus | *Microvirga ossetica* |
| SBP00083 | Asparagus | *Microvirga* sp. 17 mud 1-3 |
| SBP00083 | Asparagus | *Microvirga* sp. 17 mud 1-3 |
| SBP00083 | Asparagus | *Mixta calida* |
| SBP00083 | Asparagus | *Mixta calida* |
| SBP00083 | Asparagus | *Mixta gaviniae* |
| SBP00083 | Asparagus | *Mixta gaviniae* |
| SBP00083 | Asparagus | *Moraxella osloensis* |
| SBP00083 | Asparagus | *Moraxella osloensis* |
| SBP00083 | Asparagus | *Morganella morganii* |
| SBP00083 | Asparagus | *Morganella morganii* |
| SBP00083 | Asparagus | *Moritella viscosa* |
| SBP00083 | Asparagus | *Moritella viscosa* |
| SBP00083 | Asparagus | *Mycobacterium marinum* |
| SBP00083 | Asparagus | *Mycobacterium marinum* |
| SBP00083 | Asparagus | *Mycobacterium* sp. DL90 |
| SBP00083 | Asparagus | *Mycobacterium* sp. DL90 |
| SBP00083 | Asparagus | *Mycobacterium* sp. VKM Ac-1817D |
| SBP00083 | Asparagus | *Mycobacterium* sp. VKM Ac-1817D |
| SBP00083 | Asparagus | *Mycobacterium* sp. YC-RL4 |
| SBP00083 | Asparagus | *Mycobacterium* sp. YC-RL4 |
| SBP00083 | Asparagus | *Mycobacteroides abscessus* |
| SBP00083 | Asparagus | *Mycobacteroides abscessus* |
| SBP00083 | Asparagus | *Mycolicibacterium aurum* |
| SBP00083 | Asparagus | *Mycolicibacterium aurum* |
| SBP00083 | Asparagus | *Mycolicibacterium flavescens* |
| SBP00083 | Asparagus | *Mycolicibacterium flavescens* |
| SBP00083 | Asparagus | *Mycolicibacterium fortuitum* |

TABLE 3-continued

List of species identified in each metagenomic sample of each SBP Sample

| SBP ID | SBP Host Common Name | Genus sp. |
|---|---|---|
| SBP00083 | Asparagus | Mycolicibacterium fortuitum |
| SBP00083 | Asparagus | Mycolicibacterium gilvum |
| SBP00083 | Asparagus | Mycolicibacterium gilvum |
| SBP00083 | Asparagus | Mycolicibacterium goodii |
| SBP00083 | Asparagus | Mycolicibacterium goodii |
| SBP00083 | Asparagus | Myxococcus xanthus |
| SBP00083 | Asparagus | Myxococcus xanthus |
| SBP00083 | Asparagus | Nakamurella panacisegetis |
| SBP00083 | Asparagus | Nakamurella panacisegetis |
| SBP00083 | Asparagus | Neorhizobium galegae |
| SBP00083 | Asparagus | Neorhizobium galegae |
| SBP00083 | Asparagus | Neorhizobium sp. NCHU2750 |
| SBP00083 | Asparagus | Neorhizobium sp. NCHU2750 |
| SBP00083 | Asparagus | Neorhizobium sp. SOG26 |
| SBP00083 | Asparagus | Neorhizobium sp. SOG26 |
| SBP00083 | Asparagus | Nissabacter sp. SGAir0207 |
| SBP00083 | Asparagus | Nissabacter sp. SGAir0207 |
| SBP00083 | Asparagus | Nitrosospira multiformis |
| SBP00083 | Asparagus | Nitrosospira multiformis |
| SBP00083 | Asparagus | Nocardia asteroides |
| SBP00083 | Asparagus | Nocardia asteroides |
| SBP00083 | Asparagus | Nocardia brasiliensis |
| SBP00083 | Asparagus | Nocardia brasiliensis |
| SBP00083 | Asparagus | Nocardia cyriacigeorgica |
| SBP00083 | Asparagus | Nocardia cyriacigeorgica |
| SBP00083 | Asparagus | Nocardia sp. Y48 |
| SBP00083 | Asparagus | Nocardia sp. Y48 |
| SBP00083 | Asparagus | Nocardia terpenica |
| SBP00083 | Asparagus | Nocardia terpenica |
| SBP00083 | Asparagus | Nocardioides baekrokdamisoli |
| SBP00083 | Asparagus | Nocardioides baekrokdamisoli |
| SBP00083 | Asparagus | Nocardioides daphniae |
| SBP00083 | Asparagus | Nocardioides daphniae |
| SBP00083 | Asparagus | Nocardioides dokdonensis |
| SBP00083 | Asparagus | Nocardioides dokdonensis |
| SBP00083 | Asparagus | Nocardioides humi |
| SBP00083 | Asparagus | Nocardioides humi |
| SBP00083 | Asparagus | Nocardioides sp. 603 |
| SBP00083 | Asparagus | Nocardioides sp. 603 |
| SBP00083 | Asparagus | Nocardioides sp. CF8 |
| SBP00083 | Asparagus | Nocardioides sp. CF8 |
| SBP00083 | Asparagus | Nocardioides sp. JS614 |
| SBP00083 | Asparagus | Nocardioides sp. JS614 |
| SBP00083 | Asparagus | Nocardiopsis dassonvillei |
| SBP00083 | Asparagus | Nocardiopsis dassonvillei |
| SBP00083 | Asparagus | Nonomuraea sp. ATCC 55076 |
| SBP00083 | Asparagus | Nonomuraea sp. ATCC 55076 |
| SBP00083 | Asparagus | Novosphingobium sp. P6W |
| SBP00083 | Asparagus | Novosphingobium sp. P6W |
| SBP00083 | Asparagus | Obesumbacterium proteus |
| SBP00083 | Asparagus | Obesumbacterium proteus |
| SBP00083 | Asparagus | Oblitimonas alkaliphila |
| SBP00083 | Asparagus | Oblitimonas alkaliphila |
| SBP00083 | Asparagus | Oceanimonas sp. GK1 |
| SBP00083 | Asparagus | Oceanimonas sp. GK1 |
| SBP00083 | Asparagus | Oceanisphaera avium |
| SBP00083 | Asparagus | Oceanisphaera avium |
| SBP00083 | Asparagus | Ochrobactrum anthropi |
| SBP00083 | Asparagus | Ochrobactrum anthropi |
| SBP00083 | Asparagus | Ochrobactrum pituitosum |
| SBP00083 | Asparagus | Ochrobactrum pituitosum |
| SBP00083 | Asparagus | Oleiphilus messinensis |
| SBP00083 | Asparagus | Oleiphilus messinensis |
| SBP00083 | Asparagus | Paenibacillaceae bacterium GAS479 |
| SBP00083 | Asparagus | Paenibacillaceae bacterium GAS479 |
| SBP00083 | Asparagus | Paenibacillus alvei |
| SBP00083 | Asparagus | Paenibacillus alvei |
| SBP00083 | Asparagus | Paenibacillus borealis |
| SBP00083 | Asparagus | Paenibacillus borealis |
| SBP00083 | Asparagus | Paenibacillus bovis |
| SBP00083 | Asparagus | Paenibacillus bovis |
| SBP00083 | Asparagus | Paenibacillus chitinolyticus |
| SBP00083 | Asparagus | Paenibacillus chitinolyticus |
| SBP00083 | Asparagus | Paenibacillus crassostreae |
| SBP00083 | Asparagus | Paenibacillus crassostreae |
| SBP00083 | Asparagus | Paenibacillus donghaensis |

TABLE 3-continued

List of species identified in each metagenomic sample of each SBP Sample

| SBP ID | SBP Host Common Name | Genus sp. |
|---|---|---|
| SBP00083 | Asparagus | *Paenibacillus donghaensis* |
| SBP00083 | Asparagus | *Paenibacillus durus* |
| SBP00083 | Asparagus | *Paenibacillus durus* |
| SBP00083 | Asparagus | *Paenibacillus glucanolyticus* |
| SBP00083 | Asparagus | *Paenibacillus glucanolyticus* |
| SBP00083 | Asparagus | *Paenibacillus graminis* |
| SBP00083 | Asparagus | *Paenibacillus graminis* |
| SBP00083 | Asparagus | *Paenibacillus ihbetae* |
| SBP00083 | Asparagus | *Paenibacillus ihbetae* |
| SBP00083 | Asparagus | *Paenibacillus kribbensis* |
| SBP00083 | Asparagus | *Paenibacillus kribbensis* |
| SBP00083 | Asparagus | *Paenibacillus lautus* |
| SBP00083 | Asparagus | *Paenibacillus lautus* |
| SBP00083 | Asparagus | *Paenibacillus lentus* |
| SBP00083 | Asparagus | *Paenibacillus lentus* |
| SBP00083 | Asparagus | *Paenibacillus mucilaginosus* |
| SBP00083 | Asparagus | *Paenibacillus mucilaginosus* |
| SBP00083 | Asparagus | *Paenibacillus odorifer* |
| SBP00083 | Asparagus | *Paenibacillus odorifer* |
| SBP00083 | Asparagus | *Paenibacillus physcomitrellae* |
| SBP00083 | Asparagus | *Paenibacillus physcomitrellae* |
| SBP00083 | Asparagus | *Paenibacillus polymyxa* |
| SBP00083 | Asparagus | *Paenibacillus polymyxa* |
| SBP00083 | Asparagus | *Paenibacillus riograndensis* |
| SBP00083 | Asparagus | *Paenibacillus riograndensis* |
| SBP00083 | Asparagus | *Paenibacillus sabinae* |
| SBP00083 | Asparagus | *Paenibacillus sabinae* |
| SBP00083 | Asparagus | *Paenibacillus sp.* 18JY67-1 |
| SBP00083 | Asparagus | *Paenibacillus sp.* 18JY67-1 |
| SBP00083 | Asparagus | *Paenibacillus sp.* 32O-W |
| SBP00083 | Asparagus | *Paenibacillus sp.* 32O-W |
| SBP00083 | Asparagus | *Paenibacillus sp.* BIHB4019 |
| SBP00083 | Asparagus | *Paenibacillus sp.* BIHB4019 |
| SBP00083 | Asparagus | *Paenibacillus sp.* CAA11 |
| SBP00083 | Asparagus | *Paenibacillus sp.* CAA11 |
| SBP00083 | Asparagus | *Paenibacillus sp.* DCT19 |
| SBP00083 | Asparagus | *Paenibacillus sp.* DCT19 |
| SBP00083 | Asparagus | *Paenibacillus sp.* FSL H7-0357 |
| SBP00083 | Asparagus | *Paenibacillus sp.* FSL H7-0357 |
| SBP00083 | Asparagus | *Paenibacillus sp.* FSL H7-0737 |
| SBP00083 | Asparagus | *Paenibacillus sp.* FSL H7-0737 |
| SBP00083 | Asparagus | *Paenibacillus sp.* FSL P4-0081 |
| SBP00083 | Asparagus | *Paenibacillus sp.* FSL P4-0081 |
| SBP00083 | Asparagus | *Paenibacillus sp.* FSL R5-0345 |
| SBP00083 | Asparagus | *Paenibacillus sp.* FSL R5-0345 |
| SBP00083 | Asparagus | *Paenibacillus sp.* FSL R5-0912 |
| SBP00083 | Asparagus | *Paenibacillus sp.* FSL R5-0912 |
| SBP00083 | Asparagus | *Paenibacillus sp.* FSL R7-0273 |
| SBP00083 | Asparagus | *Paenibacillus sp.* FSL R7-0273 |
| SBP00083 | Asparagus | *Paenibacillus sp.* FSL R7-0331 |
| SBP00083 | Asparagus | *Paenibacillus sp.* FSL R7-0331 |
| SBP00083 | Asparagus | *Paenibacillus sp.* IHB B 3084 |
| SBP00083 | Asparagus | *Paenibacillus sp.* IHB B 3084 |
| SBP00083 | Asparagus | *Paenibacillus sp.* IHBB 10380 |
| SBP00083 | Asparagus | *Paenibacillus sp.* IHBB 10380 |
| SBP00083 | Asparagus | *Paenibacillus sp.* JDR-2 |
| SBP00083 | Asparagus | *Paenibacillus sp.* JDR-2 |
| SBP00083 | Asparagus | *Paenibacillus sp.* M-152 |
| SBP00083 | Asparagus | *Paenibacillus sp.* M-152 |
| SBP00083 | Asparagus | *Paenibacillus sp.* MBLB1234 |
| SBP00083 | Asparagus | *Paenibacillus sp.* MBLB1234 |
| SBP00083 | Asparagus | *Paenibacillus sp.* Y412MC10 |
| SBP00083 | Asparagus | *Paenibacillus sp.* Y412MC10 |
| SBP00083 | Asparagus | *Paenibacillus stellifer* |
| SBP00083 | Asparagus | *Paenibacillus stellifer* |
| SBP00083 | Asparagus | *Paenibacillus swuensis* |
| SBP00083 | Asparagus | *Paenibacillus swuensis* |
| SBP00083 | Asparagus | *Paenibacillus terrae* |
| SBP00083 | Asparagus | *Paenibacillus terrae* |
| SBP00083 | Asparagus | *Paenibacillus xylanexedens* |
| SBP00083 | Asparagus | *Paenibacillus xylanexedens* |
| SBP00083 | Asparagus | *Paenibacillus yonginensis* |
| SBP00083 | Asparagus | *Paenibacillus yonginensis* |
| SBP00083 | Asparagus | *Paenisporosarcina antarctica* |
| SBP00083 | Asparagus | *Paenisporosarcina antarctica* |
| SBP00083 | Asparagus | *Pandoraea pnomenusa* |

TABLE 3-continued

List of species identified in each metagenomic sample of each SBP Sample

| SBP ID | SBP Host Common Name | Genus sp. |
|---|---|---|
| SBP00083 | Asparagus | *Pandoraea pnomenusa* |
| SBP00083 | Asparagus | *Pandoraea vervacti* |
| SBP00083 | Asparagus | *Pandoraea vervacti* |
| SBP00083 | Asparagus | *Pantoea agglomerans* |
| SBP00083 | Asparagus | *Pantoea agglomerans* |
| SBP00083 | Asparagus | *Pantoea alhagi* |
| SBP00083 | Asparagus | *Pantoea alhagi* |
| SBP00083 | Asparagus | *Pantoea ananatis* |
| SBP00083 | Asparagus | *Pantoea ananatis* |
| SBP00083 | Asparagus | *Pantoea rwandensis* |
| SBP00083 | Asparagus | *Pantoea rwandensis* |
| SBP00083 | Asparagus | *Pantoea* sp. At-9b |
| SBP00083 | Asparagus | *Pantoea* sp. At-9b |
| SBP00083 | Asparagus | *Pantoea* sp. PSNIH1 |
| SBP00083 | Asparagus | *Pantoea* sp. PSNIH1 |
| SBP00083 | Asparagus | *Pantoea* sp. PSNIH2 |
| SBP00083 | Asparagus | *Pantoea* sp. PSNIH2 |
| SBP00083 | Asparagus | *Pantoea stewartii* |
| SBP00083 | Asparagus | *Pantoea stewartii* |
| SBP00083 | Asparagus | *Pantoea vagans* |
| SBP00083 | Asparagus | *Pantoea vagans* |
| SBP00083 | Asparagus | *Paraburkholderia phymatum* |
| SBP00083 | Asparagus | *Paraburkholderia phymatum* |
| SBP00083 | Asparagus | *Paraburkholderia sprentiae* |
| SBP00083 | Asparagus | *Paraburkholderia sprentiae* |
| SBP00083 | Asparagus | *Paracoccus denitrificans* |
| SBP00083 | Asparagus | *Paracoccus denitrificans* |
| SBP00083 | Asparagus | *Paracoccus* sp. Arc7-R13 |
| SBP00083 | Asparagus | *Paracoccus* sp. Arc7-R13 |
| SBP00083 | Asparagus | *Paracoccus* sp. SC2-6 |
| SBP00083 | Asparagus | *Paracoccus* sp. SC2-6 |
| SBP00083 | Asparagus | *Paracoccus yeei* |
| SBP00083 | Asparagus | *Paracoccus yeei* |
| SBP00083 | Asparagus | *Paracoccus zhejiangensis* |
| SBP00083 | Asparagus | *Paracoccus zhejiangensis* |
| SBP00083 | Asparagus | *Pasteurella multocida* |
| SBP00083 | Asparagus | *Pasteurella multocida* |
| SBP00083 | Asparagus | *Pasteurellaceae bacterium* NI1060 |
| SBP00083 | Asparagus | *Pasteurellaceae bacterium* NI1060 |
| SBP00083 | Asparagus | *Pectobacterium atrosepticum* |
| SBP00083 | Asparagus | *Pectobacterium atrosepticum* |
| SBP00083 | Asparagus | *Pectobacterium carotovorum* |
| SBP00083 | Asparagus | *Pectobacterium carotovorum* |
| SBP00083 | Asparagus | *Pectobacterium parmentieri* |
| SBP00083 | Asparagus | *Pectobacterium parmentieri* |
| SBP00083 | Asparagus | *Pectobacterium polaris* |
| SBP00083 | Asparagus | *Pectobacterium polaris* |
| SBP00083 | Asparagus | *Pectobacterium wasabiae* |
| SBP00083 | Asparagus | *Pectobacterium wasabiae* |
| SBP00083 | Asparagus | *Peptostreptococcaceae bacterium* oral taxon 929 |
| SBP00083 | Asparagus | *Peptostreptococcaceae bacterium* oral taxon 925 |
| SBP00083 | Asparagus | *Phenylobacterium zucineum* |
| SBP00083 | Asparagus | *Phenylobacterium zucineum* |
| SBP00083 | Asparagus | *Photobacterium damselae* |
| SBP00083 | Asparagus | *Photobacterium damselae* |
| SBP00083 | Asparagus | *Photobacterium profundum* |
| SBP00083 | Asparagus | *Photobacterium profundum* |
| SBP00083 | Asparagus | *Photorhabdus asymbiotica* |
| SBP00083 | Asparagus | *Photorhabdus asymbiotica* |
| SBP00083 | Asparagus | *Photorhabdus laumondii* |
| SBP00083 | Asparagus | *Photorhabdus laumondii* |
| SBP00083 | Asparagus | *Photorhabdus thracensis* |
| SBP00083 | Asparagus | *Photorhabdus thracensis* |
| SBP00083 | Asparagus | *Phycicoccus dokdonensis* |
| SBP00083 | Asparagus | *Phycicoccus dokdonensis* |
| SBP00083 | Asparagus | *Phytobacter* sp. SCO41 |
| SBP00083 | Asparagus | *Phytobacter* sp. SCO41 |
| SBP00083 | Asparagus | *Phytobacter ursingii* |
| SBP00083 | Asparagus | *Phytobacter ursingii* |
| SBP00083 | Asparagus | *Pimelobacter simplex* |
| SBP00083 | Asparagus | *Pimelobacter simplex* |
| SBP00083 | Asparagus | *Planctomyces* sp. SH-PL62 |
| SBP00083 | Asparagus | *Planctomyces* sp. SH-PL62 |
| SBP00083 | Asparagus | *Planococcus rifietoensis* |
| SBP00083 | Asparagus | *Planococcus rifietoensis* |
| SBP00083 | Asparagus | *Plantactinospora* sp. KBS50 |

TABLE 3-continued

List of species identified in each metagenomic sample of each SBP Sample

| SBP ID | SBP Host Common Name | Genus sp. |
| --- | --- | --- |
| SBP00083 | Asparagus | *Plantactinospora* sp. KBS50 |
| SBP00083 | Asparagus | *Plautia stali* |
| SBP00083 | Asparagus | *Plautia stali* |
| SBP00083 | Asparagus | *Plautia stali* symbiont |
| SBP00083 | Asparagus | *Plautia stali* symbiont |
| SBP00083 | Asparagus | *Plesiomonas shigelloides* |
| SBP00083 | Asparagus | *Plesiomonas shigelloides* |
| SBP00083 | Asparagus | *Pluralibacter gergoviae* |
| SBP00083 | Asparagus | *Pluralibacter gergoviae* |
| SBP00083 | Asparagus | *Polaromonas naphthalenivorans* |
| SBP00083 | Asparagus | *Polaromonas naphthalenivorans* |
| SBP00083 | Asparagus | *Pontibacter actiniarum* |
| SBP00083 | Asparagus | *Pontibacter actiniarum* |
| SBP00083 | Asparagus | *Pontibacter akesuensis* |
| SBP00083 | Asparagus | *Pontibacter akesuensis* |
| SBP00083 | Asparagus | *Pontibacter korlensis* |
| SBP00083 | Asparagus | *Pontibacter korlensis* |
| SBP00083 | Asparagus | *Porphyrobacter* sp. LM 6 |
| SBP00083 | Asparagus | *Porphyrobacter* sp. LM 6 |
| SBP00083 | Asparagus | *Pragia fontium* |
| SBP00083 | Asparagus | *Pragia fontium* |
| SBP00083 | Asparagus | *Prevotella intermedia* |
| SBP00083 | Asparagus | *Prevotella intermedia* |
| SBP00083 | Asparagus | *Prevotella scopos* |
| SBP00083 | Asparagus | *Prevotella scopos* |
| SBP00083 | Asparagus | *Prochlorococcus marinus* |
| SBP00083 | Asparagus | *Prochlorococcus marinus* |
| SBP00083 | Asparagus | *Proteus hauseri* |
| SBP00083 | Asparagus | *Proteus hauseri* |
| SBP00083 | Asparagus | *Proteus mirabilis* |
| SBP00083 | Asparagus | *Proteus mirabilis* |
| SBP00083 | Asparagus | *Proteus vulgaris* |
| SBP00083 | Asparagus | *Proteus vulgaris* |
| SBP00083 | Asparagus | *Providencia alcalifaciens* |
| SBP00083 | Asparagus | *Providencia alcalifaciens* |
| SBP00083 | Asparagus | *Providencia heimbachae* |
| SBP00083 | Asparagus | *Providencia heimbachae* |
| SBP00083 | Asparagus | *Providencia rettgeri* |
| SBP00083 | Asparagus | *Providencia rettgeri* |
| SBP00083 | Asparagus | *Providencia rustigianii* |
| SBP00083 | Asparagus | *Providencia rustigianii* |
| SBP00083 | Asparagus | *Providencia sneebia* |
| SBP00083 | Asparagus | *Providencia sneebia* |
| SBP00083 | Asparagus | *Providencia* sp. WCHPr000369 |
| SBP00083 | Asparagus | *Providencia* sp. WCHPr000369 |
| SBP00083 | Asparagus | *Providencia stuartii* |
| SBP00083 | Asparagus | *Providencia stuartii* |
| SBP00083 | Asparagus | *Pseudarthrobacter phenanthrenivorans* |
| SBP00083 | Asparagus | *Pseudarthrobacter phenanthrenivorans* |
| SBP00083 | Asparagus | *Pseudoalteromonas rubra* |
| SBP00083 | Asparagus | *Pseudoalteromonas rubra* |
| SBP00083 | Asparagus | *Pseudoalteromonas spongiae* |
| SBP00083 | Asparagus | *Pseudoalteromonas spongiae* |
| SBP00083 | Asparagus | *Pseudohongiella spirulinae* |
| SBP00083 | Asparagus | *Pseudohongiella spirulinae* |
| SBP00083 | Asparagus | *Pseudolabrys taiwanensis* |
| SBP00083 | Asparagus | *Pseudolabrys taiwanensis* |
| SBP00083 | Asparagus | *Pseudomonas aeruginosa* |
| SBP00083 | Asparagus | *Pseudomonas aeruginosa* |
| SBP00083 | Asparagus | *Pseudomonas agarici* |
| SBP00083 | Asparagus | *Pseudomonas agarici* |
| SBP00083 | Asparagus | *Pseudomonas alcaligenes* |
| SBP00083 | Asparagus | *Pseudomonas alcaligenes* |
| SBP00083 | Asparagus | *Pseudomonas alcaliphila* |
| SBP00083 | Asparagus | *Pseudomonas alcaliphila* |
| SBP00083 | Asparagus | *Pseudomonas alkylphenolica* |
| SBP00083 | Asparagus | *Pseudomonas alkylphenolica* |
| SBP00083 | Asparagus | *Pseudomonas amygdali* |
| SBP00083 | Asparagus | *Pseudomonas amygdali* |
| SBP00083 | Asparagus | *Pseudomonas antarctica* |
| SBP00083 | Asparagus | *Pseudomonas antarctica* |
| SBP00083 | Asparagus | *Pseudomonas arsenicoxydans* |
| SBP00083 | Asparagus | *Pseudomonas arsenicoxydans* |
| SBP00083 | Asparagus | *Pseudomonas asplenii* |
| SBP00083 | Asparagus | *Pseudomonas asplenii* |
| SBP00083 | Asparagus | *Pseudomonas azotoformans* |

TABLE 3-continued

List of species identified in each metagenomic sample of each SBP Sample

| SBP ID | SBP Host Common Name | Genus sp. |
| --- | --- | --- |
| SBP00083 | Asparagus | *Pseudomonas azotoformans* |
| SBP00083 | Asparagus | *Pseudomonas balearica* |
| SBP00083 | Asparagus | *Pseudomonas balearica* |
| SBP00083 | Asparagus | *Pseudomonas brassicacearum* |
| SBP00083 | Asparagus | *Pseudomonas brassicacearum* |
| SBP00083 | Asparagus | *Pseudomonas brenneri* |
| SBP00083 | Asparagus | *Pseudomonas brenneri* |
| SBP00083 | Asparagus | *Pseudomonas cedrina* |
| SBP00083 | Asparagus | *Pseudomonas cedrina* |
| SBP00083 | Asparagus | *Pseudomonas cerasi* |
| SBP00083 | Asparagus | *Pseudomonas cerasi* |
| SBP00083 | Asparagus | *Pseudomonas chlororaphis* |
| SBP00083 | Asparagus | *Pseudomonas chlororaphis* |
| SBP00083 | Asparagus | *Pseudomonas cichorii* |
| SBP00083 | Asparagus | *Pseudomonas cichorii* |
| SBP00083 | Asparagus | *Pseudomonas citronellolis* |
| SBP00083 | Asparagus | *Pseudomonas citronellolis* |
| SBP00083 | Asparagus | *Pseudomonas corrugata* |
| SBP00083 | Asparagus | *Pseudomonas corrugata* |
| SBP00083 | Asparagus | *Pseudomonas cremoricolorata* |
| SBP00083 | Asparagus | *Pseudomonas cremoricolorata* |
| SBP00083 | Asparagus | *Pseudomonas entomophila* |
| SBP00083 | Asparagus | *Pseudomonas entomophila* |
| SBP00083 | Asparagus | *Pseudomonas extremaustralis* |
| SBP00083 | Asparagus | *Pseudomonas extremaustralis* |
| SBP00083 | Asparagus | *Pseudomonas extremorientalis* |
| SBP00083 | Asparagus | *Pseudomonas extremorientalis* |
| SBP00083 | Asparagus | *Pseudomonas fluorescens* |
| SBP00083 | Asparagus | *Pseudomonas fluorescens* |
| SBP00083 | Asparagus | *Pseudomonas fragi* |
| SBP00083 | Asparagus | *Pseudomonas fragi* |
| SBP00083 | Asparagus | *Pseudomonas frederiksbergensis* |
| SBP00083 | Asparagus | *Pseudomonas frederiksbergensis* |
| SBP00083 | Asparagus | *Pseudomonas fulva* |
| SBP00083 | Asparagus | *Pseudomonas fulva* |
| SBP00083 | Asparagus | *Pseudomonas furukawaii* |
| SBP00083 | Asparagus | *Pseudomonas furukawaii* |
| SBP00083 | Asparagus | *Pseudomonas fuscovaginae* |
| SBP00083 | Asparagus | *Pseudomonas fuscovaginae* |
| SBP00083 | Asparagus | *Pseudomonas granadensis* |
| SBP00083 | Asparagus | *Pseudomonas granadensis* |
| SBP00083 | Asparagus | *Pseudomonas guangdongensis* |
| SBP00083 | Asparagus | *Pseudomonas guangdongensis* |
| SBP00083 | Asparagus | *Pseudomonas knackmussii* |
| SBP00083 | Asparagus | *Pseudomonas knackmussii* |
| SBP00083 | Asparagus | *Pseudomonas koreensis* |
| SBP00083 | Asparagus | *Pseudomonas koreensis* |
| SBP00083 | Asparagus | *Pseudomonas kribbensis* |
| SBP00083 | Asparagus | *Pseudomonas kribbensis* |
| SBP00083 | Asparagus | *Pseudomonas libanensis* |
| SBP00083 | Asparagus | *Pseudomonas libanensis* |
| SBP00083 | Asparagus | *Pseudomonas lini* |
| SBP00083 | Asparagus | *Pseudomonas lini* |
| SBP00083 | Asparagus | *Pseudomonas litoralis* |
| SBP00083 | Asparagus | *Pseudomonas litoralis* |
| SBP00083 | Asparagus | *Pseudomonas lurida* |
| SBP00083 | Asparagus | *Pseudomonas lurida* |
| SBP00083 | Asparagus | *Pseudomonas mandelii* |
| SBP00083 | Asparagus | *Pseudomonas mandelii* |
| SBP00083 | Asparagus | *Pseudomonas mediterranea* |
| SBP00083 | Asparagus | *Pseudomonas mediterranea* |
| SBP00083 | Asparagus | *Pseudomonas mendocina* |
| SBP00083 | Asparagus | *Pseudomonas mendocina* |
| SBP00083 | Asparagus | *Pseudomonas monteilii* |
| SBP00083 | Asparagus | *Pseudomonas monteilii* |
| SBP00083 | Asparagus | *Pseudomonas moraviensis* |
| SBP00083 | Asparagus | *Pseudomonas moraviensis* |
| SBP00083 | Asparagus | *Pseudomonas mosselii* |
| SBP00083 | Asparagus | *Pseudomonas mosselii* |
| SBP00083 | Asparagus | *Pseudomonas mucidolens* |
| SBP00083 | Asparagus | *Pseudomonas mucidolens* |
| SBP00083 | Asparagus | *Pseudomonas orientalis* |
| SBP00083 | Asparagus | *Pseudomonas orientalis* |
| SBP00083 | Asparagus | *Pseudomonas oryzae* |
| SBP00083 | Asparagus | *Pseudomonas oryzae* |
| SBP00083 | Asparagus | *Pseudomonas oryzihabitans* |

TABLE 3-continued

List of species identified in each metagenomic sample of each SBP Sample

| SBP ID | SBP Host Common Name | Genus sp. |
|---|---|---|
| SBP00083 | Asparagus | *Pseudomonas oryzihabitans* |
| SBP00083 | Asparagus | *Pseudomonas palleroniana* |
| SBP00083 | Asparagus | *Pseudomonas palleroniana* |
| SBP00083 | Asparagus | *Pseudomonas parafulva* |
| SBP00083 | Asparagus | *Pseudomonas parafulva* |
| SBP00083 | Asparagus | *Pseudomonas plecoglossicida* |
| SBP00083 | Asparagus | *Pseudomonas plecoglossicida* |
| SBP00083 | Asparagus | *Pseudomonas poae* |
| SBP00083 | Asparagus | *Pseudomonas poae* |
| SBP00083 | Asparagus | *Pseudomonas pohangensis* |
| SBP00083 | Asparagus | *Pseudomonas pohangensis* |
| SBP00083 | Asparagus | *Pseudomonas prosekii* |
| SBP00083 | Asparagus | *Pseudomonas prosekii* |
| SBP00083 | Asparagus | *Pseudomonas protegens* |
| SBP00083 | Asparagus | *Pseudomonas protegens* |
| SBP00083 | Asparagus | *Pseudomonas psychrophila* |
| SBP00083 | Asparagus | *Pseudomonas psychrophila* |
| SBP00083 | Asparagus | *Pseudomonas psychrotolerans* |
| SBP00083 | Asparagus | *Pseudomonas psychrotolerans* |
| SBP00083 | Asparagus | *Pseudomonas putida* |
| SBP00083 | Asparagus | *Pseudomonas putida* |
| SBP00083 | Asparagus | *Pseudomonas reinekei* |
| SBP00083 | Asparagus | *Pseudomonas reinekei* |
| SBP00083 | Asparagus | *Pseudomonas resinovorans* |
| SBP00083 | Asparagus | *Pseudomonas resinovorans* |
| SBP00083 | Asparagus | *Pseudomonas rhizosphaerae* |
| SBP00083 | Asparagus | *Pseudomonas rhizosphaerae* |
| SBP00083 | Asparagus | *Pseudomonas rhodesiae* |
| SBP00083 | Asparagus | *Pseudomonas rhodesiae* |
| SBP00083 | Asparagus | *Pseudomonas sabulinigri* |
| SBP00083 | Asparagus | *Pseudomonas sabulinigri* |
| SBP00083 | Asparagus | *Pseudomonas salegens* |
| SBP00083 | Asparagus | *Pseudomonas salegens* |
| SBP00083 | Asparagus | *Pseudomonas saudiphocaensis* |
| SBP00083 | Asparagus | *Pseudomonas saudiphocaensis* |
| SBP00083 | Asparagus | *Pseudomonas savastanoi* |
| SBP00083 | Asparagus | *Pseudomonas savastanoi* |
| SBP00083 | Asparagus | *Pseudomonas sihuiensis* |
| SBP00083 | Asparagus | *Pseudomonas sihuiensis* |
| SBP00083 | Asparagus | *Pseudomonas silesiensis* |
| SBP00083 | Asparagus | *Pseudomonas silesiensis* |
| SBP00083 | Asparagus | *Pseudomonas soli* |
| SBP00083 | Asparagus | *Pseudomonas soli* |
| SBP00083 | Asparagus | *Pseudomonas sp.* |
| SBP00083 | Asparagus | *Pseudomonas sp.* |
| SBP00083 | Asparagus | *Pseudomonas sp.* 02C 26 |
| SBP00083 | Asparagus | *Pseudomonas sp.* 02C 26 |
| SBP00083 | Asparagus | *Pseudomonas sp.* 09C 129 |
| SBP00083 | Asparagus | *Pseudomonas sp.* 09C 129 |
| SBP00083 | Asparagus | *Pseudomonas sp.* 31-12 |
| SBP00083 | Asparagus | *Pseudomonas sp.* 31-12 |
| SBP00083 | Asparagus | *Pseudomonas sp.* 7SR1 |
| SBP00083 | Asparagus | *Pseudomonas sp.* 7SR1 |
| SBP00083 | Asparagus | *Pseudomonas sp.* A214 |
| SBP00083 | Asparagus | *Pseudomonas sp.* A214 |
| SBP00083 | Asparagus | *Pseudomonas sp.* ATCC 13867 |
| SBP00083 | Asparagus | *Pseudomonas sp.* ATCC 13867 |
| SBP00083 | Asparagus | *Pseudomonas sp.* B10 |
| SBP00083 | Asparagus | *Pseudomonas sp.* B10 |
| SBP00083 | Asparagus | *Pseudomonas sp.* CC6-YY-74 |
| SBP00083 | Asparagus | *Pseudomonas sp.* CC6-YY-74 |
| SBP00083 | Asparagus | *Pseudomonas sp.* CCOS 191 |
| SBP00083 | Asparagus | *Pseudomonas sp.* CCOS 191 |
| SBP00083 | Asparagus | *Pseudomonas sp.* CMR12a |
| SBP00083 | Asparagus | *Pseudomonas sp.* CMR12a |
| SBP00083 | Asparagus | *Pseudomonas sp.* CMR5c |
| SBP00083 | Asparagus | *Pseudomonas sp.* CMR5c |
| SBP00083 | Asparagus | *Pseudomonas sp.* CT14 |
| SBP00083 | Asparagus | *Pseudomonas sp.* CT14 |
| SBP00083 | Asparagus | *Pseudomonas sp.* DR 5-09 |
| SBP00083 | Asparagus | *Pseudomonas sp.* DR 5-09 |
| SBP00083 | Asparagus | *Pseudomonas sp.* DY-1 |
| SBP00083 | Asparagus | *Pseudomonas sp.* DY-1 |
| SBP00083 | Asparagus | *Pseudomonas sp.* FDAARGOS_380 |
| SBP00083 | Asparagus | *Pseudomonas sp.* FDAARGOS_380 |
| SBP00083 | Asparagus | *Pseudomonas sp.* FGI182 |

TABLE 3-continued

List of species identified in each metagenomic sample of each SBP Sample

| SBP ID | SBP Host Common Name | Genus sp. |
|---|---|---|
| SBP00083 | Asparagus | *Pseudomonas* sp. FGI182 |
| SBP00083 | Asparagus | *Pseudomonas* sp. GR 6-02 |
| SBP00083 | Asparagus | *Pseudomonas* sp. GR 6-02 |
| SBP00083 | Asparagus | *Pseudomonas* sp. HLS-6 |
| SBP00083 | Asparagus | *Pseudomonas* sp. HLS-6 |
| SBP00083 | Asparagus | *Pseudomonas* sp. JY-Q |
| SBP00083 | Asparagus | *Pseudomonas* sp. JY-Q |
| SBP00083 | Asparagus | *Pseudomonas* sp. K2W315-8 |
| SBP00083 | Asparagus | *Pseudomonas* sp. K2W31S-8 |
| SBP00083 | Asparagus | *Pseudomonas* sp. LAB-08 |
| SBP00083 | Asparagus | *Pseudomonas* sp. LAB-08 |
| SBP00083 | Asparagus | *Pseudomonas* sp. LBUM920 |
| SBP00083 | Asparagus | *Pseudomonas* sp. LBUM920 |
| SBP00083 | Asparagus | *Pseudomonas* sp. Leaf58 |
| SBP00083 | Asparagus | *Pseudomonas* sp. Leaf58 |
| SBP00083 | Asparagus | *Pseudomonas* sp. LG1D9 |
| SBP00083 | Asparagus | *Pseudomonas* sp. LG1D9 |
| SBP00083 | Asparagus | *Pseudomonas* sp. LG1E9 |
| SBP00083 | Asparagus | *Pseudomonas* sp. LG1E9 |
| SBP00083 | Asparagus | *Pseudomonas* sp. LH1G9 |
| SBP00083 | Asparagus | *Pseudomonas* sp. LH1G9 |
| SBP00083 | Asparagus | *Pseudomonas* sp. LPH1 |
| SBP00083 | Asparagus | *Pseudomonas* sp. LPH1 |
| SBP00083 | Asparagus | *Pseudomonas* sp. LTGT-11-2Z |
| SBP00083 | Asparagus | *Pseudomonas* sp. LTGT-11-2Z |
| SBP00083 | Asparagus | *Pseudomonas* sp. LTJR-52 |
| SBP00083 | Asparagus | *Pseudomonas* sp. LTJR-52 |
| SBP00083 | Asparagus | *Pseudomonas* sp. M30-35 |
| SBP00083 | Asparagus | *Pseudomonas* sp. M30-35 |
| SBP00083 | Asparagus | *Pseudomonas* sp. MRSN12121 |
| SBP00083 | Asparagus | *Pseudomonas* sp. MRSN12121 |
| SBP00083 | Asparagus | *Pseudomonas* sp. NC02 |
| SBP00083 | Asparagus | *Pseudomonas* sp. NC02 |
| SBP00083 | Asparagus | *Pseudomonas* sp. NS1(2017) |
| SBP00083 | Asparagus | *Pseudomonas* sp. NS1(2017) |
| SBP00083 | Asparagus | *Pseudomonas* sp. Os17 |
| SBP00083 | Asparagus | *Pseudomonas* sp. Os17 |
| SBP00083 | Asparagus | *Pseudomonas* sp. PONIH3 |
| SBP00083 | Asparagus | *Pseudomonas* sp. PONIH3 |
| SBP00083 | Asparagus | *Pseudomonas* sp. R1-43-08 |
| SBP00083 | Asparagus | *Pseudomonas* sp. R1-43-08 |
| SBP00083 | Asparagus | *Pseudomonas* sp. R2-37-08W |
| SBP00083 | Asparagus | *Pseudomonas* sp. R2-37-08W |
| SBP00083 | Asparagus | *Pseudomonas* sp. R2-7-07 |
| SBP00083 | Asparagus | *Pseudomonas* sp. R2-7-07 |
| SBP00083 | Asparagus | *Pseudomonas* sp. R2A2 |
| SBP00083 | Asparagus | *Pseudomonas* sp. R2A2 |
| SBP00083 | Asparagus | *Pseudomonas* sp. R4-34-07 |
| SBP00083 | Asparagus | *Pseudomonas* sp. R4-34-07 |
| SBP00083 | Asparagus | *Pseudomonas* sp. R4-39-08 |
| SBP00083 | Asparagus | *Pseudomonas* sp. R4-39-08 |
| SBP00083 | Asparagus | *Pseudomonas* sp. R5-89-07 |
| SBP00083 | Asparagus | *Pseudomonas* sp. R5-89-07 |
| SBP00083 | Asparagus | *Pseudomonas* sp. RU47 |
| SBP00083 | Asparagus | *Pseudomonas* sp. RU47 |
| SBP00083 | Asparagus | *Pseudomonas* sp. S-6-2 |
| SBP00083 | Asparagus | *Pseudomonas* sp. S-6-2 |
| SBP00083 | Asparagus | *Pseudomonas* sp. S09G 359 |
| SBP00083 | Asparagus | *Pseudomonas* sp. S09G 359 |
| SBP00083 | Asparagus | *Pseudomonas* sp. s211(2017) |
| SBP00083 | Asparagus | *Pseudomonas* sp. s211(2017) |
| SBP00083 | Asparagus | *Pseudomonas* sp. SGAir0191 |
| SBP00083 | Asparagus | *Pseudomonas* sp. SGAir0191 |
| SBP00083 | Asparagus | *Pseudomonas* sp. St29 |
| SBP00083 | Asparagus | *Pseudomonas* sp. St29 |
| SBP00083 | Asparagus | *Pseudomonas* sp. StFLB209 |
| SBP00083 | Asparagus | *Pseudomonas* sp. StFLB209 |
| SBP00083 | Asparagus | *Pseudomonas* sp. SWI36 |
| SBP00083 | Asparagus | *Pseudomonas* sp. SWI36 |
| SBP00083 | Asparagus | *Pseudomonas* sp. SWI44 |
| SBP00083 | Asparagus | *Pseudomonas* sp. SWI44 |
| SBP00083 | Asparagus | *Pseudomonas* sp. SWI6 |
| SBP00083 | Asparagus | *Pseudomonas* sp. SWI6 |
| SBP00083 | Asparagus | *Pseudomonas* sp. SXM-1 |
| SBP00083 | Asparagus | *Pseudomonas* sp. SXM-1 |
| SBP00083 | Asparagus | *Pseudomonas* sp. TCU-HL1 |

TABLE 3-continued

List of species identified in each metagenomic sample of each SBP Sample

| SBP ID | SBP Host Common Name | Genus sp. |
| --- | --- | --- |
| SBP00083 | Asparagus | *Pseudomonas* sp. TCU-HL1 |
| SBP00083 | Asparagus | *Pseudomonas* sp. TKP |
| SBP00083 | Asparagus | *Pseudomonas* sp. TKP |
| SBP00083 | Asparagus | *Pseudomonas* sp. TMW 2.1634 |
| SBP00083 | Asparagus | *Pseudomonas* sp. TMW 2.1634 |
| SBP00083 | Asparagus | *Pseudomonas* sp. URMO17WK12:I11 |
| SBP00083 | Asparagus | *Pseudomonas* sp. URMO17WK12:I11 |
| SBP00083 | Asparagus | *Pseudomonas* sp. UW4 |
| SBP00083 | Asparagus | *Pseudomonas* sp. UW4 |
| SBP00083 | Asparagus | *Pseudomonas* sp. VLB120 |
| SBP00083 | Asparagus | *Pseudomonas* sp. VLB120 |
| SBP00083 | Asparagus | *Pseudomonas* sp. WCS374 |
| SBP00083 | Asparagus | *Pseudomonas* sp. WCS374 |
| SBP00083 | Asparagus | *Pseudomonas* sp. XWY-1 |
| SBP00083 | Asparagus | *Pseudomonas* sp. XWY-1 |
| SBP00083 | Asparagus | *Pseudomonas* sp. Z003-0.4C(8344-21) |
| SBP00083 | Asparagus | *Pseudomonas* sp. 2003-0.4C(8344-21) |
| SBP00083 | Asparagus | *Pseudomonas stutzeri* |
| SBP00083 | Asparagus | *Pseudomonas stutzeri* |
| SBP00083 | Asparagus | *Pseudomonas synxantha* |
| SBP00083 | Asparagus | *Pseudomonas synxantha* |
| SBP00083 | Asparagus | *Pseudomonas syringae* |
| SBP00083 | Asparagus | *Pseudomonas syringae* |
| SBP00083 | Asparagus | *Pseudomonas syringae* group genomosp. 3 |
| SBP00083 | Asparagus | *Pseudomonas syringae* group genomosp. 3 |
| SBP00083 | Asparagus | *Pseudomonas taetrolens* |
| SBP00083 | Asparagus | *Pseudomonas taetrolens* |
| SBP00083 | Asparagus | *Pseudomonas thivervalensis* |
| SBP00083 | Asparagus | *Pseudomonas thivervalensis* |
| SBP00083 | Asparagus | *Pseudomonas tolaasii* |
| SBP00083 | Asparagus | *Pseudomonas tolaasii* |
| SBP00083 | Asparagus | *Pseudomonas trivialis* |
| SBP00083 | Asparagus | *Pseudomonas trivialis* |
| SBP00083 | Asparagus | *Pseudomonas umsongensis* |
| SBP00083 | Asparagus | *Pseudomonas umsongensis* |
| SBP00083 | Asparagus | *Pseudomonas vancouverensis* |
| SBP00083 | Asparagus | *Pseudomonas vancouverensis* |
| SBP00083 | Asparagus | *Pseudomonas veronii* |
| SBP00083 | Asparagus | *Pseudomonas veronii* |
| SBP00083 | Asparagus | *Pseudomonas versuta* |
| SBP00083 | Asparagus | *Pseudomonas versuta* |
| SBP00083 | Asparagus | *Pseudomonas viridiflava* |
| SBP00083 | Asparagus | *Pseudomonas viridiflava* |
| SBP00083 | Asparagus | *Pseudomonas xanthomarina* |
| SBP00083 | Asparagus | *Pseudomonas xanthomarina* |
| SBP00083 | Asparagus | *Pseudomonas xinjiangensis* |
| SBP00083 | Asparagus | *Pseudomonas xinjiangensis* |
| SBP00083 | Asparagus | *Pseudomonas yamanorum* |
| SBP00083 | Asparagus | *Pseudomonas yamanorum* |
| SBP00083 | Asparagus | *Pseudonocardia dioxanivorans* |
| SBP00083 | Asparagus | *Pseudonocardia dioxanivorans* |
| SBP00083 | Asparagus | *Pseudorhodoplanes sinuspersici* |
| SBP00083 | Asparagus | *Pseudorhodoplanes sinuspersici* |
| SBP00083 | Asparagus | *Pseudoxanthomonas spadix* |
| SBP00083 | Asparagus | *Pseudoxanthomonas spadix* |
| SBP00083 | Asparagus | *Pseudoxanthomonas suwonensis* |
| SBP00083 | Asparagus | *Pseudoxanthomonas suwonensis* |
| SBP00083 | Asparagus | *Rahnella aquatilis* |
| SBP00083 | Asparagus | *Rahnella aquatilis* |
| SBP00083 | Asparagus | *Rahnella* sp. ERMR1:05 |
| SBP00083 | Asparagus | *Rahnella* sp. ERMR1:05 |
| SBP00083 | Asparagus | *Ralstonia insidiosa* |
| SBP00083 | Asparagus | *Ralstonia insidiosa* |
| SBP00083 | Asparagus | *Ralstonia mannitolilytica* |
| SBP00083 | Asparagus | *Ralstonia mannitolilytica* |
| SBP00083 | Asparagus | *Ralstonia pickettii* |
| SBP00083 | Asparagus | *Ralstonia pickettii* |
| SBP00083 | Asparagus | *Ralstonia solanacearum* |
| SBP00083 | Asparagus | *Ralstonia solanacearum* |
| SBP00083 | Asparagus | *Ramlibacter tataouinensis* |
| SBP00083 | Asparagus | *Ramlibacter tataouinensis* |
| SBP00083 | Asparagus | *Raoultella ornithinolytica* |
| SBP00083 | Asparagus | *Raoultella ornithinolytica* |
| SBP00083 | Asparagus | *Raoultella planticola* |
| SBP00083 | Asparagus | *Raoultella planticola* |
| SBP00083 | Asparagus | *Raoultella terrigena* |

TABLE 3-continued

List of species identified in each metagenomic sample of each SBP Sample

| SBP ID | SBP Host Common Name | Genus sp. |
|---|---|---|
| SBP00083 | Asparagus | *Raoultella terrigena* |
| SBP00083 | Asparagus | *Rheinheimera* sp. LHK132 |
| SBP00083 | Asparagus | *Rheinheimera* sp. LHK132 |
| SBP00083 | Asparagus | *Rhizobium etli* |
| SBP00083 | Asparagus | *Rhizobium etli* |
| SBP00083 | Asparagus | *Rhizobium leguminosarum* |
| SBP00083 | Asparagus | *Rhizobium leguminosarum* |
| SBP00083 | Asparagus | *Rhizobium* sp. NT-26 |
| SBP00083 | Asparagus | *Rhizobium* sp. NT-26 |
| SBP00083 | Asparagus | *Rhodanobacter denitrificans* |
| SBP00083 | Asparagus | *Rhodanobacter denitrificans* |
| SBP00083 | Asparagus | *Rhodobacter sphaeroides* |
| SBP00083 | Asparagus | *Rhodobacter sphaeroides* |
| SBP00083 | Asparagus | *Rhodobiaceae bacterium* |
| SBP00083 | Asparagus | *Rhodobiaceae bacterium* |
| SBP00083 | Asparagus | *Rhodococcus fascians* |
| SBP00083 | Asparagus | *Rhodococcus fascians* |
| SBP00083 | Asparagus | *Rhodococcus opacus* |
| SBP00083 | Asparagus | *Rhodococcus opacus* |
| SBP00083 | Asparagus | *Rhodopseudomonas palustris* |
| SBP00083 | Asparagus | *Rhodopseudomonas palustris* |
| SBP00083 | Asparagus | *Rubrivivax gelatinosus* |
| SBP00083 | Asparagus | *Rubrivivax gelatinosus* |
| SBP00083 | Asparagus | *Rubrobacter xylanophilus* |
| SBP00083 | Asparagus | *Rubrobacter xylanophilus* |
| SBP00083 | Asparagus | *Ruegeria pomeroyi* |
| SBP00083 | Asparagus | *Ruegeria pomeroyi* |
| SBP00083 | Asparagus | *Rummeliibacillus stabekisii* |
| SBP00083 | Asparagus | *Rummeliibacillus stabekisii* |
| SBP00083 | Asparagus | *Runella* sp. SP2 |
| SBP00083 | Asparagus | *Runella* sp. SP2 |
| SBP00083 | Asparagus | *Sagittula* sp. P11 |
| SBP00083 | Asparagus | *Sagittula* sp. P11 |
| SBP00083 | Asparagus | *Salmonella bongori* |
| SBP00083 | Asparagus | *Salmonella bongori* |
| SBP00083 | Asparagus | *Salmonella enterica* |
| SBP00083 | Asparagus | *Salmonella enterica* |
| SBP00083 | Asparagus | *Sandaracinus amylolyticus* |
| SBP00083 | Asparagus | *Sandaracinus amylolyticus* |
| SBP00083 | Asparagus | *Serratia fonticola* |
| SBP00083 | Asparagus | *Serratia fonticola* |
| SBP00083 | Asparagus | *Serratia liquefaciens* |
| SBP00083 | Asparagus | *Serratia liquefaciens* |
| SBP00083 | Asparagus | *Serratia marcescens* |
| SBP00083 | Asparagus | *Serratia marcescens* |
| SBP00083 | Asparagus | *Serratia odorifera* |
| SBP00083 | Asparagus | *Serratia odorifera* |
| SBP00083 | Asparagus | *Serratia plymuthica* |
| SBP00083 | Asparagus | *Serratia plymuthica* |
| SBP00083 | Asparagus | *Serratia quinivorans* |
| SBP00083 | Asparagus | *Serratia quinivorans* |
| SBP00083 | Asparagus | *Serratia rubidaea* |
| SBP00083 | Asparagus | *Serratia rubidaea* |
| SBP00083 | Asparagus | *Serratia* sp. |
| SBP00083 | Asparagus | *Serratia* sp. |
| SBP00083 | Asparagus | *Serratia* sp. 1D1416 |
| SBP00083 | Asparagus | *Serratia* sp. 1O1416 |
| SBP00083 | Asparagus | *Serratia* sp. 3ACOL1 |
| SBP00083 | Asparagus | *Serratia* sp. 3ACOL1 |
| SBP00083 | Asparagus | *Serratia* sp. ATCC 39006 |
| SBP00083 | Asparagus | *Serratia* sp. ATCC 39006 |
| SBP00083 | Asparagus | *Serratia* sp. FDAARGOS_506 |
| SBP00083 | Asparagus | *Serratia* sp. FDAARGOS_506 |
| SBP00083 | Asparagus | *Serratia* sp. FGI94 |
| SBP00083 | Asparagus | *Serratia* sp. FGI94 |
| SBP00083 | Asparagus | *Serratia* sp. FS14 |
| SBP00083 | Asparagus | *Serratia* sp. FS14 |
| SBP00083 | Asparagus | *Serratia* sp. JKS000199 |
| SBP00083 | Asparagus | *Serratia* sp. JKS000199 |
| SBP00083 | Asparagus | *Serratia* sp. MYb239 |
| SBP00083 | Asparagus | *Serratia* sp. MYb239 |
| SBP00083 | Asparagus | *Serratia* sp. P2ACOL2 |
| SBP00083 | Asparagus | *Serratia* sp. P2ACOL2 |
| SBP00083 | Asparagus | *Serratia* sp. SCBI |
| SBP00083 | Asparagus | *Serratia* sp. SCBI |
| SBP00083 | Asparagus | *Serratia* sp. SSNIH1 |

TABLE 3-continued

List of species identified in each metagenomic sample of each SBP Sample

| SBP ID | SBP Host Common Name | Genus sp. |
|---|---|---|
| SBP00083 | Asparagus | *Serratia* sp. SSNIH1 |
| SBP00083 | Asparagus | *Serratia* sp. YD25 |
| SBP00083 | Asparagus | *Serratia* sp. YD25 |
| SBP00083 | Asparagus | *Shewanella baltica* |
| SBP00083 | Asparagus | *Shewanella baltica* |
| SBP00083 | Asparagus | *Shewanella bicestrii* |
| SBP00083 | Asparagus | *Shewanella bicestrii* |
| SBP00083 | Asparagus | *Shewanella marisflavi* |
| SBP00083 | Asparagus | *Shewanella marisflavi* |
| SBP00083 | Asparagus | *Shewanella oneidensis* |
| SBP00083 | Asparagus | *Shewanella oneidensis* |
| SBP00083 | Asparagus | *Shewanella pealeana* |
| SBP00083 | Asparagus | *Shewanella pealeana* |
| SBP00083 | Asparagus | *Shigella dysenteriae* |
| SBP00083 | Asparagus | *Shigella dysenteriae* |
| SBP00083 | Asparagus | *Shigella flexneri* |
| SBP00083 | Asparagus | *Shigella flexneri* |
| SBP00083 | Asparagus | *Shimwellia blattae* |
| SBP00083 | Asparagus | *Shimwellia blattae* |
| SBP00083 | Asparagus | *Shinella* sp. HZN7 |
| SBP00083 | Asparagus | *Shinella* sp. HZN7 |
| SBP00083 | Asparagus | *Sinorhizobium fredii* |
| SBP00083 | Asparagus | *Sinorhizobium fredii* |
| SBP00083 | Asparagus | *Sinorhizobium meliloti* |
| SBP00083 | Asparagus | *Sinorhizobium meliloti* |
| SBP00083 | Asparagus | *Sinorhizobium* sp. RAC02 |
| SBP00083 | Asparagus | *Sinorhizobium* sp. RAC02 |
| SBP00083 | Asparagus | *Sneathia amnii* |
| SBP00083 | Asparagus | *Sneathia amnil* |
| SBP00083 | Asparagus | *Sodalis* endosymbiont of *Henestaris halophilus* |
| SBP00083 | Asparagus | *Sodalis* endosymbiont of *Henestaris halophilus* |
| SBP00083 | Asparagus | *Sodalis glossinidius* |
| SBP00083 | Asparagus | *Sodalis glossinidius* |
| SBP00083 | Asparagus | *Sodalis praecaptivus* |
| SBP00083 | Asparagus | *Sodalis praecaptivus* |
| SBP00083 | Asparagus | *Solibacillus silvestris* |
| SBP00083 | Asparagus | *Solibacillus silvestris* |
| SBP00083 | Asparagus | *Solibacillus* sp. R5-41 |
| SBP00083 | Asparagus | *Solibacillus* sp. R5-41 |
| SBP00083 | Asparagus | *Sorangium cellulosum* |
| SBP00083 | Asparagus | *Sorangium cellulosum* |
| SBP00083 | Asparagus | *Sphingobacterium* sp. B29 |
| SBP00083 | Asparagus | *Sphingobacterium* sp. 829 |
| SBP00083 | Asparagus | *Sphingobacterium* sp. G1-14 |
| SBP00083 | Asparagus | *Sphingobacterium* sp. G1-14 |
| SBP00083 | Asparagus | *Sphingobacterium thalpophilum* |
| SBP00083 | Asparagus | *Sphingobacterium thalpophilum* |
| SBP00083 | Asparagus | *Sphingobium amiense* |
| SBP00083 | Asparagus | *Sphingobium amiense* |
| SBP00083 | Asparagus | *Sphingobium* sp. MI1205 |
| SBP00083 | Asparagus | *Sphingobium* sp. MI1205 |
| SBP00083 | Asparagus | *Sphingobium* sp. SYK-6 |
| SBP00083 | Asparagus | *Sphingobium* sp. SYK-6 |
| SBP00083 | Asparagus | *Sphingobium yanoikuyae* |
| SBP00083 | Asparagus | *Sphingobium yanoikuyae* |
| SBP00083 | Asparagus | *Sphingomonas koreensis* |
| SBP00083 | Asparagus | *Sphingomonas koreensis* |
| SBP00083 | Asparagus | *Sphingomonas panacis* |
| SBP00083 | Asparagus | *Sphingomonas panacis* |
| SBP00083 | Asparagus | *Sphingomonas* sp. AAP5 |
| SBP00083 | Asparagus | *Sphingomonas* sp. AAP5 |
| SBP00083 | Asparagus | *Sphingomonas* sp. FARSPH |
| SBP00083 | Asparagus | *Sphingomonas* sp. FARSPH |
| SBP00083 | Asparagus | *Sphingomonas* sp. JJ-A5 |
| SBP00083 | Asparagus | *Sphingomonas* sp. JJ-A5 |
| SBP00083 | Asparagus | *Sphingomonas* sp. LK11 |
| SBP00083 | Asparagus | *Sphingomonas* sp. LK11 |
| SBP00083 | Asparagus | *Sphingomonas* sp. LM7 |
| SBP00083 | Asparagus | *Sphingomonas* sp. LM7 |
| SBP00083 | Asparagus | *Sphingomonas* sp. MM-1 |
| SBP00083 | Asparagus | *Sphingomonas* sp. MM-1 |
| SBP00083 | Asparagus | *Sphingomonas taxi* |
| SBP00083 | Asparagus | *Sphingomonas taxi* |
| SBP00083 | Asparagus | *Sphingopyxis macrogoltabida* |
| SBP00083 | Asparagus | *Sphingopyxis macrogoltabida* |
| SBP00083 | Asparagus | *Sphingopyxis* sp. FD7 |

TABLE 3-continued

List of species identified in each metagenomic sample of each SBP Sample

| SBP ID | SBP Host Common Name | Genus sp. |
|---|---|---|
| SBP00083 | Asparagus | *Sphingopyxis* sp. FD7 |
| SBP00083 | Asparagus | *Sphingosinicella* sp. BN140058 |
| SBP00083 | Asparagus | *Sphingosinicella* sp. BN140058 |
| SBP00083 | Asparagus | *Spodoptera frugiperda* ascovirus 1a |
| SBP00083 | Asparagus | *Spodoptera frugiperda* ascovirus 1a |
| SBP00083 | Asparagus | *Sporosarcina psychrophila* |
| SBP00083 | Asparagus | *Sporosarcina psychrophila* |
| SBP00083 | Asparagus | *Sporosarcina ureae* |
| SBP00083 | Asparagus | *Sporosarcina ureae* |
| SBP00083 | Asparagus | *Staphylococcus aureus* |
| SBP00083 | Asparagus | *Staphylococcus aureus* |
| SBP00083 | Asparagus | *Staphylococcus haemolyticus* |
| SBP00083 | Asparagus | *Staphylococcus haemolyticus* |
| SBP00083 | Asparagus | *Staphylococcus sciuri* |
| SBP00083 | Asparagus | *Staphylococcus sciuri* |
| SBP00083 | Asparagus | *Staphylococcus* sp. M0911 |
| SBP00083 | Asparagus | *Staphylococcus* sp. M0911 |
| SBP00083 | Asparagus | *Staphylococcus xylosus* |
| SBP00083 | Asparagus | *Staphylococcus xylosus* |
| SBP00083 | Asparagus | *Stenotrophomonas acidaminiphila* |
| SBP00083 | Asparagus | *Stenotrophomonas acidaminiphila* |
| SBP00083 | Asparagus | *Stenotrophomonas maltophilia* |
| SBP00083 | Asparagus | *Stenotrophomonas maltophilia* |
| SBP00083 | Asparagus | *Stenotrophomonas rhizophila* |
| SBP00083 | Asparagus | *Stenotrophomonas rhizophila* |
| SBP00083 | Asparagus | *Stenotrophomonas* sp. |
| SBP00083 | Asparagus | *Stenotrophomonas* sp. |
| SBP00083 | Asparagus | *Stenotrophomonas* sp. ESTM1D_MKCIP4_1 |
| SBP00083 | Asparagus | *Stenotrophomonas* sp. ESTM1D_MKCIP4_1 |
| SBP00083 | Asparagus | *Stenotrophomonas* sp. G4 |
| SBP00083 | Asparagus | *Stenotrophomonas* sp. G4 |
| SBP00083 | Asparagus | *Stenotrophomonas* sp. MYb57 |
| SBP00083 | Asparagus | *Stenotrophomonas* sp. MYb57 |
| SBP00083 | Asparagus | *Stenotrophomonas* sp. Pemsol |
| SBP00083 | Asparagus | *Stenotrophomonas* sp. Pemsol |
| SBP00083 | Asparagus | *Stenotrophomonas* sp. SAU14A_NAIMI4_5 |
| SBP00083 | Asparagus | *Stenotrophomonas* sp. SAU14A_NAIMI4_5 |
| SBP00083 | Asparagus | *Stenotrophomonas* sp. SAU14A_NAIMI4_8 |
| SBP00083 | Asparagus | *Stenotrophomonas* sp. SAU14A_NAIMI4_8 |
| SBP00083 | Asparagus | *Stenotrophomonas* sp. WZN-1 |
| SBP00083 | Asparagus | *Stenotrophomonas* sp. WZN-1 |
| SBP00083 | Asparagus | *Stenotrophomonas* sp. YAU14A_MKIMI4_1 |
| SBP00083 | Asparagus | *Stenotrophomonas* sp. YAU14A_MKIMI4_1 |
| SBP00083 | Asparagus | *Stenotrophomonas* sp. YAU14D1_LEIMI4_1 |
| SBP00083 | Asparagus | *Stenotrophomonas* sp. YAU14D1_LEIMI4_1 |
| SBP00083 | Asparagus | *Stenotrophomonas* sp. ZAC14A_NAIMI4_1 |
| SBP00083 | Asparagus | *Stenotrophomonas* sp. ZAC14A_NAIMI4_1 |
| SBP00083 | Asparagus | *Stenotrophomonas* sp. ZAC14D2_NAIMI4_6 |
| SBP00083 | Asparagus | *Stenotrophomonas* sp. ZAC14DZ_NAIMI4_6 |
| SBP00083 | Asparagus | *Stenotrophomonas* sp. ZAC14D2_NAIMI4_7 |
| SBP00083 | Asparagus | *Stenotrophomonas* sp. ZAC14D2_NAIMI4_7 |
| SBP00083 | Asparagus | *Streptococcus pantholopis* |
| SBP00083 | Asparagus | *Streptococcus pantholopis* |
| SBP00083 | Asparagus | *Streptomyces clavuligerus* |
| SBP00083 | Asparagus | *Streptomyces clavuligerus* |
| SBP00083 | Asparagus | *Streptomyces davaonensis* |
| SBP00083 | Asparagus | *Streptomyces davaonensis* |
| SBP00083 | Asparagus | *Streptomyces fungicidicus* |
| SBP00083 | Asparagus | *Streptomyces fungicidicus* |
| SBP00083 | Asparagus | *Streptomyces gilvosporeus* |
| SBP00083 | Asparagus | *Streptomyces gilvosporeus* |
| SBP00083 | Asparagus | *Streptomyces lydicus* |
| SBP00083 | Asparagus | *Streptomyces lydicus* |
| SBP00083 | Asparagus | *Streptomyces nigra* |
| SBP00083 | Asparagus | *Streptomyces nigra* |
| SBP00083 | Asparagus | *Streptomyces pactum* |
| SBP00083 | Asparagus | *Streptomyces pactum* |
| SBP00083 | Asparagus | *Streptomyces pristinaespiralis* |
| SBP00083 | Asparagus | *Streptomyces pristinaespiralis* |
| SBP00083 | Asparagus | *Streptomyces* sp. Go-475 |
| SBP00083 | Asparagus | *Streptomyces* sp. Go-475 |
| SBP00083 | Asparagus | *Streptomyces* sp. ICC1 |
| SBP00083 | Asparagus | *Streptomyces* sp. ICC1 |
| SBP00083 | Asparagus | *Streptomyces* sp. M2 |
| SBP00083 | Asparagus | *Streptomyces* sp. M2 |
| SBP00083 | Asparagus | *Streptomyces* sp. SGAir0924 |

TABLE 3-continued

List of species identified in each metagenomic sample of each SBP Sample

| SBP ID | SBP Host Common Name | Genus sp. |
|---|---|---|
| SBP00083 | Asparagus | *Streptomyces* sp. SGAir0924 |
| SBP00083 | Asparagus | *Streptomyces venezuelae* |
| SBP00083 | Asparagus | *Streptomyces venezuelae* |
| SBP00083 | Asparagus | *Tannerella* sp. oral taxon HOT-286 |
| SBP00083 | Asparagus | *Tannerella* sp. oral taxon HOT-286 |
| SBP00083 | Asparagus | *Tatumella citrea* |
| SBP00083 | Asparagus | *Tatumella citrea* |
| SBP00083 | Asparagus | *Tatumella ptyseos* |
| SBP00083 | Asparagus | *Tatumella ptyseos* |
| SBP00083 | Asparagus | *Tepidanaerobacter acetatoxydans* |
| SBP00083 | Asparagus | *Tepidanaerobacter acetatoxydans* |
| SBP00083 | Asparagus | *Terribacillus goriensis* |
| SBP00083 | Asparagus | *Terribacillus goriensis* |
| SBP00083 | Asparagus | *Thalassospira xiamenensis* |
| SBP00083 | Asparagus | *Thalassospira xiamenensis* |
| SBP00083 | Asparagus | *Thermomonas* sp. SY21 |
| SBP00083 | Asparagus | *Thermomonas* sp. SY21 |
| SBP00083 | Asparagus | *Thiobacillus denitrificans* |
| SBP00083 | Asparagus | *Thiobacillus denitrificans* |
| SBP00083 | Asparagus | *Tolumonas auensis* |
| SBP00083 | Asparagus | *Tolumonas auensis* |
| SBP00083 | Asparagus | *Tsukamurella paurometabola* |
| SBP00083 | Asparagus | *Tsukamurella paurometabola* |
| SBP00083 | Asparagus | *Tsukamurella tyrosinosolvens* |
| SBP00083 | Asparagus | *Tsukamurella tyrosinosolvens* |
| SBP00083 | Asparagus | *Variovorax paradoxus* |
| SBP00083 | Asparagus | *Variovorax paradoxus* |
| SBP00083 | Asparagus | *Variovorax* sp. HW608 |
| SBP00083 | Asparagus | *Variovorax* sp. HW608 |
| SBP00083 | Asparagus | *Vibrio anguillarum* |
| SBP00083 | Asparagus | *Vibrio anguillarum* |
| SBP00083 | Asparagus | *Vibrio aphrogenes* |
| SBP00083 | Asparagus | *Vibrio aphrogenes* |
| SBP00083 | Asparagus | *Vibrio azureus* |
| SBP00083 | Asparagus | *Vibrio azureus* |
| SBP00083 | Asparagus | *Vibrio casei* |
| SBP00083 | Asparagus | *Vibrio casei* |
| SBP00083 | Asparagus | *Vibrio chagasii* |
| SBP00083 | Asparagus | *Vibrio chagasii* |
| SBP00083 | Asparagus | *Vibrio cholerae* |
| SBP00083 | Asparagus | *Vibrio cholerae* |
| SBP00083 | Asparagus | *Vibrio coralliilyticus* |
| SBP00083 | Asparagus | *Vibrio coralliilyticus* |
| SBP00083 | Asparagus | *Vibrio furnissii* |
| SBP00083 | Asparagus | *Vibrio furnissii* |
| SBP00083 | Asparagus | *Vibrio nigripulchritudo* |
| SBP00083 | Asparagus | *Vibrio nigripulchritudo* |
| SBP00083 | Asparagus | *Vibrio parahaemolyticus* |
| SBP00083 | Asparagus | *Vibrio parahaemolyticus* |
| SBP00083 | Asparagus | *Vibrio rumoiensis* |
| SBP00083 | Asparagus | *Vibrio rumoiensis* |
| SBP00083 | Asparagus | *Vibrio scophthalmi* |
| SBP00083 | Asparagus | *Vibrio scophthalmi* |
| SBP00083 | Asparagus | *Vibrio* sp. HBUAS61001 |
| SBP00083 | Asparagus | *Vibrio* sp. HBUAS61001 |
| SBP00083 | Asparagus | *Vibrio tasmaniensis* |
| SBP00083 | Asparagus | *Vibrio tasmaniensis* |
| SBP00083 | Asparagus | *Vibrio tritonius* |
| SBP00083 | Asparagus | *Vibrio tritonius* |
| SBP00083 | Asparagus | *Vibrio tubiashii* |
| SBP00083 | Asparagus | *Vibrio tubiashii* |
| SBP00083 | Asparagus | *Vibrio vulnificus* |
| SBP00083 | Asparagus | *Vibrio vulnificus* |
| SBP00083 | Asparagus | *Weissella cibaria* |
| SBP00083 | Asparagus | *Weissella cibaria* |
| SBP00083 | Asparagus | *Xanthobacter autotrophicus* |
| SBP00083 | Asparagus | *Xanthobacter autotrophicus* |
| SBP00083 | Asparagus | *Xanthomonas campestris* |
| SBP00083 | Asparagus | *Xanthomonas campestris* |
| SBP00083 | Asparagus | *Xanthomonas cassavae* |
| SBP00083 | Asparagus | *Xanthomonas cassavae* |
| SBP00083 | Asparagus | *Xanthomonas citri* |
| SBP00083 | Asparagus | *Xanthomonas citri* |
| SBP00083 | Asparagus | *Xanthomonas fragariae* |
| SBP00083 | Asparagus | *Xanthomonas fragariae* |
| SBP00083 | Asparagus | *Xanthomonas gardneri* |

TABLE 3-continued

List of species identified in each metagenomic sample of each SBP Sample

| SBP ID | SBP Host Common Name | Genus sp. |
|---|---|---|
| SBP00083 | Asparagus | Xanthomonas gardneri |
| SBP00083 | Asparagus | Xanthomonas oryzae |
| SBP00083 | Asparagus | Xanthomonas oryzae |
| SBP00083 | Asparagus | Xanthomonas sacchari |
| SBP00083 | Asparagus | Xanthomonas sacchari |
| SBP00083 | Asparagus | Xanthomonas translucens |
| SBP00083 | Asparagus | Xanthomonas translucens |
| SBP00083 | Asparagus | Xanthomonas vesicatoria |
| SBP00083 | Asparagus | Xanthomonas vesicatoria |
| SBP00083 | Asparagus | Xenorhabdus bovienii |
| SBP00083 | Asparagus | Xenorhabdus bovienii |
| SBP00083 | Asparagus | Xenorhabdus doucetiae |
| SBP00083 | Asparagus | Xenorhabdus doucetiae |
| SBP00083 | Asparagus | Xenorhabdus hominickii |
| SBP00083 | Asparagus | Xenorhabdus hominickii |
| SBP00083 | Asparagus | Xenorhabdus nematophila |
| SBP00083 | Asparagus | Xenorhabdus nematophila |
| SBP00083 | Asparagus | Xenorhabdus poinarii |
| SBP00083 | Asparagus | Xenorhabdus poinarii |
| SBP00083 | Asparagus | Yangia pacifica |
| SBP00083 | Asparagus | Yangia pacifica |
| SBP00083 | Asparagus | Yersinia aldovae |
| SBP00083 | Asparagus | Yersinia aldovae |
| SBP00083 | Asparagus | Yersinia aleksiciae |
| SBP00083 | Asparagus | Yersinia aleksiciae |
| SBP00083 | Asparagus | Yersinia enterocolitica |
| SBP00083 | Asparagus | Yersinia enterocolitica |
| SBP00083 | Asparagus | Yersinia entomophaga |
| SBP00083 | Asparagus | Yersinia entomophaga |
| SBP00083 | Asparagus | Yersinia frederiksenii |
| SBP00083 | Asparagus | Yersinia frederiksenii |
| SBP00083 | Asparagus | Yersinia intermedia |
| SBP00083 | Asparagus | Yersinia intermedia |
| SBP00083 | Asparagus | Yersinia kristensenii |
| SBP00083 | Asparagus | Yersinia kristensenii |
| SBP00083 | Asparagus | Yersinia massiliensis |
| SBP00083 | Asparagus | Yersinia massiliensis |
| SBP00083 | Asparagus | Yersinia pestis |
| SBP00083 | Asparagus | Yersinia pestis |
| SBP00083 | Asparagus | Yersinia pseudotuberculosis |
| SBP00083 | Asparagus | Yersinia pseudotuberculosis |
| SBP00083 | Asparagus | Yersinia rohdei |
| SBP00083 | Asparagus | Yersinia rohdei |
| SBP00083 | Asparagus | Yersinia ruckeri |
| SBP00083 | Asparagus | Yersinia ruckeri |
| SBP00083 | Asparagus | Yersinia similis |
| SBP00083 | Asparagus | Yersinia similis |
| SBP00083 | Asparagus | Zobellella denitrificans |
| SBP00083 | Asparagus | Zobellella denitrificans |
| SBP00085 | Carrot - yellow | [Brevibacterium] frigoritolerans |
| SBP00085 | Carrot - yellow | [Polyangium] brachysporum |
| SBP00085 | Carrot - yellow | Acanthocystis turfacea chlorella virus 1 |
| SBP00085 | Carrot - yellow | Acholeplasma oculi |
| SBP00085 | Carrot - yellow | Achromobacter denitrificans |
| SBP00085 | Carrot - yellow | Achromobacter insolitus |
| SBP00085 | Carrot - yellow | Achromobacter sp. AONIH1 |
| SBP00085 | Carrot - yellow | Achromobacter sp. B7 |
| SBP00085 | Carrot - yellow | Achromobacter sp. MFA1 R4 |
| SBP00085 | Carrot - yellow | Achromobacter spanius |
| SBP00085 | Carrot - yellow | Achromobacter xylosoxidans |
| SBP00085 | Carrot - yellow | Acidaminococcus fermentans |
| SBP00085 | Carrot - yellow | Acidipropionibacterium jensenii |
| SBP00085 | Carrot - yellow | Acidisphaera sp. G45-3 |
| SBP00085 | Carrot - yellow | Acidobacterium capsulatum |
| SBP00085 | Carrot - yellow | Acidovorax avenae |
| SBP00085 | Carrot - yellow | Acidovorax carolinensis |
| SBP00085 | Carrot - yellow | Acidovorax cattleyae |
| SBP00085 | Carrot - yellow | Acidovorax citrulli |
| SBP00085 | Carrot - yellow | Acidovorax sp. 1608163 |
| SBP00085 | Carrot - yellow | Acidovorax sp. KKS102 |
| SBP00085 | Carrot - yellow | Acidovorax sp. RAC01 |
| SBP00085 | Carrot - yellow | Acinetobacter baumannii |
| SBP00085 | Carrot - yellow | Acinetobacter calcoaceticus |
| SBP00085 | Carrot - yellow | Acinetobacter haemolyticus |
| SBP00085 | Carrot - yellow | Acinetobacter johnsonii |
| SBP00085 | Carrot - yellow | Acinetobacter schindleri |

TABLE 3-continued

List of species identified in each metagenomic sample of each SBP Sample

| SBP ID | SBP Host Common Name | Genus sp. |
| --- | --- | --- |
| SBP00085 | Carrot - yellow | *Acinetobacter* sp. ACNIH2 |
| SBP00085 | Carrot - yellow | *Acinetobacter* sp. LoGeW2-3 |
| SBP00085 | Carrot - yellow | *Acinetobacter* sp. SWBY1 |
| SBP00085 | Carrot - yellow | *Acinetobacter* sp. TTH0-4 |
| SBP00085 | Carrot - yellow | *Acinetobacter* sp. WCHAc010034 |
| SBP00085 | Carrot - yellow | *Acinetobacter wuhouensis* |
| SBP00085 | Carrot - yellow | *Actinoalloteichus* sp. AHMU CJ021 |
| SBP00085 | Carrot - yellow | *Actinomadura amylolytica* |
| SBP00085 | Carrot - yellow | *Actinoplanes derwentensis* |
| SBP00085 | Carrot - yellow | *Actinoplanes friuliensis* |
| SBP00085 | Carrot - yellow | *Actinoplanes missouriensis* |
| SBP00085 | Carrot - yellow | *Actinoplanes* sp. ATCC 31351 |
| SBP00085 | Carrot - yellow | *Actinoplanes* sp. N902-109 |
| SBP00085 | Carrot - yellow | *Actinoplanes* sp. OR16 |
| SBP00085 | Carrot - yellow | *Actinoplanes teichomyceticus* |
| SBP00085 | Carrot - yellow | *Actinopolyspora erythraea* |
| SBP00085 | Carrot - yellow | *Actinosynnema pretiosum* |
| SBP00085 | Carrot - yellow | *Aeromicrobium choanae* |
| SBP00085 | Carrot - yellow | *Aeromicrobium erythreum* |
| SBP00085 | Carrot - yellow | *Aeromicrobium marinum* |
| SBP00085 | Carrot - yellow | *Aeromicrobium* sp. 592 |
| SBP00085 | Carrot - yellow | *Aeromicrobium* sp. A1-2 |
| SBP00085 | Carrot - yellow | *Aeromonas hydrophila* |
| SBP00085 | Carrot - yellow | *Aeromonas salmonicida* |
| SBP00085 | Carrot - yellow | *Aeromonas veronii* |
| SBP00085 | Carrot - yellow | *Afipia* sp. GAS231 |
| SBP00085 | Carrot - yellow | *Agrobacterium fabrum* |
| SBP00085 | Carrot - yellow | *Agrobacterium larrymoorei* |
| SBP00085 | Carrot - yellow | *Agrobacterium rhizogenes* |
| SBP00085 | Carrot - yellow | *Agrobacterium* sp. |
| SBP00085 | Carrot - yellow | *Agrobacterium* sp. RAC06 |
| SBP00085 | Carrot - yellow | *Agrobacterium tumefaciens* |
| SBP00085 | Carrot - yellow | *Agrobacterium vitis* |
| SBP00085 | Carrot - yellow | *Agrococcus carbonis* |
| SBP00085 | Carrot - yellow | *Agrococcus jejuensis* |
| SBP00085 | Carrot - yellow | *Agrococcus* sp. SGAir0287 |
| SBP00085 | Carrot - yellow | *Agromyces aureus* |
| SBP00085 | Carrot - yellow | *Agromyces flavus* |
| SBP00085 | Carrot - yellow | *Agromyces* sp. 30A |
| SBP00085 | Carrot - yellow | *Agromyces* sp. LHK192 |
| SBP00085 | Carrot - yellow | *Ahniella affigens* |
| SBP00085 | Carrot - yellow | *Alcaligenes faecalis* |
| SBP00085 | Carrot - yellow | *Alcanivorax pacificus* |
| SBP00085 | Carrot - yellow | *Alcanivorax* sp. N3-2A |
| SBP00085 | Carrot - yellow | *Alicycliphilus denitrificans* |
| SBP00085 | Carrot - yellow | *Alloactinosynnema* sp. L-07 |
| SBP00085 | Carrot - yellow | *Allochromatium vinosum* |
| SBP00085 | Carrot - yellow | *Allokutzneria albata* |
| SBP00085 | Carrot - yellow | *Alphaproteobacteria bacterium* WS11 |
| SBP00085 | Carrot - yellow | *Altererythrobacter atlanticus* |
| SBP00085 | Carrot - yellow | *Altererythrobacter dongtanensis* |
| SBP00085 | Carrot - yellow | *Altererythrobacter epoxidivorans* |
| SBP00085 | Carrot - yellow | *Altererythrobacter ishigakiensis* |
| SBP00085 | Carrot - yellow | *Altererythrobacter mangrovi* |
| SBP00085 | Carrot - yellow | *Altererythrobacter marensis* |
| SBP00085 | Carrot - yellow | *Altererythrobacter namhicola* |
| SBP00085 | Carrot - yellow | *Altererythrobacter* sp. B11 |
| SBP00085 | Carrot - yellow | *Altererythrobacter* sp. NS1 |
| SBP00085 | Carrot - yellow | *Altererythrobacter* sp. ZODW24 |
| SBP00085 | Carrot - yellow | *Alteromonas mediterranea* |
| SBP00085 | Carrot - yellow | *Aminobacter aminovorans* |
| SBP00085 | Carrot - yellow | *Aminobacter* sp. MSH1 |
| SBP00085 | Carrot - yellow | *Amphibacillus xylanus* |
| SBP00085 | Carrot - yellow | *Amycolatopsis albispora* |
| SBP00085 | Carrot - yellow | *Amycolatopsis mediterranei* |
| SBP00085 | Carrot - yellow | *Amycolatopsis methanolica* |
| SBP00085 | Carrot - yellow | *Amycolatopsis orientalis* |
| SBP00085 | Carrot - yellow | *Amycolatopsis* sp. AA4 |
| SBP00085 | Carrot - yellow | *Amycolatopsis* sp. BJA-103 |
| SBP00085 | Carrot - yellow | *Anabaenopsis circularis* |
| SBP00085 | Carrot - yellow | *Anaeromyxobacter dehalogenans* |
| SBP00085 | Carrot - yellow | *Anaeromyxobacter* sp. Fw109-5 |
| SBP00085 | Carrot - yellow | *Anaeromyxobacter* sp. K |
| SBP00085 | Carrot - yellow | *Aquabacterium olei* |
| SBP00085 | Carrot - yellow | *Aquimarina* sp. AD1 |
| SBP00085 | Carrot - yellow | *Archangium gephyra* |

TABLE 3-continued

List of species identified in each metagenomic sample of each SBP Sample

| SBP ID | SBP Host Common Name | Genus sp. |
|---|---|---|
| SBP00085 | Carrot - yellow | *Arcobacter skirrowii* |
| SBP00085 | Carrot - yellow | *Aromatoleum aromaticum* |
| SBP00085 | Carrot - yellow | *Arsenicicoccus* sp. oral taxon 190 |
| SBP00085 | Carrot - yellow | *Arthrobacter alpinus* |
| SBP00085 | Carrot - yellow | *Arthrobacter* sp. ERGS1:01 |
| SBP00085 | Carrot - yellow | *Arthrobacter* sp. PGP41 |
| SBP00085 | Carrot - yellow | *Arthrobacter* sp. QXT-31 |
| SBP00085 | Carrot - yellow | *Arthrobacter* sp. YC-RL1 |
| SBP00085 | Carrot - yellow | *Asticcacaulis excentricus* |
| SBP00085 | Carrot - yellow | *Aureimonas* sp. AU20 |
| SBP00085 | Carrot - yellow | *Azoarcus communis* |
| SBP00085 | Carrot - yellow | *Azoarcus* sp. CIB |
| SBP00085 | Carrot - yellow | *Azoarcus* sp. DN11 |
| SBP00085 | Carrot - yellow | *Azoarcus* sp. KH32C |
| SBP00085 | Carrot - yellow | *Azoarcus* sp. SY39 |
| SBP00085 | Carrot - yellow | *Azorhizobium caulinodans* |
| SBP00085 | Carrot - yellow | *Azospira oryzae* |
| SBP00085 | Carrot - yellow | *Azospirillum brasilense* |
| SBP00085 | Carrot - yellow | *Azospirillum humicireducens* |
| SBP00085 | Carrot - yellow | *Azospirillum lipoferum* |
| SBP00085 | Carrot - yellow | *Azospirillum* sp. CFH 70021 |
| SBP00085 | Carrot - yellow | *Azospirillum* sp. M2T2B2 |
| SBP00085 | Carrot - yellow | *Azospirillum* sp. TSA2s |
| SBP00085 | Carrot - yellow | *Azospirillum* sp. TSH100 |
| SBP00085 | Carrot - yellow | *Azospirillum thiophilum* |
| SBP00085 | Carrot - yellow | *Azotobacter chroococcum* |
| SBP00085 | Carrot - yellow | *Azotobacter vinelandii* |
| SBP00085 | Carrot - yellow | *Bacillus beveridgei* |
| SBP00085 | Carrot - yellow | *Bacillus cereus* |
| SBP00085 | Carrot - yellow | *Bacillus clausii* |
| SBP00085 | Carrot - yellow | *Bacillus halotolerans* |
| SBP00085 | Carrot - yellow | *Bacillus megaterium* |
| SBP00085 | Carrot - yellow | *Bacillus muralis* |
| SBP00085 | Carrot - yellow | *Bacillus paralicheniformis* |
| SBP00085 | Carrot - yellow | *Bacillus safensis* |
| SBP00085 | Carrot - yellow | *Bacillus* sp. (in: Bacteria) |
| SBP00085 | Carrot - yellow | *Bacillus subtilis* |
| SBP00085 | Carrot - yellow | *Bacillus thuringiensis* |
| SBP00085 | Carrot - yellow | *Bacillus vallismortis* |
| SBP00085 | Carrot - yellow | *Bacteroides cellulosilyticus* |
| SBP00085 | Carrot - yellow | *Bacteroides coprosuis* |
| SBP00085 | Carrot - yellow | *Bacteroides salanitronis* |
| SBP00085 | Carrot - yellow | Bat associated circovirus 4 |
| SBP00085 | Carrot - yellow | *Betaproteobacteria bacterium* GR16-43 |
| SBP00085 | Carrot - yellow | *Beutenbergia cavernae* |
| SBP00085 | Carrot - yellow | *Bifidobacterium longum* |
| SBP00085 | Carrot - yellow | *Blastochloris* sp. GI |
| SBP00085 | Carrot - yellow | *Blastochloris viridis* |
| SBP00085 | Carrot - yellow | *Blastococcus saxobsidens* |
| SBP00085 | Carrot - yellow | *Blastomonas* sp. RAC04 |
| SBP00085 | Carrot - yellow | *Bordetella bronchialis* |
| SBP00085 | Carrot - yellow | *Bordetella bronchiseptica* |
| SBP00085 | Carrot - yellow | *Bordetella flabilis* |
| SBP00085 | Carrot - yellow | *Bordetella genomosp.* 13 |
| SBP00085 | Carrot - yellow | *Bordetella genomosp.* 8 |
| SBP00085 | Carrot - yellow | *Bordetella genomosp.* 9 |
| SBP00085 | Carrot - yellow | *Bordetella hinzii* |
| SBP00085 | Carrot - yellow | *Bordetella petrii* |
| SBP00085 | Carrot - yellow | *Bordetella* sp. H567 |
| SBP00085 | Carrot - yellow | *Bordetella* sp. N |
| SBP00085 | Carrot - yellow | *Bordetella trematum* |
| SBP00085 | Carrot - yellow | *Bosea* sp. AS-1 |
| SBP00085 | Carrot - yellow | *Bosea* sp. PAMC 26642 |
| SBP00085 | Carrot - yellow | *Bosea* sp. RAC05 |
| SBP00085 | Carrot - yellow | *Bosea* sp. Tri-49 |
| SBP00085 | Carrot - yellow | *Bosea vaviloviae* |
| SBP00085 | Carrot - yellow | *Brachybacterium ginsengisoli* |
| SBP00085 | Carrot - yellow | *Brachybacterium* sp. VM2412 |
| SBP00085 | Carrot - yellow | *Bradymonas sediminis* |
| SBP00085 | Carrot - yellow | *Bradyrhizobiaceae bacterium* SG-6C |
| SBP00085 | Carrot - yellow | *Bradyrhizobium diazoefficiens* |
| SBP00085 | Carrot - yellow | *Bradyrhizobium erythrophlei* |
| SBP00085 | Carrot - yellow | *Bradyrhizobium guangdongense* |
| SBP00085 | Carrot - yellow | *Bradyrhizobium guangxiense* |
| SBP00085 | Carrot - yellow | *Bradyrhizobium icense* |
| SBP00085 | Carrot - yellow | *Bradyrhizobium Japonicum* |

TABLE 3-continued

List of species identified in each metagenomic sample of each SBP Sample

| SBP ID | SBP Host Common Name | Genus sp. |
|---|---|---|
| SBP00085 | Carrot - yellow | *Bradyrhizobium lablabi* |
| SBP00085 | Carrot - yellow | *Bradyrhizobium oligotrophicum* |
| SBP00085 | Carrot - yellow | *Bradyrhizobium ottawaense* |
| SBP00085 | Carrot - yellow | *Bradyrhizobium* sp. 2 3951MB |
| SBP00085 | Carrot - yellow | *Bradyrhizobium* sp. BTAi1 |
| SBP00085 | Carrot - yellow | *Bradyrhizobium* sp. CCBAU 51670 |
| SBP00085 | Carrot - yellow | *Bradyrhizobium* sp. CCBAU 51778 |
| SBP00085 | Carrot - yellow | *Bradyrhizobium* sp. CCGE-LA001 |
| SBP00085 | Carrot - yellow | *Bradyrhizobium* sp. ORS 278 |
| SBP00085 | Carrot - yellow | *Bradyrhizobium* sp. ORS 285 |
| SBP00085 | Carrot - yellow | *Bradyrhizobium* sp. ORS 3257 |
| SBP00085 | Carrot - yellow | *Bradyrhizobium* sp. S23321 |
| SBP00085 | Carrot - yellow | *Bradyrhizobium* sp. SK17 |
| SBP00085 | Carrot - yellow | *Breoghania* sp. L-A4 |
| SBP00085 | Carrot - yellow | *Brevibacterium linens* |
| SBP00085 | Carrot - yellow | *Brevundimonas diminuta* |
| SBP00085 | Carrot - yellow | *Brevundimonas naejangsanensis* |
| SBP00085 | Carrot - yellow | *Brevundimonas* sp. DS20 |
| SBP00085 | Carrot - yellow | *Brevundimonas* sp. GW460-12-10-14-LB2 |
| SBP00085 | Carrot - yellow | *Brevundimonas* sp. LM2 |
| SBP00085 | Carrot - yellow | *Brevundimonas subvibrioides* |
| SBP00085 | Carrot - yellow | *Brevundimonas vancanneytii* |
| SBP00085 | Carrot - yellow | *Brevundimonas vesicularis* |
| SBP00085 | Carrot - yellow | *Buchnera aphidicola* |
| SBP00085 | Carrot - yellow | *Burkholderia ambifaria* |
| SBP00085 | Carrot - yellow | *Burkholderia cenocepacia* |
| SBP00085 | Carrot - yellow | *Burkholderia cepacia* |
| SBP00085 | Carrot - yellow | *Burkholderia contaminans* |
| SBP00085 | Carrot - yellow | *Burkholderia gladioli* |
| SBP00085 | Carrot - yellow | *Burkholderia glumae* |
| SBP00085 | Carrot - yellow | *Burkholderia insecticola* |
| SBP00085 | Carrot - yellow | *Burkholderia lata* |
| SBP00085 | Carrot - yellow | *Burkholderia metallica* |
| SBP00085 | Carrot - yellow | *Burkholderia multivorans* |
| SBP00085 | Carrot - yellow | *Burkholderia plantarii* |
| SBP00085 | Carrot - yellow | *Burkholderia pseudomallei* |
| SBP00085 | Carrot - yellow | *Burkholderia* sp. AD24 |
| SBP00085 | Carrot - yellow | *Burkholderia* sp. CCGE1002 |
| SBP00085 | Carrot - yellow | *Burkholderia* sp. CCGE1003 |
| SBP00085 | Carrot - yellow | *Burkholderia* sp. IDO3 |
| SBP00085 | Carrot - yellow | *Burkholderia* sp. KJ006 |
| SBP00085 | Carrot - yellow | *Burkholderia stabilis* |
| SBP00085 | Carrot - yellow | *Burkholderia stagnalis* |
| SBP00085 | Carrot - yellow | *Burkholderia territorii* |
| SBP00085 | Carrot - yellow | *Burkholderia thailandensis* |
| SBP00085 | Carrot - yellow | *Burkholderia ubonensis* |
| SBP00085 | Carrot - yellow | *Burkholderiales bacterium* GJ-E10 |
| SBP00085 | Carrot - yellow | *Burkholderiales bacterium* JOSHI_001 |
| SBP00085 | Carrot - yellow | *Burkholderiales bacterium* YL45 |
| SBP00085 | Carrot - yellow | *Calothrix parasitica* |
| SBP00085 | Carrot - yellow | *Calothrix* sp. 336/3 |
| SBP00085 | Carrot - yellow | *Campylobacter jejuni* |
| SBP00085 | Carrot - yellow | *Campylobacter lari* |
| SBP00085 | Carrot - yellow | *Campylobacter pinnipediorum* |
| SBP00085 | Carrot - yellow | *Candidatus Accumulibacter phosphatis* |
| SBP00085 | Carrot - yellow | *Candidatus Arthromitus* sp. SFB-rat-Yit |
| SBP00085 | Carrot - yellow | *Candidatus Koribacter versatilis* |
| SBP00085 | Carrot - yellow | *Candidatus Promineofilum breve* |
| SBP00085 | Carrot - yellow | *Candidatus Saccharimonas aalborgensis* |
| SBP00085 | Carrot - yellow | *Candidatus Solibacter usitatus* |
| SBP00085 | Carrot - yellow | *Candidatus Symbiobacter mobilis* |
| SBP00085 | Carrot - yellow | *Candidatus Thiodictyon syntrophicum* |
| SBP00085 | Carrot - yellow | *Carboxydocella thermautotrophica* |
| SBP00085 | Carrot - yellow | Carnation etched ring virus |
| SBP00085 | Carrot - yellow | *Castellaniella defragrans* |
| SBP00085 | Carrot - yellow | *Catenulispora acidiphila* |
| SBP00085 | Carrot - yellow | *Caulobacter flavus* |
| SBP00085 | Carrot - yellow | *Caulobacter henricii* |
| SBP00085 | Carrot - yellow | *Caulobacter mirabilis* |
| SBP00085 | Carrot - yellow | *Caulobacter segnis* |
| SBP00085 | Carrot - yellow | *Caulobacter* sp. FWC26 |
| SBP00085 | Carrot - yellow | *Caulobacter* sp. K31 |
| SBP00085 | Carrot - yellow | *Caulobacter vibrioides* |
| SBP00085 | Carrot - yellow | *Caulobacteraceae bacterium* OTS2_A_272 |
| SBP00085 | Carrot - yellow | *Celeribacter indicus* |
| SBP00085 | Carrot - yellow | *Celeribacter manganoxidans* |

TABLE 3-continued

List of species identified in each metagenomic sample of each SBP Sample

| SBP ID | SBP Host Common Name | Genus sp. |
|---|---|---|
| SBP00085 | Carrot - yellow | *Cellulomonas fimi* |
| SBP00085 | Carrot - yellow | *Cellulomonas flavigena* |
| SBP00085 | Carrot - yellow | *Cellulomonas* sp. PSBB021 |
| SBP00085 | Carrot - yellow | *Cellulosimicrobium cellulans* |
| SBP00085 | Carrot - yellow | *Cellulosimicrobium* sp. TH-20 |
| SBP00085 | Carrot - yellow | *Cellvibrio* sp. PSBB006 |
| SBP00085 | Carrot - yellow | *Chelativorans* sp. BNC1 |
| SBP00085 | Carrot - yellow | *Chelatococcus daeguensis* |
| SBP00085 | Carrot - yellow | *Chelatococcus* sp. CO-6 |
| SBP00085 | Carrot - yellow | *Chitinophaga pinensis* |
| SBP00085 | Carrot - yellow | *Chondromyces crocatus* |
| SBP00085 | Carrot - yellow | *Chromobacterium rhizoryzae* |
| SBP00085 | Carrot - yellow | *Chromobacterium* sp. ATCC 53434 |
| SBP00085 | Carrot - yellow | *Chromobacterium vaccinii* |
| SBP00085 | Carrot - yellow | *Chromobacterium violaceum* |
| SBP00085 | Carrot - yellow | *Chromohalobacter salexigens* |
| SBP00085 | Carrot - yellow | *Chryseobacterium antarcticum* |
| SBP00085 | Carrot - yellow | *Chryseobacterium balustinum* |
| SBP00085 | Carrot - yellow | *Chryseobacterium bernardetii* |
| SBP00085 | Carrot - yellow | *Chryseobacterium gleum* |
| SBP00085 | Carrot - yellow | *Chryseobacterium indologenes* |
| SBP00085 | Carrot - yellow | *Chryseobacterium indoltheticum* |
| SBP00085 | Carrot - yellow | *Chryseobacterium shandongense* |
| SBP00085 | Carrot - yellow | *Chryseobacterium* sp. 1751E7 |
| SBP00085 | Carrot - yellow | *Chryseobacterium* sp. 3008163 |
| SBP00085 | Carrot - yellow | *Chryseobacterium* sp. 6424 |
| SBP00085 | Carrot - yellow | *Chryseobacterium* sp. IHB B 17019 |
| SBP00085 | Carrot - yellow | *Chryseolinea* sp. KIS68-18 |
| SBP00085 | Carrot - yellow | *Chrysochromulina ericina virus* |
| SBP00085 | Carrot - yellow | *Citromicrobium* sp. JL477 |
| SBP00085 | Carrot - yellow | *Clavibacter michiganensis* |
| SBP00085 | Carrot - yellow | *Clostridium beijerinckii* |
| SBP00085 | Carrot - yellow | *Clostridium botulinum* |
| SBP00085 | Carrot - yellow | *Clostridium butyricum* |
| SBP00085 | Carrot - yellow | *Clostridium carboxidivorans* |
| SBP00085 | Carrot - yellow | *Clostridium kluyveri* |
| SBP00085 | Carrot - yellow | *Clostridium novyi* |
| SBP00085 | Carrot - yellow | *Clostridium perfringens* |
| SBP00085 | Carrot - yellow | *Clostridium* sp. BNL1100 |
| SBP00085 | Carrot - yellow | *Clostridium* sp. CT4 |
| SBP00085 | Carrot - yellow | *Collimonas arenae* |
| SBP00085 | Carrot - yellow | *Collimonas fungivorans* |
| SBP00085 | Carrot - yellow | *Collimonas pratensis* |
| SBP00085 | Carrot - yellow | *Comamonas aquatica* |
| SBP00085 | Carrot - yellow | *Comamonas serinivorans* |
| SBP00085 | Carrot - yellow | *Comamonas terrigena* |
| SBP00085 | Carrot - yellow | *Comamonas testosteroni* |
| SBP00085 | Carrot - yellow | *Conexibacter woesei* |
| SBP00085 | Carrot - yellow | *Confluentimicrobium* sp. EMB200-NS6 |
| SBP00085 | Carrot - yellow | *Corallococcus coralloides* |
| SBP00085 | Carrot - yellow | *Corynebacterium jeikeium* |
| SBP00085 | Carrot - yellow | *Corynebacterium mycetoides* |
| SBP00085 | Carrot - yellow | *Corynebacterium* sp. NM198-0116 |
| SBP00085 | Carrot - yellow | *Corynebacterium xerosis* |
| SBP00085 | Carrot - yellow | *Crenobacter* sp. K1W11S-77 |
| SBP00085 | Carrot - yellow | *Croceicoccus marinus* |
| SBP00085 | Carrot - yellow | *Croceicoccus naphthovorans* |
| SBP00085 | Carrot - yellow | *Cryobacterium* sp. LW097 |
| SBP00085 | Carrot - yellow | *Cupriavidus basilensis* |
| SBP00085 | Carrot - yellow | *Cupriavidus gilardii* |
| SBP00085 | Carrot - yellow | *Cupriavidus metallidurans* |
| SBP00085 | Carrot - yellow | *Cupriavidus necator* |
| SBP00085 | Carrot - yellow | *Cupriavidus oxalaticus* |
| SBP00085 | Carrot - yellow | *Cupriavidus pauculus* |
| SBP00085 | Carrot - yellow | *Cupriavidus pinatubonensis* |
| SBP00085 | Carrot - yellow | *Cupriavidus taiwanensis* |
| SBP00085 | Carrot - yellow | *Curtobacterium pusillum* |
| SBP00085 | Carrot - yellow | *Curvibacter* sp. AEP1-3 |
| SBP00085 | Carrot - yellow | *Cutibacterium acnes* |
| SBP00085 | Carrot - yellow | *cyanobacterium* endosymbiont of *Rhopalodia gibberula* |
| SBP00085 | Carrot - yellow | *Cyanothece* sp. PCC 7424 |
| SBP00085 | Carrot - yellow | *Cystobacter fuscus* |
| SBP00085 | Carrot - yellow | *Dechloromonas* sp. HYN0024 |
| SBP00085 | Carrot - yellow | *Defluviimonas alba* |
| SBP00085 | Carrot - yellow | *Deinococcus actinosclerus* |
| SBP00085 | Carrot - yellow | *Deinococcus ficus* |

TABLE 3-continued

List of species identified in each metagenomic sample of each SBP Sample

| SBP ID | SBP Host Common Name | Genus sp. |
|---|---|---|
| SBP00085 | Carrot - yellow | *Deinococcus maricopensis* |
| SBP00085 | Carrot - yellow | *Delftia* sp. |
| SBP00085 | Carrot - yellow | *Delftia tsuruhatensis* |
| SBP00085 | Carrot - yellow | *Dermacoccus nishinomiyaensis* |
| SBP00085 | Carrot - yellow | *Desulfitobacterium hafniense* |
| SBP00085 | Carrot - yellow | *Desulfotomaculum ruminis* |
| SBP00085 | Carrot - yellow | *Desulfovibrio africanus* |
| SBP00085 | Carrot - yellow | *Desulfovibrio desulfuricans* |
| SBP00085 | Carrot - yellow | *Desulfovibrio piger* |
| SBP00085 | Carrot - yellow | *Desulfovibrio* sp. FW1012B |
| SBP00085 | Carrot - yellow | *Desulfovibrio vulgaris* |
| SBP00085 | Carrot - yellow | *Devosia* sp. 1566 |
| SBP00085 | Carrot - yellow | *Devosia* sp. A16 |
| SBP00085 | Carrot - yellow | *Devosia* sp. H5989 |
| SBP00085 | Carrot - yellow | *Devosia* sp. I507 |
| SBP00085 | Carrot - yellow | *Dickeya fangzhongdai* |
| SBP00085 | Carrot - yellow | *Dickeya zeae* |
| SBP00085 | Carrot - yellow | *Dietzia psychralcaliphila* |
| SBP00085 | Carrot - yellow | *Diolcogaster facetosa bracovirus* |
| SBP00085 | Carrot - yellow | *Dokdonella koreensis* |
| SBP00085 | Carrot - yellow | *Dyadobacter fermentans* |
| SBP00085 | Carrot - yellow | *Dyella japonica* |
| SBP00085 | Carrot - yellow | *Dyella thiooxydans* |
| SBP00085 | Carrot - yellow | *Echinicola rosea* |
| SBP00085 | Carrot - yellow | *Egibacter rhizosphaerae* |
| SBP00085 | Carrot - yellow | *Egicoccus halophilus* |
| SBP00085 | Carrot - yellow | *Elephantid* betaherpesvirus 1 |
| SBP00085 | Carrot - yellow | *Endomicrobium proavitum* |
| SBP00085 | Carrot - yellow | endosymbiont of unidentified scaly snail isolate Monju |
| SBP00085 | Carrot - yellow | *Ensifer adhaerens* |
| SBP00085 | Carrot - yellow | *Ensifer sojae* |
| SBP00085 | Carrot - yellow | *Enterobacter bugandensis* |
| SBP00085 | Carrot - yellow | *Enterobacter cloacae* |
| SBP00085 | Carrot - yellow | *Enterobacter ludwigii* |
| SBP00085 | Carrot - yellow | *Enterococcus faecalis* |
| SBP00085 | Carrot - yellow | *Enterococcus gilvus* |
| SBP00085 | Carrot - yellow | *Equid gammaherpesvirus* 5 |
| SBP00085 | Carrot - yellow | *Ereboglobus luteus* |
| SBP00085 | Carrot - yellow | *Erythrobacter atlanticus* |
| SBP00085 | Carrot - yellow | *Erythrobacter flavus* |
| SBP00085 | Carrot - yellow | *Erythrobacter gangjinensis* |
| SBP00085 | Carrot - yellow | *Erythrobacter litoralis* |
| SBP00085 | Carrot - yellow | *Erythrobacter seohaensis* |
| SBP00085 | Carrot - yellow | *Erythrobacter* sp. HKB08 |
| SBP00085 | Carrot - yellow | *Erythrobacter* sp. HL-111 |
| SBP00085 | Carrot - yellow | *Erythrobacter* sp. KY5 |
| SBP00085 | Carrot - yellow | *Erythrobacter* sp. YH-07 |
| SBP00085 | Carrot - yellow | *Escherichia coli* |
| SBP00085 | Carrot - yellow | *Eubacterium callanderi* |
| SBP00085 | Carrot - yellow | *Euzebya* sp. DY32-46 |
| SBP00085 | Carrot - yellow | *Faecalitalea cylindroides* |
| SBP00085 | Carrot - yellow | *Figwort mosaic virus* |
| SBP00085 | Carrot - yellow | *Fimbriimonas ginsengisoli* |
| SBP00085 | Carrot - yellow | *Fischerella* sp. NIES-4106 |
| SBP00085 | Carrot - yellow | *Flammeovirga* sp. L12M1 |
| SBP00085 | Carrot - yellow | *Flavisolibacter* sp. 17J28-1 |
| SBP00085 | Carrot - yellow | *Flavisolibacter tropicus* |
| SBP00085 | Carrot - yellow | *Flavobacterium album* |
| SBP00085 | Carrot - yellow | *Flavobacterium anhuiense* |
| SBP00085 | Carrot - yellow | *Flavobacterium commune* |
| SBP00085 | Carrot - yellow | *Flavobacterium crassostreae* |
| SBP00085 | Carrot - yellow | *Flavobacterium faecale* |
| SBP00085 | Carrot - yellow | *Flavobacterium indicum* |
| SBP00085 | Carrot - yellow | *Flavobacterium johnsoniae* |
| SBP00085 | Carrot - yellow | *Flavobacterium pallidum* |
| SBP00085 | Carrot - yellow | *Flavobacterium* sp. 140616W15 |
| SBP00085 | Carrot - yellow | *Flavobacterium* sp. CJ74 |
| SBP00085 | Carrot - yellow | *Flavobacterium* sp. HYN0086 |
| SBP00085 | Carrot - yellow | *Francisella* sp. TX077310 |
| SBP00085 | Carrot - yellow | *Francisella tularensis* |
| SBP00085 | Carrot - yellow | *Frankia alni* |
| SBP00085 | Carrot - yellow | *Frankia casuarinae* |
| SBP00085 | Carrot - yellow | *Frankia inefficax* |
| SBP00085 | Carrot - yellow | *Frankia* sp. EAN1pec |
| SBP00085 | Carrot - yellow | *Frankia* sp. QA3 |
| SBP00085 | Carrot - yellow | *Frankia* symbiont of *Datisca glomerata* |

TABLE 3-continued

List of species identified in each metagenomic sample of each SBP Sample

| SBP ID | SBP Host Common Name | Genus sp. |
|---|---|---|
| SBP00085 | Carrot - yellow | *Frateuria aurantia* |
| SBP00085 | Carrot - yellow | *Friedmanniella luteola* |
| SBP00085 | Carrot - yellow | *Friedmanniella sagamiharensis* |
| SBP00085 | Carrot - yellow | *Frischella perrara* |
| SBP00085 | Carrot - yellow | *Frondihabitans* sp. 762G35 |
| SBP00085 | Carrot - yellow | *Frondihabitans* sp. PAMC 28766 |
| SBP00085 | Carrot - yellow | *Fuerstia marisgermanicae* |
| SBP00085 | Carrot - yellow | *Fusobacterium mortiferum* |
| SBP00085 | Carrot - yellow | *Gallionella capsiferriformans* |
| SBP00085 | Carrot - yellow | *Gardnerella vaginalis* |
| SBP00085 | Carrot - yellow | *Gemmata obscuriglobus* |
| SBP00085 | Carrot - yellow | *Gemmata* sp. SH-PL17 |
| SBP00085 | Carrot - yellow | *Gemmatirosa kalamazoonesis* |
| SBP00085 | Carrot - yellow | *Gemmobacter* sp. HYN0069 |
| SBP00085 | Carrot - yellow | *Geobacter* sp. DSM 9736 |
| SBP00085 | Carrot - yellow | *Geobacter* sp. M18 |
| SBP00085 | Carrot - yellow | *Geobacter* sp. M21 |
| SBP00085 | Carrot - yellow | *Geobacter sulfurreducens* |
| SBP00085 | Carrot - yellow | *Geodermatophilus obscurus* |
| SBP00085 | Carrot - yellow | *Georgenia* sp. ZLI0423 |
| SBP00085 | Carrot - yellow | *Glaciecola* sp. THG-3.7 |
| SBP00085 | Carrot - yellow | *Gluconobacter oxydans* |
| SBP00085 | Carrot - yellow | *Glycocaulis alkaliphilus* |
| SBP00085 | Carrot - yellow | *Gordonia bronchialis* |
| SBP00085 | Carrot - yellow | *Gordonia iterans* |
| SBP00085 | Carrot - yellow | *Gordonia polyisoprenivorans* |
| SBP00085 | Carrot - yellow | *Gordonia* sp. KTR9 |
| SBP00085 | Carrot - yellow | *Gordonia* sp. MMS17-SY073 |
| SBP00085 | Carrot - yellow | *Granulibacter bethesdensis* |
| SBP00085 | Carrot - yellow | *Gryllotalpicola* sp. 2DFW10M-5 |
| SBP00085 | Carrot - yellow | *Haliangium ochraceum* |
| SBP00085 | Carrot - yellow | *Halioglobus pacificus* |
| SBP00085 | Carrot - yellow | *Halobacteriovorax* sp. BALOs_7 |
| SBP00085 | Carrot - yellow | *Halobacterium* sp. DL1 |
| SBP00085 | Carrot - yellow | *Halobiforma lacisalsi* |
| SBP00085 | Carrot - yellow | *Halomonas beimenensis* |
| SBP00085 | Carrot - yellow | *Halomonas* sp. 1513 |
| SBP00085 | Carrot - yellow | *Halomonas* sp. JS92-SW72 |
| SBP00085 | Carrot - yellow | *Halomonas* sp. SF2003 |
| SBP00085 | Carrot - yellow | *Halorhodospira halophila* |
| SBP00085 | Carrot - yellow | *Halorientalis* sp. IM1011 |
| SBP00085 | Carrot - yellow | *Halorubrum ezzemoulense* |
| SBP00085 | Carrot - yellow | *Halotalea alkalilenta* |
| SBP00085 | Carrot - yellow | *Halothiobacillus* sp. LS2 |
| SBP00085 | Carrot - yellow | *Hartmannibacter diazotrophicus* |
| SBP00085 | Carrot - yellow | *Helicobacter pylori* |
| SBP00085 | Carrot - yellow | *Herbaspirillum hiltneri* |
| SBP00085 | Carrot - yellow | *Herbaspirillum huttiense* |
| SBP00085 | Carrot - yellow | *Herbaspirillum robiniae* |
| SBP00085 | Carrot - yellow | *Herbaspirillum rubrisubalbicans* |
| SBP00085 | Carrot - yellow | *Herbaspirillum seropedicae* |
| SBP00085 | Carrot - yellow | *Herbaspirillum* sp. meg3 |
| SBP00085 | Carrot - yellow | *Hoeflea phototrophica* |
| SBP00085 | Carrot - yellow | *Hoeflea* sp. IMCC20628 |
| SBP00085 | Carrot - yellow | *Hoyosella subflava* |
| SBP00085 | Carrot - yellow | *Hydrogenophaga crassostreae* |
| SBP00085 | Carrot - yellow | *Hydrogenophaga pseudoflava* |
| SBP00085 | Carrot - yellow | *Hydrogenophaga* sp. NH-16 |
| SBP00085 | Carrot - yellow | *Hydrogenophaga* sp. PBC |
| SBP00085 | Carrot - yellow | *Hydrogenophaga* sp. RAC07 |
| SBP00085 | Carrot - yellow | *Hydrogenophilus thermoluteolus* |
| SBP00085 | Carrot - yellow | *Hydrogenovibrio crunogenus* |
| SBP00085 | Carrot - yellow | *Hylemonella gracilis* |
| SBP00085 | Carrot - yellow | *Hymenobacter sedentarius* |
| SBP00085 | Carrot - yellow | *Hymenobacter* sp. PAMC 26554 |
| SBP00085 | Carrot - yellow | *Hyphomicrobium denitrificans* |
| SBP00085 | Carrot - yellow | *Hyphomicrobium nitrativorans* |
| SBP00085 | Carrot - yellow | *Hyphomicrobium* sp. MC1 |
| SBP00085 | Carrot - yellow | *Hyphomonas* sp. CACIAM 19H1 |
| SBP00085 | Carrot - yellow | *Immundisolibacter cernigliae* |
| SBP00085 | Carrot - yellow | *Indioceanicola profundi* |
| SBP00085 | Carrot - yellow | *Inhella inkyongensis* |
| SBP00085 | Carrot - yellow | *Intrasporangium calvum* |
| SBP00085 | Carrot - yellow | *Isoptericola dokdonensis* |
| SBP00085 | Carrot - yellow | *Isoptericola variabilis* |
| SBP00085 | Carrot - yellow | *Isosphaera pallida* |

TABLE 3-continued

List of species identified in each metagenomic sample of each SBP Sample

| SBP ID | SBP Host Common Name | Genus sp. |
|---|---|---|
| SBP00085 | Carrot - yellow | *Janibacter indicus* |
| SBP00085 | Carrot - yellow | *Janibacter limosus* |
| SBP00085 | Carrot - yellow | *Janthinobacterium agaricidamnosum* |
| SBP00085 | Carrot - yellow | *Janthinobacterium* sp. 1_2014MBL_MicDiv |
| SBP00085 | Carrot - yellow | *Janthinobacterium* sp. 17J80-10 |
| SBP00085 | Carrot - yellow | *Janthinobacterium* sp. LM6 |
| SBP00085 | Carrot - yellow | *Janthinobacterium* sp. Marseille |
| SBP00085 | Carrot - yellow | *Janthinobacterium svalbardensis* |
| SBP00085 | Carrot - yellow | *Jiangella alkaliphila* |
| SBP00085 | Carrot - yellow | *Jiangella* sp. DSM 45060 |
| SBP00085 | Carrot - yellow | *Kibdelosporangium phytohabitans* |
| SBP00085 | Carrot - yellow | *Kineococcus radiotolerans* |
| SBP00085 | Carrot - yellow | *Kitasatospora aureofaciens* |
| SBP00085 | Carrot - yellow | *Kitasatospora setae* |
| SBP00085 | Carrot - yellow | *Kitasatospora* sp. MMS16-BH015 |
| SBP00085 | Carrot - yellow | *Klebsiella pneumoniae* |
| SBP00085 | Carrot - yellow | *Kluyvera intermedia* |
| SBP00085 | Carrot - yellow | *Kocuria flava* |
| SBP00085 | Carrot - yellow | *Kocuria rosea* |
| SBP00085 | Carrot - yellow | *Kribbella flavida* |
| SBP00085 | Carrot - yellow | *Kutzneria albida* |
| SBP00085 | Carrot - yellow | *Labrenzia* sp. VG12 |
| SBP00085 | Carrot - yellow | *Lactobacillus crispatus* |
| SBP00085 | Carrot - yellow | *Lactobacillus ginsenosidimutans* |
| SBP00085 | Carrot - yellow | *Lactobacillus koreensis* |
| SBP00085 | Carrot - yellow | *Lactobacillus paraplantarum* |
| SBP00085 | Carrot - yellow | *Lactobacillus pentosus* |
| SBP00085 | Carrot - yellow | *Lactobacillus plantarum* |
| SBP00085 | Carrot - yellow | *Lactobacillus sakei* |
| SBP00085 | Carrot - yellow | *Lactobacillus salivarius* |
| SBP00085 | Carrot - yellow | *Lactococcus lactis* |
| SBP00085 | Carrot - yellow | *Lactococcus piscium* |
| SBP00085 | Carrot - yellow | *Lacunisphaera limnophila* |
| SBP00085 | Carrot - yellow | *Lautropia mirabilis* |
| SBP00085 | Carrot - yellow | *Leclercia adecarboxylata* |
| SBP00085 | Carrot - yellow | *Legionella pneumophila* |
| SBP00085 | Carrot - yellow | *Leifsonia* sp. 21MFCrub1.1 |
| SBP00085 | Carrot - yellow | *Leifsonia xyli* |
| SBP00085 | Carrot - yellow | *Leisingera aquaemixtae* |
| SBP00085 | Carrot - yellow | *Leisingera methylohalidivorans* |
| SBP00085 | Carrot - yellow | *Lelliottia amnigena* |
| SBP00085 | Carrot - yellow | *Lentibacillus amyloliquefaciens* |
| SBP00085 | Carrot - yellow | *Lentzea guizhouensis* |
| SBP00085 | Carrot - yellow | *Leptothrix cholodnii* |
| SBP00085 | Carrot - yellow | *Leucobacter* sp. DSM 101948 |
| SBP00085 | Carrot - yellow | *Leuconostoc carnosum* |
| SBP00085 | Carrot - yellow | *Leuconostoc mesenteroides* |
| SBP00085 | Carrot - yellow | *Limnobaculum parvum* |
| SBP00085 | Carrot - yellow | *Limnochorda pilosa* |
| SBP00085 | Carrot - yellow | *Limnohabitans* sp. 63ED37-2 |
| SBP00085 | Carrot - yellow | *Litorilituus sediminis* |
| SBP00085 | Carrot - yellow | *Luteibacter rhizovicinus* |
| SBP00085 | Carrot - yellow | *Luteimonas* sp. 100111 |
| SBP00085 | Carrot - yellow | *Luteimonas* sp. 83-4 |
| SBP00085 | Carrot - yellow | *Luteimonas* sp. JM171 |
| SBP00085 | Carrot - yellow | *Luteipulveratus mongoliensis* |
| SBP00085 | Carrot - yellow | *Luteitalea pratensis* |
| SBP00085 | Carrot - yellow | *Lysinibacillus sphaericus* |
| SBP00085 | Carrot - yellow | *Lysinimonas* sp. 2DFWR-13 |
| SBP00085 | Carrot - yellow | *Lysobacter antibioticus* |
| SBP00085 | Carrot - yellow | *Lysobacter capsici* |
| SBP00085 | Carrot - yellow | *Lysobacter enzymogenes* |
| SBP00085 | Carrot - yellow | *Lysobacter gummosus* |
| SBP00085 | Carrot - yellow | *Lysobacter maris* |
| SBP00085 | Carrot - yellow | *Lysobacter* sp. TY2-98 |
| SBP00085 | Carrot - yellow | *Magnetospirillum gryphiswaldense* |
| SBP00085 | Carrot - yellow | *Magnetospirillum magneticum* |
| SBP00085 | Carrot - yellow | *Magnetospirillum* sp. ME-1 |
| SBP00085 | Carrot - yellow | *Magnetospirillum* sp. XM-1 |
| SBP00085 | Carrot - yellow | *Maricaulis maris* |
| SBP00085 | Carrot - yellow | *Marichromatium purpuratum* |
| SBP00085 | Carrot - yellow | *Mariniflexile* sp. TRM1-10 |
| SBP00085 | Carrot - yellow | *Marinobacterium aestuarii* |
| SBP00085 | Carrot - yellow | *Marinovum algicola* |
| SBP00085 | Carrot - yellow | *Marmoricola scoriae* |
| SBP00085 | Carrot - yellow | *Martelella endophytica* |

TABLE 3-continued

List of species identified in each metagenomic sample of each SBP Sample

| SBP ID | SBP Host Common Name | Genus sp. |
|---|---|---|
| SBP00085 | Carrot - yellow | *Martelella mediterranea* |
| SBP00085 | Carrot - yellow | *Martelella* sp. AD-3 |
| SBP00085 | Carrot - yellow | *Massilia albidiflava* |
| SBP00085 | Carrot - yellow | *Massilia armeniaca* |
| SBP00085 | Carrot - yellow | *Massilia lutea* |
| SBP00085 | Carrot - yellow | *Massilia oculi* |
| SBP00085 | Carrot - yellow | *Massilia plicata* |
| SBP00085 | Carrot - yellow | *Massilia putida* |
| SBP00085 | Carrot - yellow | *Massilia* sp. NR 4-1 |
| SBP00085 | Carrot - yellow | *Massilia* sp. WGS |
| SBP00085 | Carrot - yellow | *Massilia* sp. YMA4 |
| SBP00085 | Carrot - yellow | *Massilia umbonata* |
| SBP00085 | Carrot - yellow | *Massilia violaceinigra* |
| SBP00085 | Carrot - yellow | *Melaminivora* sp. SC2-7 |
| SBP00085 | Carrot - yellow | *Melaminivora* sp. SC2-9 |
| SBP00085 | Carrot - yellow | *Melittangium boletus* |
| SBP00085 | Carrot - yellow | *Mesorhizobium amorphae* |
| SBP00085 | Carrot - yellow | *Mesorhizobium australicum* |
| SBP00085 | Carrot - yellow | *Mesorhizobium ciceri* |
| SBP00085 | Carrot - yellow | *Mesorhizobium japonicum* |
| SBP00085 | Carrot - yellow | *Mesorhizobium loti* |
| SBP00085 | Carrot - yellow | *Mesorhizobium oceanicum* |
| SBP00085 | Carrot - yellow | *Mesorhizobium opportunistum* |
| SBP00085 | Carrot - yellow | *Mesorhizobium* sp. DCY119 |
| SBP00085 | Carrot - yellow | *Mesorhizobium* sp. M1B.F.Ca.ET.045.04.1.1 |
| SBP00085 | Carrot - yellow | *Mesorhizobium* sp. M1D.F.Ca.ET.043.01.1.1 |
| SBP00085 | Carrot - yellow | *Mesorhizobium* sp. M1E.F.Ca.ET.045.02.1.1 |
| SBP00085 | Carrot - yellow | *Mesorhizobium* sp. M2A.F.Ca.ET.043.02.1.1 |
| SBP00085 | Carrot - yellow | *Mesorhizobium* sp. M2A.F.Ca.ET.043.05.1.1 |
| SBP00085 | Carrot - yellow | *Mesorhizobium* sp. M3A.F.Ca.ET.080.04.2.1 |
| SBP00085 | Carrot - yellow | *Mesorhizobium* sp. M4B.F.Ca.ET.058.02.1.1 |
| SBP00085 | Carrot - yellow | *Mesorhizobium* sp. M6A.T.Cr.TU.016.01.1.1 |
| SBP00085 | Carrot - yellow | *Mesorhizobium* sp. M7A.F.Ce.TU.012.03.2.1 |
| SBP00085 | Carrot - yellow | *Mesorhizobium* sp. M7D.F.Ca.US.005.01.1.1 |
| SBP00085 | Carrot - yellow | *Mesorhizobium* sp. M9A.F.Ca.ET.002.03.1.2 |
| SBP00085 | Carrot - yellow | *Methanobacterium paludis* |
| SBP00085 | Carrot - yellow | *Methanobrevibacter olleyae* |
| SBP00085 | Carrot - yellow | *Methanobrevibacter* sp. YE315 |
| SBP00085 | Carrot - yellow | *Methanococcoides methylutens* |
| SBP00085 | Carrot - yellow | *Methanococcus maripaludis* |
| SBP00085 | Carrot - yellow | *Methanosarcina mazei* |
| SBP00085 | Carrot - yellow | *Methylibium petroleiphilum* |
| SBP00085 | Carrot - yellow | *Methylobacillus flagellatus* |
| SBP00085 | Carrot - yellow | *Methylobacterium aquaticum* |
| SBP00085 | Carrot - yellow | *Methylobacterium brachiatum* |
| SBP00085 | Carrot - yellow | *Methylobacterium currus* |
| SBP00085 | Carrot - yellow | *Methylobacterium nodulans* |
| SBP00085 | Carrot - yellow | *Methylobacterium* sp. 17SD2-17 |
| SBP00085 | Carrot - yellow | *Methylobacterium* sp. 17Sr1-1 |
| SBP00085 | Carrot - yellow | *Methylobacterium* sp. 17Sr1-28 |
| SBP00085 | Carrot - yellow | *Methylobacterium* sp. 17Sr1-43 |
| SBP00085 | Carrot - yellow | *Methylobacterium* sp. 4-46 |
| SBP00085 | Carrot - yellow | *Methylobacterium* sp. AMS5 |
| SBP00085 | Carrot - yellow | *Methylobacterium* sp. DM1 |
| SBP00085 | Carrot - yellow | *Methylocella silvestris* |
| SBP00085 | Carrot - yellow | *Methylococcus capsulatus* |
| SBP00085 | Carrot - yellow | *Methylocystis rosea* |
| SBP00085 | Carrot - yellow | *Methylomonas clara* |
| SBP00085 | Carrot - yellow | *Methylophilus* sp. TWE2 |
| SBP00085 | Carrot - yellow | *Methylorubrum extorquens* |
| SBP00085 | Carrot - yellow | *Methylorubrum populi* |
| SBP00085 | Carrot - yellow | *Methylosinus trichosporium* |
| SBP00085 | Carrot - yellow | *Methylotenera versatilis* |
| SBP00085 | Carrot - yellow | *Methyloversatilis* sp. RAC08 |
| SBP00085 | Carrot - yellow | *Methylovorus glucosotrophus* |
| SBP00085 | Carrot - yellow | *Methylovorus* sp. MP688 |
| SBP00085 | Carrot - yellow | *Methylovulum psychrotolerans* |
| SBP00085 | Carrot - yellow | *Micavibrio aeruginosavorus* |
| SBP00085 | Carrot - yellow | *Microbacterium aurum* |
| SBP00085 | Carrot - yellow | *Microbacterium foliorum* |
| SBP00085 | Carrot - yellow | *Microbacterium hominis* |
| SBP00085 | Carrot - yellow | *Microbacterium lemovicicum* |
| SBP00085 | Carrot - yellow | *Microbacterium oleivorans* |
| SBP00085 | Carrot - yellow | *Microbacterium oxydans* |
| SBP00085 | Carrot - yellow | *Microbacterium pygmaeum* |
| SBP00085 | Carrot - yellow | *Microbacterium sediminis* |

TABLE 3-continued

List of species identified in each metagenomic sample of each SBP Sample

| SBP ID | SBP Host Common Name | Genus sp. |
|---|---|---|
| SBP00085 | Carrot - yellow | *Microbacterium* sp. 10M-3C3 |
| SBP00085 | Carrot - yellow | *Microbacterium* sp. No. 7 |
| SBP00085 | Carrot - yellow | *Microbacterium* sp. PAMC 28756 |
| SBP00085 | Carrot - yellow | *Microbacterium* sp. PM5 |
| SBP00085 | Carrot - yellow | *Microbacterium* sp. TPU 3598 |
| SBP00085 | Carrot - yellow | *Microbacterium* sp. Y-01 |
| SBP00085 | Carrot - yellow | *Microbacterium testaceum* |
| SBP00085 | Carrot - yellow | *Microbulbifer thermotolerans* |
| SBP00085 | Carrot - yellow | *Microcella alkaliphila* |
| SBP00085 | Carrot - yellow | *Micrococcus luteus* |
| SBP00085 | Carrot - yellow | *Microlunatus phosphovorus* |
| SBP00085 | Carrot - yellow | *Microlunatus soli* |
| SBP00085 | Carrot - yellow | *Micromonospora auratinigra* |
| SBP00085 | Carrot - yellow | *Micromonospora coriariae* |
| SBP00085 | Carrot - yellow | *Micromonospora coxensis* |
| SBP00085 | Carrot - yellow | *Micromonospora echinofusca* |
| SBP00085 | Carrot - yellow | *Micromonospora echinospora* |
| SBP00085 | Carrot - yellow | *Micromonospora krabiensis* |
| SBP00085 | Carrot - yellow | *Micromonospora purpureochromogenes* |
| SBP00085 | Carrot - yellow | *Micromonospora rifamycinica* |
| SBP00085 | Carrot - yellow | *Micromonospora siamensis* |
| SBP00085 | Carrot - yellow | *Micromonospora* sp. WMMA2032 |
| SBP00085 | Carrot - yellow | *Micromonospora tulbaghiae* |
| SBP00085 | Carrot - yellow | *Micromonospora zamorensis* |
| SBP00085 | Carrot - yellow | *Micropruina glycogenica* |
| SBP00085 | Carrot - yellow | *Microterricola viridarii* |
| SBP00085 | Carrot - yellow | *Microvirga ossetica* |
| SBP00085 | Carrot - yellow | *Microvirga* sp. 17 mud 1-3 |
| SBP00085 | Carrot - yellow | *Mitsuaria* sp. 7 |
| SBP00085 | Carrot - yellow | *Modestobacter marinus* |
| SBP00085 | Carrot - yellow | *Moorea producens* |
| SBP00085 | Carrot - yellow | *Moraxella osloensis* |
| SBP00085 | Carrot - yellow | *Mucinivorans hirudinis* |
| SBP00085 | Carrot - yellow | *Mycobacterium colombiense* |
| SBP00085 | Carrot - yellow | *Mycobacterium dioxanotrophicus* |
| SBP00085 | Carrot - yellow | *Mycobacterium marseillense* |
| SBP00085 | Carrot - yellow | *Mycobacterium paragordonae* |
| SBP00085 | Carrot - yellow | *Mycobacterium* sp. djl-10 |
| SBP00085 | Carrot - yellow | *Mycobacterium* sp. DL90 |
| SBP00085 | Carrot - yellow | *Mycobacterium* sp. JS623 |
| SBP00085 | Carrot - yellow | *Mycobacterium* sp. YC-RL4 |
| SBP00085 | Carrot - yellow | *Mycobacterium tuberculosis* |
| SBP00085 | Carrot - yellow | *Mycolicibacter sinensis* |
| SBP00085 | Carrot - yellow | *Mycolicibacterium aurum* |
| SBP00085 | Carrot - yellow | *Mycolicibacterium chitae* |
| SBP00085 | Carrot - yellow | *Mycolicibacterium chubuense* |
| SBP00085 | Carrot - yellow | *Mycolicibacterium flavescens* |
| SBP00085 | Carrot - yellow | *Mycolicibacterium gilvum* |
| SBP00085 | Carrot - yellow | *Mycolicibacterium hassiacum* |
| SBP00085 | Carrot - yellow | *Mycolicibacterium rutilum* |
| SBP00085 | Carrot - yellow | *Mycolicibacterium vaccae* |
| SBP00085 | Carrot - yellow | *Mycolicibacterium vanbaalenii* |
| SBP00085 | Carrot - yellow | *Mycoplasma hominis* |
| SBP00085 | Carrot - yellow | *Myroides odoratus* |
| SBP00085 | Carrot - yellow | *Myxococcus fulvus* |
| SBP00085 | Carrot - yellow | *Myxococcus hansupus* |
| SBP00085 | Carrot - yellow | *Myxococcus macrosporus* |
| SBP00085 | Carrot - yellow | *Myxococcus stipitatus* |
| SBP00085 | Carrot - yellow | *Myxococcus xanthus* |
| SBP00085 | Carrot - yellow | *Nakamurella multipartita* |
| SBP00085 | Carrot - yellow | *Nakamurella panacisegetis* |
| SBP00085 | Carrot - yellow | *Natronococcus occultus* |
| SBP00085 | Carrot - yellow | *Neoasaia chiangmaiensis* |
| SBP00085 | Carrot - yellow | *Neodiprion lecontei* nucleopolyhedrovirus |
| SBP00085 | Carrot - yellow | *Neorhizobium galegae* |
| SBP00085 | Carrot - yellow | *Neorhizobium* sp. NCHU2750 |
| SBP00085 | Carrot - yellow | *Neorhizobium* sp. SOG26 |
| SBP00085 | Carrot - yellow | *Niastella koreensis* |
| SBP00085 | Carrot - yellow | *Nissabacter* sp. SGAir0207 |
| SBP00085 | Carrot - yellow | *Nitratireductor basaltis* |
| SBP00085 | Carrot - yellow | *Nitratireductor* sp. OM-1 |
| SBP00085 | Carrot - yellow | *Nitrobacter hamburgensis* |
| SBP00085 | Carrot - yellow | *Nitrobacter winogradskyi* |
| SBP00085 | Carrot - yellow | *Nitrosococcus halophilus* |
| SBP00085 | Carrot - yellow | *Nitrosospira lacus* |
| SBP00085 | Carrot - yellow | *Nitrospira moscoviensis* |

TABLE 3-continued

List of species identified in each metagenomic sample of each SBP Sample

| SBP ID | SBP Host Common Name | Genus sp. |
|---|---|---|
| SBP00085 | Carrot - yellow | *Nitrospirillum amazonense* |
| SBP00085 | Carrot - yellow | *Niveispirillum cyanobacteriorum* |
| SBP00085 | Carrot - yellow | *Nocardia brasiliensis* |
| SBP00085 | Carrot - yellow | *Nocardia cyriacigeorgica* |
| SBP00085 | Carrot - yellow | *Nocardia farcinica* |
| SBP00085 | Carrot - yellow | *Nocardia nova* |
| SBP00085 | Carrot - yellow | *Nocardia seriolae* |
| SBP00085 | Carrot - yellow | *Nocardia* sp. CFHS0054 |
| SBP00085 | Carrot - yellow | *Nocardia* sp. CS682 |
| SBP00085 | Carrot - yellow | *Nocardia* sp. Y48 |
| SBP00085 | Carrot - yellow | *Nocardia terpenica* |
| SBP00085 | Carrot - yellow | *Nocardioides baekrokdamisoli* |
| SBP00085 | Carrot - yellow | *Nocardioides daphniae* |
| SBP00085 | Carrot - yellow | *Nocardioides dokdonensis* |
| SBP00085 | Carrot - yellow | *Nocardioides humi* |
| SBP00085 | Carrot - yellow | *Nocardioides* sp. 603 |
| SBP00085 | Carrot - yellow | *Nocardioides* sp. 78 |
| SBP00085 | Carrot - yellow | *Nocardioides* sp. CF8 |
| SBP00085 | Carrot - yellow | *Nocardioides* sp. HY056 |
| SBP00085 | Carrot - yellow | *Nocardioides* sp. JS614 |
| SBP00085 | Carrot - yellow | *Nocardiopsis dassonvillei* |
| SBP00085 | Carrot - yellow | *Nonomuraea* sp. ATCC 55076 |
| SBP00085 | Carrot - yellow | *Nostoc carneum* |
| SBP00085 | Carrot - yellow | *Nostoc piscinale* |
| SBP00085 | Carrot - yellow | *Novibacillus thermophilus* |
| SBP00085 | Carrot - yellow | *Novosphingobium aromaticivorans* |
| SBP00085 | Carrot - yellow | *Novosphingobium pentaromativorans* |
| SBP00085 | Carrot - yellow | *Novosphingobium resinovorum* |
| SBP00085 | Carrot - yellow | *Novosphingobium* sp. P6W |
| SBP00085 | Carrot - yellow | *Novosphingobium* sp. THN1 |
| SBP00085 | Carrot - yellow | *Novosphingobium tardaugens* |
| SBP00085 | Carrot - yellow | *Oceanithermus profundus* |
| SBP00085 | Carrot - yellow | *Oceanobacillus iheyensis* |
| SBP00085 | Carrot - yellow | *Ochrobactrum anthropi* |
| SBP00085 | Carrot - yellow | *Ochrobactrum* sp. A44 |
| SBP00085 | Carrot - yellow | *Oligotropha carboxidovorans* |
| SBP00085 | Carrot - yellow | *Opitutaceae bacterium* TAV5 |
| SBP00085 | Carrot - yellow | *Opitutus* sp. GAS368 |
| SBP00085 | Carrot - yellow | *Opitutus terrae* |
| SBP00085 | Carrot - yellow | *Ornithinimicrobium flavum* |
| SBP00085 | Carrot - yellow | *Ornithinimicrobium* sp. AMA3305 |
| SBP00085 | Carrot - yellow | *Orrella dioscoreae* |
| SBP00085 | Carrot - yellow | *Oscillatoria nigro-viridis* |
| SBP00085 | Carrot - yellow | *Ottowia oryzae* |
| SBP00085 | Carrot - yellow | *Paenibacillus crassostreae* |
| SBP00085 | Carrot - yellow | *Paenibacillus mucilaginosus* |
| SBP00085 | Carrot - yellow | *Paenibacillus odorifer* |
| SBP00085 | Carrot - yellow | *Paenibacillus polymyxa* |
| SBP00085 | Carrot - yellow | *Paenibacillus* sp. MBLB1234 |
| SBP00085 | Carrot - yellow | *Paenibacillus* sp. RUD330 |
| SBP00085 | Carrot - yellow | *Paludisphaera borealis* |
| SBP00085 | Carrot - yellow | *Pandoraea faecigallinarum* |
| SBP00085 | Carrot - yellow | *Pandoraea norimbergensis* |
| SBP00085 | Carrot - yellow | *Pandoraea pnomenusa* |
| SBP00085 | Carrot - yellow | *Pandoraea pulmonicola* |
| SBP00085 | Carrot - yellow | *Pandoraea sputorum* |
| SBP00085 | Carrot - yellow | *Pandoraea thiooxydans* |
| SBP00085 | Carrot - yellow | *Pandoraea vervacti* |
| SBP00085 | Carrot - yellow | *Pannonibacter phragmitetus* |
| SBP00085 | Carrot - yellow | *Pantoea agglomerans* |
| SBP00085 | Carrot - yellow | *Pantoea vagans* |
| SBP00085 | Carrot - yellow | *Parabacteroides distasonis* |
| SBP00085 | Carrot - yellow | *Paraburkholderia aromaticivorans* |
| SBP00085 | Carrot - yellow | *Paraburkholderia caledonica* |
| SBP00085 | Carrot - yellow | *Paraburkholderia caribensis* |
| SBP00085 | Carrot - yellow | *Paraburkholderia hospita* |
| SBP00085 | Carrot - yellow | *Paraburkholderia phymatum* |
| SBP00085 | Carrot - yellow | *Paraburkholderia phytofirmans* |
| SBP00085 | Carrot - yellow | *Paraburkholderia* sp. DCR13 |
| SBP00085 | Carrot - yellow | *Paraburkholderia* sp. SOS3 |
| SBP00085 | Carrot - yellow | *Paraburkholderia sprentiae* |
| SBP00085 | Carrot - yellow | *Paraburkholderia terrae* |
| SBP00085 | Carrot - yellow | *Paraburkholderia xenovorans* |
| SBP00085 | Carrot - yellow | *Paracoccus aminophilus* |
| SBP00085 | Carrot - yellow | *Paracoccus aminovorans* |
| SBP00085 | Carrot - yellow | *Paracoccus contaminans* |

TABLE 3-continued

List of species identified in each metagenomic sample of each SBP Sample

| SBP ID | SBP Host Common Name | Genus sp. |
|---|---|---|
| SBP00085 | Carrot - yellow | *Paracoccus denitrificans* |
| SBP00085 | Carrot - yellow | *Paracoccus* sp. Arc7-R13 |
| SBP00085 | Carrot - yellow | *Paracoccus* sp. SC2-6 |
| SBP00085 | Carrot - yellow | *Paracoccus yeei* |
| SBP00085 | Carrot - yellow | *Paracoccus zhejiangensis* |
| SBP00085 | Carrot - yellow | *Pararhodospirillum photometricum* |
| SBP00085 | Carrot - yellow | *Parolsenella catena* |
| SBP00085 | Carrot - yellow | *Parvibaculum lavamentivorans* |
| SBP00085 | Carrot - yellow | *Parvularcula bermudensis* |
| SBP00085 | Carrot - yellow | *Pasteurella multocida* |
| SBP00085 | Carrot - yellow | *Paucibacter* sp. KCTC 42545 |
| SBP00085 | Carrot - yellow | *Pediococcus damnosus* |
| SBP00085 | Carrot - yellow | *Pediococcus pentosaceus* |
| SBP00085 | Carrot - yellow | *Pedobacter cryoconitis* |
| SBP00085 | Carrot - yellow | *Pedobacter steynii* |
| SBP00085 | Carrot - yellow | *Pelagibaca abyssi* |
| SBP0008S | Carrot - yellow | *Pelagibacterium halotolerans* |
| SBP00085 | Carrot - yellow | *Pelobacter carbinolicus* |
| SBP00085 | Carrot - yellow | *Pelobacter* sp. SFB93 |
| SBP00085 | Carrot - yellow | *Peptoclostridium acidaminophilum* |
| SBP00085 | Carrot - yellow | *Persicobacter* sp. JZB09 |
| SBP00085 | Carrot - yellow | *Phaeobacter gallaeciensis* |
| SBP00085 | Carrot - yellow | *Phenylobacterium* sp. HYN0004 |
| SBP00085 | Carrot - yellow | *Phenylobacterium zucineum* |
| SBP00085 | Carrot - yellow | *Photobacterium damselae* |
| SBP00085 | Carrot - yellow | *Phreatobacter cathodiphilus* |
| SBP00085 | Carrot - yellow | *Phreatobacter stygius* |
| SBP00085 | Carrot - yellow | *Phycicoccus dokdonensis* |
| SBP00085 | Carrot - yellow | *Phycisphaera mikurensis* |
| SBP00085 | Carrot - yellow | *Phyllobacterium zundukense* |
| SBP00085 | Carrot - yellow | *Pigmentiphaga* sp. H8 |
| SBP00085 | Carrot - yellow | *Pimelobacter simplex* |
| SBP00085 | Carrot - yellow | *Pirellula staleyi* |
| SBP00085 | Carrot - yellow | *Planctomyces* sp. SH-PL14 |
| SBP00085 | Carrot - yellow | *Planctomyces* sp. SH-PL62 |
| SBP00085 | Carrot - yellow | *Planctopirus limnophila* |
| SBP00085 | Carrot - yellow | *Plantibacter flavus* |
| SBP00085 | Carrot - yellow | *Plantibacter* sp. |
| SBP00085 | Carrot - yellow | *Plautia stali* |
| SBP00085 | Carrot - yellow | *Pleomorphomonas* sp. SM30 |
| SBP00085 | Carrot - yellow | *Polaribacter* sp. Hel1_33_78 |
| SBP00085 | Carrot - yellow | *Polaribacter* sp. SA4-10 |
| SBP00085 | Carrot - yellow | *Polaromonas naphthalenivorans* |
| SBP00085 | Carrot - yellow | *Polaromonas* sp. JS666 |
| SBP00085 | Carrot - yellow | *Polaromonas* sp. SP1 |
| SBP00085 | Carrot - yellow | *Polymorphum gilvum* |
| SBP00085 | Carrot - yellow | *Pontibacter actiniarum* |
| SBP00085 | Carrot - yellow | *Porphyrobacter* HT-58-2 |
| SBP00085 | Carrot - yellow | *Porphyrobacter neustonensis* |
| SBP00085 | Carrot - yellow | *Porphyrobacter* sp. CACIAM 03H1 |
| SBP00085 | Carrot - yellow | *Porphyrobacter* sp. LM 6 |
| SBP00085 | Carrot - yellow | *Prauserella marina* |
| SBP00085 | Carrot - yellow | *Prevotella scopos* |
| SBP00085 | Carrot - yellow | *Prochlorococcus marinus* |
| SBP00085 | Carrot - yellow | *Proteus mirabilis* |
| SBP00085 | Carrot - yellow | *Providencia rustigianii* |
| SBP00085 | Carrot - yellow | *Pseudanabaena* sp. PCC 7367 |
| SBP00085 | Carrot - yellow | *Pseudarthrobacter phenanthrenivorans* |
| SBP00085 | Carrot - yellow | *Pseudarthrobacter sulfonivorans* |
| SBP00085 | Carrot - yellow | *Pseudoflavitalea* sp. 5GH32-13 |
| SBP00085 | Carrot - yellow | *Pseudolabrys taiwanensis* |
| SBP00085 | Carrot - yellow | *Pseudomonas aeruginosa* |
| SBP00085 | Carrot - yellow | *Pseudomonas agarici* |
| SBP00085 | Carrot - yellow | *Pseudomonas alcaligenes* |
| SBP00085 | Carrot - yellow | *Pseudomonas alkylphenolica* |
| SBP00085 | Carrot - yellow | *Pseudomonas antarctica* |
| SBP00085 | Carrot - yellow | *Pseudomonas arsenicoxydans* |
| SBP00085 | Carrot - yellow | *Pseudomonas asplenii* |
| SBP00085 | Carrot - yellow | *Pseudomonas azotoformans* |
| SBP00085 | Carrot - yellow | *Pseudomonas balearica* |
| SBP00085 | Carrot - yellow | *Pseudomonas brassicacearum* |
| SBP00085 | Carrot - yellow | *Pseudomonas brenneri* |
| SBP00085 | Carrot - yellow | *Pseudomonas cedrina* |
| SBP00085 | Carrot - yellow | *Pseudomonas chlororaphis* |
| SBP00085 | Carrot - yellow | *Pseudomonas citronellolis* |
| SBP00085 | Carrot - yellow | *Pseudomonas corrugata* |

TABLE 3-continued

List of species identified in each metagenomic sample of each SBP Sample

| SBP ID | SBP Host Common Name | Genus sp. |
|---|---|---|
| SBP00085 | Carrot - yellow | *Pseudomonas cremoricolorata* |
| SBP00085 | Carrot - yellow | *Pseudomonas entomophila* |
| SBP00085 | Carrot - yellow | *Pseudomonas extremaustralis* |
| SBP00085 | Carrot - yellow | *Pseudomonas extremorientalis* |
| SBP00085 | Carrot - yellow | *Pseudomonas fluorescens* |
| SBP00085 | Carrot - yellow | *Pseudomonas fragi* |
| SBP00085 | Carrot - yellow | *Pseudomonas frederiksbergensis* |
| SBP00085 | Carrot - yellow | *Pseudomonas fulva* |
| SBP00085 | Carrot - yellow | *Pseudomonas furukawaii* |
| SBP00085 | Carrot - yellow | *Pseudomonas granadensis* |
| SBP00085 | Carrot - yellow | *Pseudomonas knackmussii* |
| SBP00085 | Carrot - yellow | *Pseudomonas koreensis* |
| SBP00085 | Carrot - yellow | *Pseudomonas kribbensis* |
| SBP00085 | Carrot - yellow | *Pseudomonas libanensis* |
| SBP00085 | Carrot - yellow | *Pseudomonas lini* |
| SBP00085 | Carrot - yellow | *Pseudomonas mandelii* |
| SBP00085 | Carrot - yellow | *Pseudomonas mediterranea* |
| SBP00085 | Carrot - yellow | *Pseudomonas mendocina* |
| SBP00085 | Carrot - yellow | *Pseudomonas monteilii* |
| SBP00085 | Carrot - yellow | *Pseudomonas moraviensis* |
| SBP00085 | Carrot - yellow | *Pseudomonas mucidolens* |
| SBP00085 | Carrot - yellow | *Pseudomonas orientalis* |
| SBP00085 | Carrot - yellow | *Pseudomonas oryzae* |
| SBP00085 | Carrot - yellow | *Pseudomonas oryzihabitans* |
| SBP00085 | Carrot - yellow | *Pseudomonas palleroniana* |
| SBP00085 | Carrot - yellow | *Pseudomonas parafulva* |
| SBP00085 | Carrot - yellow | *Pseudomonas phage Andromeda* |
| SBP00085 | Carrot - yellow | *Pseudomonas plecoglossicida* |
| SBP00085 | Carrot - yellow | *Pseudomonas poae* |
| SBP00085 | Carrot - yellow | *Pseudomonas pohangensis* |
| SBP00085 | Carrot - yellow | *Pseudomonas prosekii* |
| SBP00085 | Carrot - yellow | *Pseudomonas protegens* |
| SBP00085 | Carrot - yellow | *Pseudomonas psychrophila* |
| SBP00085 | Carrot - yellow | *Pseudomonas psychrotolerans* |
| SBP00085 | Carrot - yellow | *Pseudomonas putida* |
| SBP00085 | Carrot - yellow | *Pseudomonas reinekei* |
| SBP00085 | Carrot - yellow | *Pseudomonas resinovorans* |
| SBP00085 | Carrot - yellow | *Pseudomonas rhizosphaerae* |
| SBP00085 | Carrot - yellow | *Pseudomonas rhodesiae* |
| SBP00085 | Carrot - yellow | *Pseudomonas saudiphocaensis* |
| SBP00085 | Carrot - yellow | *Pseudomonas sihuiensis* |
| SBP00085 | Carrot - yellow | *Pseudomonas silesiensis* |
| SBP00085 | Carrot - yellow | *Pseudomonas sp.* |
| SBP00085 | Carrot - yellow | *Pseudomonas sp.* 02C 26 |
| SBP00085 | Carrot - yellow | *Pseudomonas sp.* 31-12 |
| SBP00085 | Carrot - yellow | *Pseudomonas sp.* 7SR1 |
| SBP00085 | Carrot - yellow | *Pseudomonas sp.* A214 |
| SBP00085 | Carrot - yellow | *Pseudomonas sp.* ATCC 13867 |
| SBP00085 | Carrot - yellow | *Pseudomonas sp.* B10 |
| SBP00085 | Carrot - yellow | *Pseudomonas sp.* CC6-YY-74 |
| SBP00085 | Carrot - yellow | *Pseudomonas sp.* CMR12a |
| SBP00085 | Carrot - yellow | *Pseudomonas sp.* CMR5c |
| SBP00085 | Carrot - yellow | *Pseudomonas sp.* DR 5-09 |
| SBP00085 | Carrot - yellow | *Pseudomonas sp.* DY-1 |
| SBP00085 | Carrot - yellow | *Pseudomonas sp.* FDAARGOS_380 |
| SBP00085 | Carrot - yellow | *Pseudomonas sp.* GR 6-02 |
| SBP00085 | Carrot - yellow | *Pseudomonas sp.* HLS-6 |
| SBP00085 | Carrot - yellow | *Pseudomonas sp.* K2W31S-8 |
| SBP00085 | Carrot - yellow | *Pseudomonas sp.* LAB-08 |
| SBP00085 | Carrot - yellow | *Pseudomonas sp.* LBUM920 |
| SBP00085 | Carrot - yellow | *Pseudomonas sp.* LG1D9 |
| SBP00085 | Carrot - yellow | *Pseudomonas sp.* LG1E9 |
| SBP00085 | Carrot - yellow | *Pseudomonas sp.* LH1G9 |
| SBP00085 | Carrot - yellow | *Pseudomonas sp.* LPH1 |
| SBP00085 | Carrot - yellow | *Pseudomonas sp.* M30-35 |
| SBP00085 | Carrot - yellow | *Pseudomonas sp.* NS1(2017) |
| SBP00085 | Carrot - yellow | *Pseudomonas sp.* Os17 |
| SBP00085 | Carrot - yellow | *Pseudomonas sp.* R2-37-08W |
| SBP00085 | Carrot - yellow | *Pseudomonas sp.* R5-89-07 |
| SBP00085 | Carrot - yellow | *Pseudomonas sp.* RU47 |
| SBP00085 | Carrot - yellow | *Pseudomonas sp.* S-6-2 |
| SBP00085 | Carrot - yellow | *Pseudomonas sp.* S09G 359 |
| SBP00085 | Carrot - yellow | *Pseudomonas sp.* s211(2017) |
| SBP00085 | Carrot - yellow | *Pseudomonas sp.* St29 |
| SBP00085 | Carrot - yellow | *Pseudomonas sp.* StFLB209 |
| SBP00085 | Carrot - yellow | *Pseudomonas sp.* SWI36 |

TABLE 3-continued

List of species identified in each metagenomic sample of each SBP Sample

| SBP ID | SBP Host Common Name | Genus sp. |
| --- | --- | --- |
| SBP00085 | Carrot - yellow | *Pseudomonas* sp. TCU-HL1 |
| SBP00085 | Carrot - yellow | *Pseudomonas* sp. URMO17WK12:I11 |
| SBP00085 | Carrot - yellow | *Pseudomonas* sp. UW4 |
| SBP00085 | Carrot - yellow | *Pseudomonas* sp. XWY-1 |
| SBP00085 | Carrot - yellow | *Pseudomonas* sp. Z003-0.4C(8344-21) |
| SBP00085 | Carrot - yellow | *Pseudomonas stutzeri* |
| SBP00085 | Carrot - yellow | *Pseudomonas synxantha* |
| SBP00085 | Carrot - yellow | *Pseudomonas syringae* |
| SBP00085 | Carrot - yellow | *Pseudomonas syringae* group genomosp. 3 |
| SBP00085 | Carrot - yellow | *Pseudomonas taetrolens* |
| SBP00085 | Carrot - yellow | *Pseudomonas thivervalensis* |
| SBP00085 | Carrot - yellow | *Pseudomonas tolaasii* |
| SBP00085 | Carrot - yellow | *Pseudomonas trivialis* |
| SBP00085 | Carrot - yellow | *Pseudomonas umsongensis* |
| SBP00085 | Carrot - yellow | *Pseudomonas vancouverensis* |
| SBP00085 | Carrot - yellow | *Pseudomonas veronii* |
| SBP00085 | Carrot - yellow | *Pseudomonas versuta* |
| SBP00085 | Carrot - yellow | *Pseudomonas viridiflava* |
| SBP00085 | Carrot - yellow | *Pseudomonas xanthomarina* |
| SBP00085 | Carrot - yellow | *Pseudomonas xinjiangensis* |
| SBP00085 | Carrot - yellow | *Pseudomonas yamanorum* |
| SBP00085 | Carrot - yellow | *Pseudonocardia autotrophica* |
| SBP00085 | Carrot - yellow | *Pseudonocardia dioxanivorans* |
| SBP00085 | Carrot - yellow | *Pseudonocardia* sp. AL041005-10 |
| SBP00085 | Carrot - yellow | *Pseudonocardia* sp. HH130630-07 |
| SBP00085 | Carrot - yellow | *Pseudorhodoplanes sinuspersici* |
| SBP00085 | Carrot - yellow | *Pseudoxanthomonas spadix* |
| SBP00085 | Carrot - yellow | *Pseudoxanthomonas suwonensis* |
| SBP00085 | Carrot - yellow | *Psychromonas* sp. CNPT3 |
| SBP00085 | Carrot - yellow | *Qipengyuania sediminis* |
| SBP00085 | Carrot - yellow | *Rahnella* sp. ERMR1:05 |
| SBP00085 | Carrot - yellow | *Ralstonia insidiosa* |
| SBP00085 | Carrot - yellow | *Ralstonia mannitolilytica* |
| SBP00085 | Carrot - yellow | *Ralstonia pickettii* |
| SBP00085 | Carrot - yellow | *Ralstonia solanacearum* |
| SBP00085 | Carrot - yellow | *Ramlibacter tataouinensis* |
| SBP00085 | Carrot - yellow | *Raoultella ornithinolytica* |
| SBP00085 | Carrot - yellow | *Rathayibacter festucae* |
| SBP00085 | Carrot - yellow | *Rathayibacter iranicus* |
| SBP00085 | Carrot - yellow | *Rathayibacter tritici* |
| SBP00085 | Carrot - yellow | *Rheinheimera* sp. LHK132 |
| SBP00085 | Carrot - yellow | *Rhizobacter gummiphilus* |
| SBP00085 | Carrot - yellow | *Rhizobium acidisoli* |
| SBP00085 | Carrot - yellow | *Rhizobium etli* |
| SBP00085 | Carrot - yellow | *Rhizobium favelukesii* |
| SBP00085 | Carrot - yellow | *Rhizobium gallicum* |
| SBP00085 | Carrot - yellow | *Rhizobium jaguaris* |
| SBP00085 | Carrot - yellow | *Rhizobium leguminosarum* |
| SBP00085 | Carrot - yellow | *Rhizobium phaseoli* |
| SBP00085 | Carrot - yellow | *Rhizobium pusense* |
| SBP00085 | Carrot - yellow | *Rhizobium* sp. 11515TR |
| SBP00085 | Carrot - yellow | *Rhizobium* sp. ACO-34A |
| SBP00085 | Carrot - yellow | *Rhizobium* sp. CIAT894 |
| SBP00085 | Carrot - yellow | *Rhizobium* sp. Kim5 |
| SBP00085 | Carrot - yellow | *Rhizobium* sp. NT-26 |
| SBP00085 | Carrot - yellow | *Rhizobium* sp. NXC14 |
| SBP00085 | Carrot - yellow | *Rhizobium* sp. NXC24 |
| SBP00085 | Carrot - yellow | *Rhizobium* sp. S41 |
| SBP00085 | Carrot - yellow | *Rhizobium tropici* |
| SBP00085 | Carrot - yellow | *Rhizorhabdus dicambivorans* |
| SBP00085 | Carrot - yellow | *Rhodanobacter denitrificans* |
| SBP00085 | Carrot - yellow | *Rhodanobacteraceae bacterium* Dysh456 |
| SBP00085 | Carrot - yellow | *Rhodobacter blasticus* |
| SBP00085 | Carrot - yellow | *Rhodobacter capsulatus* |
| SBP00085 | Carrot - yellow | *Rhodobacter* sp. CZR27 |
| SBP00085 | Carrot - yellow | *Rhodobacter* sp. LPB0142 |
| SBP00085 | Carrot - yellow | *Rhodobacter sphaeroides* |
| SBP00085 | Carrot - yellow | *Rhodobacteraceae bacterium* QY30 |
| SBP00085 | Carrot - yellow | *Rhodococcus fascians* |
| SBP00085 | Carrot - yellow | *Rhodococcus hoagii* |
| SBP00085 | Carrot - yellow | *Rhodococcus opacus* |
| SBP00085 | Carrot - yellow | *Rhodococcus ruber* |
| SBP00085 | Carrot - yellow | *Rhodococcus* sp. MTM3W5.2 |
| SBP00085 | Carrot - yellow | *Rhodococcus* sp. X156 |
| SBP00085 | Carrot - yellow | *Rhodoferax antarcticus* |
| SBP00085 | Carrot - yellow | *Rhodoferax ferrireducens* |

TABLE 3-continued

List of species identified in each metagenomic sample of each SBP Sample

| SBP ID | SBP Host Common Name | Genus sp. |
| --- | --- | --- |
| SBP00085 | Carrot - yellow | *Rhodoferax koreense* |
| SBP00085 | Carrot - yellow | *Rhodoferax saidenbachensis* |
| SBP00085 | Carrot - yellow | *Rhodomicrobium vannielii* |
| SBP00085 | Carrot - yellow | *Rhodopirellula baltica* |
| SBP00085 | Carrot - yellow | *Rhodoplanes* sp. Z2-YC6860 |
| SBP00085 | Carrot - yellow | *Rhodopseudomonas palustris* |
| SBP00085 | Carrot - yellow | *Rhodospirillum centenum* |
| SBP00085 | Carrot - yellow | *Rhodospirillum rubrum* |
| SBP00085 | Carrot - yellow | *Rhodothermaceae bacterium* |
| SBP00085 | Carrot - yellow | *Rhodothermus marinus* |
| SBP00085 | Carrot - yellow | *Rhodovulum* sp. MB263 |
| SBP00085 | Carrot - yellow | *Rhodovulum* sp. P5 |
| SBP00085 | Carrot - yellow | *Rhodovulum sulfidophilum* |
| SBP00085 | Carrot - yellow | *Roseateles depolymerans* |
| SBP00085 | Carrot - yellow | *Roseburia hominis* |
| SBP00085 | Carrot - yellow | *Roseiflexus castenholzii* |
| SBP00085 | Carrot - yellow | *Roseitalea porphyridii* |
| SBP00085 | Carrot - yellow | *Roseomonas gilardii* |
| SBP00085 | Carrot - yellow | *Roseomonas* sp. FDAARGOS_362 |
| SBP00085 | Carrot - yellow | *Rothia aeria* |
| SBP00085 | Carrot - yellow | *Rubinisphaera brasiliensis* |
| SBP00085 | Carrot - yellow | *Rubrivivax gelatinosus* |
| SBP00085 | Carrot - yellow | *Rubrobacter radiotolerans* |
| SBP00085 | Carrot - yellow | *Rubrobacter xylanophilus* |
| SBP00085 | Carrot - yellow | *Ruegeria pomeroyi* |
| SBP00085 | Carrot - yellow | *Rummeliibacillus stabekisii* |
| SBP00085 | Carrot - yellow | *Saccharomonospora azurea* |
| SBP00085 | Carrot - yellow | *Saccharomonospora cyanea* |
| SBP00085 | Carrot - yellow | *Saccharopolyspora erythraea* |
| SBP00085 | Carrot - yellow | *Saccharothrix espanaensis* |
| SBP00085 | Carrot - yellow | *Sagittula* sp. P11 |
| SBP00085 | Carrot - yellow | *Salinibacter ruber* |
| SBP00085 | Carrot - yellow | *Salinicola tamaricis* |
| SBP00085 | Carrot - yellow | *Salipiger profundus* |
| SBP00085 | Carrot - yellow | *Salmonella enterica* |
| SBP00085 | Carrot - yellow | *Sandaracinus amylolyticus* |
| SBP00085 | Carrot - yellow | *Sanguibacter keddieii* |
| SBP00085 | Carrot - yellow | *Scytonema* sp. HK-05 |
| SBP00085 | Carrot - yellow | *Serinicoccus chungangensis* |
| SBP00085 | Carrot - yellow | *Serinicaccus* sp. JLT9 |
| SBP00085 | Carrot - yellow | *Serpentinomonas mccroryi* |
| SBP00085 | Carrot - yellow | *Serpentinomonas raichei* |
| SBP00085 | Carrot - yellow | *Serratia fonticola* |
| SBP00085 | Carrot - yellow | *Serratia marcescens* |
| SBP00085 | Carrot - yellow | *Serratia* sp. |
| SBP00085 | Carrot - yellow | *Shewanella baltica* |
| SBP00085 | Carrot - yellow | *Shewanella halifaxensis* |
| SBP00085 | Carrot - yellow | *Shewanella psychrophila* |
| SBP00085 | Carrot - yellow | *Shewanella* sp. M2 |
| SBP00085 | Carrot - yellow | *Shewanella* sp. TH2012 |
| SBP00085 | Carrot - yellow | *Shewanella* sp. WE21 |
| SBP00085 | Carrot - yellow | *Shewanella violacea* |
| SBP00085 | Carrot - yellow | *Shinella* sp. HZN7 |
| SBP00085 | Carrot - yellow | *Sideroxydans lithotrophicus* |
| SBP00085 | Carrot - yellow | *Silicimonas algicola* |
| SBP00085 | Carrot - yellow | *Simplicispira suum* |
| SBP00085 | Carrot - yellow | *Singulisphaera acidiphila* |
| SBP00085 | Carrot - yellow | *Sinorhizobium americanum* |
| SBP00085 | Carrot - yellow | *Sinorhizobium fredii* |
| SBP00085 | Carrot - yellow | *Sinorhizobium medicae* |
| SBP00085 | Carrot - yellow | *Sinorhizobium meliloti* |
| SBP00085 | Carrot - yellow | *Sinorhizobium* sp. RAC02 |
| SBP00085 | Carrot - yellow | *Solimonas* sp. K1W22B-7 |
| SBP00085 | Carrot - yellow | *Sorangium cellulosum* |
| SBP00085 | Carrot - yellow | *Sphaerobacter thermophilus* |
| SBP00085 | Carrot - yellow | *Sphingobacterium* sp. ML3W |
| SBP00085 | Carrot - yellow | *Sphingobacterium thalpophilum* |
| SBP00085 | Carrot - yellow | *Sphingobium amiense* |
| SBP00085 | Carrot - yellow | *Sphingobium baderi* |
| SBP00085 | Carrot - yellow | *Sphingobium chlorophenolicum* |
| SBP00085 | Carrot - yellow | *Sphingobium cloacae* |
| SBP00085 | Carrot - yellow | *Sphingobium herbicidovorans* |
| SBP00085 | Carrot - yellow | *Sphingobium hydrophobicum* |
| SBP00085 | Carrot - yellow | *Sphingobium japonicum* |
| SBP00085 | Carrot - yellow | *Sphingobium* sp. EP60837 |
| SBP00085 | Carrot - yellow | *Sphingobium* sp. MI1205 |

TABLE 3-continued

List of species identified in each metagenomic sample of each SBP Sample

| SBP ID | SBP Host Common Name | Genus sp. |
| --- | --- | --- |
| SBP00085 | Carrot - yellow | *Sphingobium* sp. RAC03 |
| SBP00085 | Carrot - yellow | *Sphingobium* sp. SCG-1 |
| SBP00085 | Carrot - yellow | *Sphingobium* sp. SYK-6 |
| SBP00085 | Carrot - yellow | *Sphingobium* sp. TKS |
| SBP00085 | Carrot - yellow | *Sphingobium* sp. YG1 |
| SBP00085 | Carrot - yellow | *Sphingobium yanoikuyae* |
| SBP00085 | Carrot - yellow | *Sphingomonas indica* |
| SBP00085 | Carrot - yellow | *Sphingomonas koreensis* |
| SBP00085 | Carrot - yellow | *Sphingomonas melonis* |
| SBP00085 | Carrot - yellow | *Sphingomonas panacis* |
| SBP00085 | Carrot - yellow | *Sphingomonas paucimobilis* |
| SBP00085 | Carrot - yellow | *Sphingomonas sanxanigenens* |
| SBP00085 | Carrot - yellow | *Sphingomonas* sp. AAP5 |
| SBP00085 | Carrot - yellow | *Sphingomonas* sp. C8-2 |
| SBP00085 | Carrot - yellow | *Sphingomonas* sp. Cra20 |
| SBP00085 | Carrot - yellow | *Sphingomonas* sp. FARSPH |
| SBP00085 | Carrot - yellow | *Sphingomonas* sp. JJ-A5 |
| SBP00085 | Carrot - yellow | *Sphingomonas* sp. KC8 |
| SBP00085 | Carrot - yellow | *Sphingomonas* sp. LK11 |
| SBP00085 | Carrot - yellow | *Sphingomonas* sp. LM7 |
| SBP00085 | Carrot - yellow | *Sphingomonas* sp. MM-1 |
| SBP00085 | Carrot - yellow | *Sphingomonas taxi* |
| SBP00085 | Carrot - yellow | *Sphingomonas wittichii* |
| SBP00085 | Carrot - yellow | *Sphingopyxis alaskensis* |
| SBP00085 | Carrot - yellow | *Sphingopyxis fribergensis* |
| SBP00085 | Carrot - yellow | *Sphingopyxis granuli* |
| SBP00085 | Carrot - yellow | *Sphingopyxis macrogoltabida* |
| SBP00085 | Carrot - yellow | *Sphingopyxis* sp. 113P3 |
| SBP00085 | Carrot - yellow | *Sphingopyxis* sp. EG6 |
| SBP00085 | Carrot - yellow | *Sphingopyxis* sp. FD7 |
| SBP00085 | Carrot - yellow | *Sphingopyxis* sp. QXT-31 |
| SBP00085 | Carrot - yellow | *Sphingopyxis* sp. WS5A3p |
| SBP00085 | Carrot - yellow | *Sphingorhabdus* sp. M41 |
| SBP00085 | Carrot - yellow | *Sphingorhabdus* sp. YGSMI21 |
| SBP00085 | Carrot - yellow | *Sphingosinicella microcystinivorans* |
| SBP00085 | Carrot - yellow | *Sphingosinicella* sp. BN140058 |
| SBP00085 | Carrot - yellow | *Spirosoma pollinicola* |
| SBP00085 | Carrot - yellow | *Spirosoma rigui* |
| SBP00085 | Carrot - yellow | *Sporosarcina psychrophila* |
| SBP00085 | Carrot - yellow | *Stackebrandtia nassauensis* |
| SBP00085 | Carrot - yellow | *Staphylococcus aureus* |
| SBP00085 | Carrot - yellow | *Staphylococcus epidermidis* |
| SBP00085 | Carrot - yellow | *Staphylococcus sciuri* |
| SBP00085 | Carrot - yellow | *Stappia* sp. ES.058 |
| SBP00085 | Carrot - yellow | *Starkeya novella* |
| SBP00085 | Carrot - yellow | *Stella humosa* |
| SBP00085 | Carrot - yellow | *Stella vacuolata* |
| SBP00085 | Carrot - yellow | *Stenotrophomonas acidaminiphila* |
| SBP00085 | Carrot - yellow | *Stenotrophomonas maltophilia* |
| SBP00085 | Carrot - yellow | *Stenotrophomonas rhizophila* |
| SBP00085 | Carrot - yellow | *Stenotrophomonas* sp. |
| SBP00085 | Carrot - yellow | *Stenotrophomonas* sp. ESTM1D_MKCIP4_1 |
| SBP00085 | Carrot - yellow | *Stenotrophomonas* sp. G4 |
| SBP00085 | Carrot - yellow | *Stenotrophomonas* sp. Pemsol |
| SBP00085 | Carrot - yellow | *Stenotrophomonas* sp. WZN-1 |
| SBP00085 | Carrot - yellow | *Stenotrophomonas* sp. ZAC14D2_NAIMI4_7 |
| SBP00085 | Carrot - yellow | *Steroidobacter denitrificans* |
| SBP00085 | Carrot - yellow | *Sterolibacteriaceae bacterium* J5B |
| SBP00085 | Carrot - yellow | *Stigmatella aurantiaca* |
| SBP00085 | Carrot - yellow | *Streptacidiphilus* sp. DSM 106435 |
| SBP00085 | Carrot - yellow | *Streptococcus parauberis* |
| SBP00085 | Carrot - yellow | *Streptococcus viridans* |
| SBP00085 | Carrot - yellow | *Streptomyces actuosus* |
| SBP00085 | Carrot - yellow | *Streptomyces alboflavus* |
| SBP00085 | Carrot - yellow | *Streptomyces albulus* |
| SBP00085 | Carrot - yellow | *Streptomyces albus* |
| SBP00085 | Carrot - yellow | *Streptomyces ambofaciens* |
| SBP00085 | Carrot - yellow | *Streptomyces antibioticus* |
| SBP00085 | Carrot - yellow | *Streptomyces avermitilis* |
| SBP00085 | Carrot - yellow | *Streptomyces bingchenggensis* |
| SBP00085 | Carrot - yellow | *Streptomyces cattleya* |
| SBP00085 | Carrot - yellow | *Streptomyces collinus* |
| SBP00085 | Carrot - yellow | *Streptomyces davaonensis* |
| SBP00085 | Carrot - yellow | *Streptomyces dengpaensis* |
| SBP00085 | Carrot - yellow | *Streptomyces exfoliatus* |
| SBP00085 | Carrot - yellow | *Streptomyces fungicidicus* |

TABLE 3-continued

List of species identified in each metagenomic sample of each SBP Sample

| SBP ID | SBP Host Common Name | Genus sp. |
|---|---|---|
| SBP00085 | Carrot - yellow | *Streptomyces gilvosporeus* |
| SBP00085 | Carrot - yellow | *Streptomyces griseorubiginosus* |
| SBP00085 | Carrot - yellow | *Streptomyces griseoviridis* |
| SBP00085 | Carrot - yellow | *Streptomyces hundungensis* |
| SBP00085 | Carrot - yellow | *Streptomyces hygroscopicus* |
| SBP00085 | Carrot - yellow | *Streptomyces leeuwenhoekii* |
| SBP00085 | Carrot - yellow | *Streptomyces lunaelactis* |
| SBP00085 | Carrot - yellow | *Streptomyces luteoverticillatus* |
| SBP00085 | Carrot - yellow | *Streptomyces lydicus* |
| SBP00085 | Carrot - yellow | *Streptomyces nigra* |
| SBP00085 | Carrot - yellow | *Streptomyces niveus* |
| SBP00085 | Carrot - yellow | *Streptomyces olivoreticuli* |
| SBP00085 | Carrot - yellow | *Streptomyces pactum* |
| SBP00085 | Carrot - yellow | *Streptomyces parvulus* |
| SBP00085 | Carrot - yellow | *Streptomyces pristinaespiralis* |
| SBP00085 | Carrot - yellow | *Streptomyces puniciscabiei* |
| SBP00085 | Carrot - yellow | *Streptomyces qaidamensis* |
| SBP00085 | Carrot - yellow | *Streptomyces reticuli* |
| SBP00085 | Carrot - yellow | *Streptomyces rimosus* |
| SBP00085 | Carrot - yellow | *Streptomyces roseochromogenus* |
| SBP00085 | Carrot - yellow | *Streptomyces scabiei* |
| SBP00085 | Carrot - yellow | *Streptomyces* sp. 2323.1 |
| SBP00085 | Carrot - yellow | *Streptomyces* sp. 3214.6 |
| SBP00085 | Carrot - yellow | *Streptomyces* sp. fd1-xmd |
| SBP00085 | Carrot - yellow | *Streptomyces* sp. Go-475 |
| SBP00085 | Carrot - yellow | *Streptomyces* sp. GSSD-12 |
| SBP00085 | Carrot - yellow | *Streptomyces* sp. HNM0039 |
| SBP00085 | Carrot - yellow | *Streptomyces* sp. M2 |
| SBP00085 | Carrot - yellow | *Streptomyces* sp. NEAU-S7GS2 |
| SBP00085 | Carrot - yellow | *Streptomyces* sp. P3 |
| SBP00085 | Carrot - yellow | *Streptomyces* sp. RTd22 |
| SBP00085 | Carrot - yellow | *Streptomyces* sp. SCSIO 03032 |
| SBP00085 | Carrot - yellow | *Streptomyces* sp. SGAir0924 |
| SBP00085 | Carrot - yellow | *Streptomyces* sp. SirexAA-E |
| SBP00085 | Carrot - yellow | *Streptomyces* sp. TLI_053 |
| SBP00085 | Carrot - yellow | *Streptomyces* sp. W1SF4 |
| SBP00085 | Carrot - yellow | *Streptomyces* sp. YIM 121038 |
| SBP00085 | Carrot - yellow | *Streptomyces* sp. Z022 |
| SBP00085 | Carrot - yellow | *Streptomyces* sp. ZFG47 |
| SBP00085 | Carrot - yellow | *Streptomyces venezuelae* |
| SBP00085 | Carrot - yellow | *Streptomyces vietnamensis* |
| SBP00085 | Carrot - yellow | *Streptomyces xinghaiensis* |
| SBP00085 | Carrot - yellow | *Streptosporangium roseum* |
| SBP00085 | Carrot - yellow | *Streptosporangium* sp. 'caverna' |
| SBP00085 | Carrot - yellow | *Sulfitobacter* sp. AM1-D1 |
| SBP00085 | Carrot - yellow | *Sulfitobacter* sp. D7 |
| SBP00085 | Carrot - yellow | *Sulfolobus islandicus* |
| SBP00085 | Carrot - yellow | *Sulfuricaulis limicola* |
| SBP00085 | Carrot - yellow | *Sulfurifustis variabilis* |
| SBP00085 | Carrot - yellow | *Sulfuritalea hydrogenivorans* |
| SBP00085 | Carrot - yellow | *Sulfuritortus calidifontis* |
| SBP00085 | Carrot - yellow | *Sulfurivermis fontis* |
| SBP00085 | Carrot - yellow | *Synechococcus* sp. JA-3-3Ab |
| SBP00085 | Carrot - yellow | *Tabrizicola* sp. K13M18 |
| SBP00085 | Carrot - yellow | *Tenacibaculum jejuense* |
| SBP00085 | Carrot - yellow | *Terriglobus roseus* |
| SBP00085 | Carrot - yellow | *Tessaracoccus* sp. T2.5-30 |
| SBP00085 | Carrot - yellow | *Thalassococcus* sp. SH-1 |
| SBP00085 | Carrot - yellow | *Thauera aromatica* |
| SBP00085 | Carrot - yellow | *Thauera chlorobenzoica* |
| SBP00085 | Carrot - yellow | *Thauera* sp. K11 |
| SBP00085 | Carrot - yellow | *Thauera* sp. MZ1T |
| SBP00085 | Carrot - yellow | *Thermobispora bispora* |
| SBP00085 | Carrot - yellow | *Thermococcus kodakarensis* |
| SBP00085 | Carrot - yellow | *Thermocrinis albus* |
| SBP00085 | Carrot - yellow | *Thermodesulfovibrio yellowstonii* |
| SBP00085 | Carrot - yellow | *Thermogutta terrifontis* |
| SBP00085 | Carrot - yellow | *Thermomonas* sp. SY21 |
| SBP00085 | Carrot - yellow | *Thioalkalivibrio sulfidiphilus* |
| SBP00085 | Carrot - yellow | *Thiobacillus denitrificans* |
| SBP00085 | Carrot - yellow | *Thioclava nitratireducens* |
| SBP00085 | Carrot - yellow | *Thiohalobacter thiocyanaticus* |
| SBP00085 | Carrot - yellow | *Thiomicrospira* sp. S5 |
| SBP00085 | Carrot - yellow | *Thiomonas intermedia* |
| SBP00085 | Carrot - yellow | *Thiomonas* sp. X19 |
| SBP00085 | Carrot - yellow | *Tistrella mobilis* |

TABLE 3-continued

List of species identified in each metagenomic sample of each SBP Sample

| SBP ID | SBP Host Common Name | Genus sp. |
|---|---|---|
| SBP00085 | Carrot - yellow | Treponema pedis |
| SBP00085 | Carrot - yellow | Trichodesmium erythraeum |
| SBP00085 | Carrot - yellow | Trichormus azollae |
| SBP00085 | Carrot - yellow | Trueperella pyogenes |
| SBP00085 | Carrot - yellow | Tsukamurella paurometabola |
| SBP00085 | Carrot - yellow | Tumebacillus avium |
| SBP00085 | Carrot - yellow | Variibacter gotjawalensis |
| SBP00085 | Carrot - yellow | Variovorax boronicumulans |
| SBP00085 | Carrot - yellow | Variovorax paradoxus |
| SBP00085 | Carrot - yellow | Variovorax sp. HW608 |
| SBP00085 | Carrot - yellow | Variovorax sp. PAMC 28711 |
| SBP00085 | Carrot - yellow | Variovorax sp. PMC12 |
| SBP00085 | Carrot - yellow | Verminephrobacter eiseniae |
| SBP00085 | Carrot - yellow | Verrucomicrobia bacterium IMCC26134 |
| SBP00085 | Carrot - yellow | Verrucomicrobium sp. GAS474 |
| SBP00085 | Carrot - yellow | Verrucomicrobium spinosum |
| SBP00085 | Carrot - yellow | Verrucosispora maris |
| SBP00085 | Carrot - yellow | Vibrio natriegens |
| SBP00085 | Carrot - yellow | Vibrio vulnificus |
| SBP00085 | Carrot - yellow | Vogesella sp. LIG4 |
| SBP00085 | Carrot - yellow | Vulgatibacter incomptus |
| SBP00085 | Carrot - yellow | Wenzhouxiangella marina |
| SBP00085 | Carrot - yellow | Wolbachia endosymbiont of Folsomia candida |
| SBP00085 | Carrot - yellow | Wolbachia sp. wRi |
| SBP00085 | Carrot - yellow | Xanthobacter autotrophicus |
| SBP00085 | Carrot - yellow | Xanthomonas albilineans |
| SBP00085 | Carrot - yellow | Xanthomonas arboricola |
| SBP00085 | Carrot - yellow | Xanthomonas campestris |
| SBP00085 | Carrot - yellow | Xanthomonas cassavae |
| SBP00085 | Carrot - yellow | Xanthomonas citri |
| SBP00085 | Carrot - yellow | Xanthomonas hortorum |
| SBP00085 | Carrot - yellow | Xanthomonas oryzae |
| SBP00085 | Carrot - yellow | Xanthomonas sacchari |
| SBP00085 | Carrot - yellow | Xanthomonas translucens |
| SBP00085 | Carrot - yellow | Xanthomonas vesicatoria |
| SBP00085 | Carrot - yellow | Xenorhabdus hominickii |
| SBP00085 | Carrot - yellow | Xylanimonas cellulosilytica |
| SBP00085 | Carrot - yellow | Yangia pacifica |
| SBP00085 | Carrot - yellow | Yangia sp. CCB-MM3 |
| SBP00085 | Carrot - yellow | Yoonia vestfoldensis |
| SBP00090 | Pomegranate | [Brevibacterium] frigoritolerans |
| SBP00090 | Pomegranate | [Clostridium] sphenoides |
| SBP00090 | Pomegranate | [Clostridium] ultunense |
| SBP00090 | Pomegranate | Acanthocystis turfacea chlorella virus 1 |
| SBP00090 | Pomegranate | Achromobacter insolitus |
| SBP00090 | Pomegranate | Achromobacter spanius |
| SBP00090 | Pomegranate | Achromobacter xylosoxidans |
| SBP00090 | Pomegranate | Acidaminococcus fermentans |
| SBP00090 | Pomegranate | Acidipropionibacterium acidipropionici |
| SBP00090 | Pomegranate | Acidithiobacillus ferrivorans |
| SBP00090 | Pomegranate | Acidovorax sp. KKS102 |
| SBP00090 | Pomegranate | Acinetobacter baumannii |
| SBP00090 | Pomegranate | Acinetobacter bereziniae |
| SBP00090 | Pomegranate | Acinetobacter calcoaceticus |
| SBP00090 | Pomegranate | Acinetobacter haemolyticus |
| SBP00090 | Pomegranate | Acinetobacter johnsonii |
| SBP00090 | Pomegranate | Acinetobacter junii |
| SBP00090 | Pomegranate | Acinetobacter radioresistens |
| SBP00090 | Pomegranate | Acinetobacter sp. ACNIH2 |
| SBP00090 | Pomegranate | Acinetobacter sp. ADP1 |
| SBP00090 | Pomegranate | Acinetobacter sp. NCu2D-2 |
| SBP00090 | Pomegranate | Actinoalloteichus hoggarensis |
| SBP00090 | Pomegranate | Actinobacillus porcitonsillarum |
| SBP00090 | Pomegranate | Actinoplanes derwentensis |
| SBP00090 | Pomegranate | Actinoplanes sp. ATCC 31351 |
| SBP00090 | Pomegranate | Advenella kashmirensis |
| SBP00090 | Pomegranate | Aeromonas sp. |
| SBP00090 | Pomegranate | Agarilytica rhodophyticola |
| SBP00090 | Pomegranate | Agrobacterium fabrum |
| SBP00090 | Pomegranate | Agrobacterium sp. |
| SBP00090 | Pomegranate | Agrobacterium tumefaciens |
| SBP00090 | Pomegranate | Agromyces flavus |
| SBP00090 | Pomegranate | Agrotis segetum granulovirus |
| SBP00090 | Pomegranate | Ahniella affigens |
| SBP00090 | Pomegranate | Akkermansia muciniphila |
| SBP00090 | Pomegranate | Alcaligenes faecalis |

TABLE 3-continued

List of species identified in each metagenomic sample of each SBP Sample

| SBP ID | SBP Host Common Name | Genus sp. |
|---|---|---|
| SBP00090 | Pomegranate | *Alcanivorax pacificus* |
| SBP00090 | Pomegranate | *Algibacter alginicilyticus* |
| SBP00090 | Pomegranate | *Aliivibrio fischeri* |
| SBP00090 | Pomegranate | *Alistipes shahii* |
| SBP00090 | Pomegranate | *Alkaliphilus oremlandii* |
| SBP00090 | Pomegranate | *Alteromonas* sp. BL110 |
| SBP00090 | Pomegranate | *Alteromonas* sp. RKMC-009 |
| SBP00090 | Pomegranate | *Amycolatopsis mediterranei* |
| SBP00090 | Pomegranate | *Amycolatopsis methanolica* |
| SBP00090 | Pomegranate | *Amycolatopsis* sp. AA4 |
| SBP00090 | Pomegranate | *Anabaena cylindrica* |
| SBP00090 | Pomegranate | *Anaerococcus prevotii* |
| SBP00090 | Pomegranate | *Anaerolinea thermophila* |
| SBP00090 | Pomegranate | *Anaerostipes rhamnosivorans* |
| SBP00090 | Pomegranate | *Aquimarina* sp. AD1 |
| SBP00090 | Pomegranate | *Aquimarina* sp. AD10 |
| SBP00090 | Pomegranate | *Aquimarina* sp. BL5 |
| SBP00090 | Pomegranate | *Aquitalea magnusonii* |
| SBP00090 | Pomegranate | *Archangium gephyra* |
| SBP00090 | Pomegranate | *Arcobacter anaerophilus* |
| SBP00090 | Pomegranate | *Arcobacter bivalviorum* |
| SBP00090 | Pomegranate | *Arcobacter molluscorum* |
| SBP00090 | Pomegranate | *Arcobacter* sp. L |
| SBP00090 | Pomegranate | *Arthrobacter alpinus* |
| SBP00090 | Pomegranate | *Bacillus asahii* |
| SBP00090 | Pomegranate | *Bacillus butanolivorans* |
| SBP00090 | Pomegranate | *Bacillus cellulosilyticus* |
| SBP00090 | Pomegranate | *Bacillus cereus* |
| SBP00090 | Pomegranate | *Bacillus ciccensis* |
| SBP00090 | Pomegranate | *Bacillus halodurans* |
| SBP00090 | Pomegranate | *Bacillus halotolerans* |
| SBP00090 | Pomegranate | *Bacillus krulwichiae* |
| SBP00090 | Pomegranate | *Bacillus lentus* |
| SBP00090 | Pomegranate | *Bacillus licheniformis* |
| SBP00090 | Pomegranate | *Bacillus megaterium* |
| SBP00090 | Pomegranate | *Bacillus methanolicus* |
| SBP00090 | Pomegranate | *Bacillus mycoides* |
| SBP00090 | Pomegranate | *Bacillus paralicheniformis* |
| SBP00090 | Pomegranate | *Bacillus pseudofirmus* |
| SBP00090 | Pomegranate | *Bacillus pumilus* |
| SBP00090 | Pomegranate | *Bacillus safensis* |
| SBP00090 | Pomegranate | *Bacillus simplex* |
| SBP00090 | Pomegranate | *Bacillus* sp. (in: Bacteria) |
| SBP00090 | Pomegranate | *Bacillus* sp. 1NLA3E |
| SBP00090 | Pomegranate | *Bacillus* sp. FJAT-18017 |
| SBP00090 | Pomegranate | *Bacillus* sp. FJAT-22090 |
| SBP00090 | Pomegranate | *Bacillus subtilis* |
| SBP00090 | Pomegranate | *Bacillus thuringiensis* |
| SBP00090 | Pomegranate | *Bacteroides fragilis* |
| SBP00090 | Pomegranate | *Bacteroides thetaiotaomicron* |
| SBP00090 | Pomegranate | *Bartonella apis* |
| SBP00090 | Pomegranate | *Bartonella vinsonii* |
| SBP00090 | Pomegranate | Bat associated circovirus 4 |
| SBP00090 | Pomegranate | *Bdellovibrio bacteriovorus* |
| SBP00090 | Pomegranate | *Bernardetia litoralis* |
| SBP00090 | Pomegranate | *Bifidobacterium angulatum* |
| SBP00090 | Pomegranate | *Bifidobacterium bifidum* |
| SBP00090 | Pomegranate | *Blastococcus saxobsidens* |
| SBP00090 | Pomegranate | *Blautia producta* |
| SBP00090 | Pomegranate | *Bordetella* genomosp. 8 |
| SBP00090 | Pomegranate | *Borrelia miyamotoi* |
| SBP00090 | Pomegranate | *Brachybacterium faecium* |
| SBP00090 | Pomegranate | *Brachybacterium ginsengisoli* |
| SBP00090 | Pomegranate | *Brachybacterium saurashtrense* |
| SBP00090 | Pomegranate | *Brachybacterium* sp. P6-10-X1 |
| SBP00090 | Pomegranate | *Brachybacterium* sp. VM2412 |
| SBP00090 | Pomegranate | *Brachybacterium* sp. VR2415 |
| SBP00090 | Pomegranate | *Bradyrhizobium erythrophlei* |
| SBP00090 | Pomegranate | *Bradyrhizobium oligotrophicum* |
| SBP00090 | Pomegranate | *Bradyrhizobium* sp. BTAi1 |
| SBP00090 | Pomegranate | *Bradyrhizobium* sp. CCBAU 51778 |
| SBP00090 | Pomegranate | *Bradyrhizobium* sp. ORS 285 |
| SBP00090 | Pomegranate | *Bradyrhizobium* sp. SK17 |
| SBP00090 | Pomegranate | *Brevibacillus agri* |
| SBP00090 | Pomegranate | *Brevibacillus brevis* |
| SBP00090 | Pomegranate | *Brevibacillus laterosporus* |

TABLE 3-continued

List of species identified in each metagenomic sample of each SBP Sample

| SBP ID | SBP Host Common Name | Genus sp. |
| --- | --- | --- |
| SBP00090 | Pomegranate | *Brevibacterium aurantiacum* |
| SBP00090 | Pomegranate | *Brevibacterium linens* |
| SBP00090 | Pomegranate | *Brevundimonas naejangsanensis* |
| SBP00090 | Pomegranate | *Burkholderia cenocepacia* |
| SBP00090 | Pomegranate | *Burkholderia cepacia* |
| SBP00090 | Pomegranate | *Burkholderia lata* |
| SBP00090 | Pomegranate | *Burkholderia pseudomallei* |
| SBP00090 | Pomegranate | *Burkholderia stabilis* |
| SBP00090 | Pomegranate | *Burkholderia territorii* |
| SBP00090 | Pomegranate | *Burkholderia ubonensis* |
| SBP00090 | Pomegranate | *Butyrivibrio hungatei* |
| SBP00090 | Pomegranate | *Caldicellulosiruptor saccharolyticus* |
| SBP00090 | Pomegranate | *Calothrix parasitica* |
| SBP00090 | Pomegranate | *Calothrix parietina* |
| SBP00090 | Pomegranate | *Calothrix* sp. 336/3 |
| SBP00090 | Pomegranate | *Calothrix* sp. NIES-2098 |
| SBP00090 | Pomegranate | *Calothrix* sp. NIES-2100 |
| SBP00090 | Pomegranate | *Calothrix* sp. NIES-3974 |
| SBP00090 | Pomegranate | *Calothrix* sp. PCC 7507 |
| SBP00090 | Pomegranate | *Campylobacter jejuni* |
| SBP00090 | Pomegranate | *Campylobacter lari* |
| SBP00090 | Pomegranate | *Campylobacter pinnipediorum* |
| SBP00090 | Pomegranate | *Campylobacter sputorum* |
| SBP00090 | Pomegranate | *Candidatus Atelocyanobacterium thalassa* |
| SBP00090 | Pomegranate | *Candidatus Azobacteroides pseudotrichonymphae* |
| SBP00090 | Pomegranate | *Candidatus Cloacimonas acidaminovorans* |
| SBP00090 | Pomegranate | *Candidatus Coxiella mudrowiae* |
| SBP00090 | Pomegranate | *Candidatus Dependentiae bacterium* (ex *Spumella elongata* CCAP 955/1) |
| SBP00090 | Pomegranate | *Candidatus Nitrosocaldus islandicus* |
| SBP00090 | Pomegranate | *Candidatus Nitrosocosmicus franklandus* |
| SBP00090 | Pomegranate | *Candidatus Nitrosoglobus terrae* |
| SBP00090 | Pomegranate | *Candidatus Pelagibacter* sp. RS40 |
| SBP00090 | Pomegranate | *Candidatus Puniceispirillum marinum* |
| SBP00090 | Pomegranate | *Candidatus Tachikawaea gelatinosa* |
| SBP00090 | Pomegranate | *Candidatus Thioglobus singularis* |
| SBP00090 | Pomegranate | *Capnocytophaga canimorsus* |
| SBP00090 | Pomegranate | *Capnocytophaga sputigena* |
| SBP00090 | Pomegranate | *Carnobacterium maltaromaticum* |
| SBP00090 | Pomegranate | *Catenovulum* sp. CCB-QB4 |
| SBP00090 | Pomegranate | *Catenulispora acidiphila* |
| SBP00090 | Pomegranate | *Celeribacter baekdonensis* |
| SBP00090 | Pomegranate | *Cellulophaga algicola* |
| SBP00090 | Pomegranate | *Cellulophaga baltica* |
| SBP00090 | Pomegranate | *Cellulophaga lytica* |
| SBP00090 | Pomegranate | *Cellvibrio* sp. PSBB006 |
| SBP00090 | Pomegranate | Cestrum yellow leaf curling virus |
| SBP00090 | Pomegranate | *Chlorobaculum limnaeum* |
| SBP00090 | Pomegranate | *Chondrocystis* sp. NIES-4102 |
| SBP00090 | Pomegranate | *Chryseobacterium arthrosphaerae* |
| SBP00090 | Pomegranate | *Chryseobacterium balustinum* |
| SBP00090 | Pomegranate | *Chryseobacterium bernardetii* |
| SBP00090 | Pomegranate | *Chryseobacterium carnipullorum* |
| SBP00090 | Pomegranate | *Chryseobacterium gallinarum* |
| SBP00090 | Pomegranate | *Chryseobacterium glaciei* |
| SBP00090 | Pomegranate | *Chryseobacterium gleum* |
| SBP00090 | Pomegranate | *Chryseobacterium haifense* |
| SBP00090 | Pomegranate | *Chryseobacterium indologenes* |
| SBP00090 | Pomegranate | *Chryseobacterium indoltheticum* |
| SBP00090 | Pomegranate | *Chryseobacterium joostei* |
| SBP00090 | Pomegranate | *Chryseobacterium lactis* |
| SBP00090 | Pomegranate | *Chryseobacterium nakagawai* |
| SBP00090 | Pomegranate | *Chryseobacterium* sp. 1751E7 |
| SBP00090 | Pomegranate | *Chryseobacterium* sp. G0201 |
| SBP00090 | Pomegranate | *Chryseobacterium* sp. IHB B 17019 |
| SBP00090 | Pomegranate | *Chryseobacterium taklimakanense* |
| SBP00090 | Pomegranate | *Chrysochromulina ericina* virus |
| SBP00090 | Pomegranate | Citrus yellow mosaic virus |
| SBP00090 | Pomegranate | *Clavibacter michiganensis* |
| SBP00090 | Pomegranate | *Cloacibacterium normanense* |
| SBP00090 | Pomegranate | *Clostridiaceae bacterium* 14S0207 |
| SBP00090 | Pomegranate | *Clostridioides difficile* |
| SBP00090 | Pomegranate | *Clostridium baratii* |
| SBP00090 | Pomegranate | *Clostridium beijerinckii* |
| SBP00090 | Pomegranate | *Clostridium bornimense* |
| SBP00090 | Pomegranate | *Clostridium

TABLE 3-continued

List of species identified in each metagenomic sample of each SBP Sample

| SBP ID | SBP Host Common Name | Genus sp. |
| --- | --- | --- |
| SBP00090 | Pomegranate | *Clostridium butyricum* |
| SBP00090 | Pomegranate | *Clostridium carboxidivorans* |
| SBP00090 | Pomegranate | *Clostridium chauvoei* |
| SBP00090 | Pomegranate | *Clostridium cochlearium* |
| SBP00090 | Pomegranate | *Clostridium estertheticum* |
| SBP00090 | Pomegranate | *Clostridium formicaceticum* |
| SBP00090 | Pomegranate | *Clostridium kluyveri* |
| SBP00090 | Pomegranate | *Clostridium pasteurianum* |
| SBP00090 | Pomegranate | *Clostridium perfringens* |
| SBP00090 | Pomegranate | *Clostridium saccharoperbutylacetonicum* |
| SBP00090 | Pomegranate | *Clostridium* sp. AWRP |
| SBP00090 | Pomegranate | *Clostridium* sp. BNL1100 |
| SBP00090 | Pomegranate | *Clostridium* sp. DL-VIII |
| SBP00090 | Pomegranate | *Clostridium tetani* |
| SBP00090 | Pomegranate | *Clostridium tyrobutyricum* |
| SBP00090 | Pomegranate | *Collimonas arenae* |
| SBP00090 | Pomegranate | *Collinsella aerofaciens* |
| SBP00090 | Pomegranate | *Colwellia* sp. PAMC 20917 |
| SBP00090 | Pomegranate | *Colwellia* sp. PAMC 21821 |
| SBP00090 | Pomegranate | *Corallococcus coralloides* |
| SBP00090 | Pomegranate | *Corynebacterium camporealensis* |
| SBP00090 | Pomegranate | *Corynebacterium casei* |
| SBP00090 | Pomegranate | *Corynebacterium frankenforstense* |
| SBP00090 | Pomegranate | *Corynebacterium glaucum* |
| SBP00090 | Pomegranate | *Corynebacterium glutamicum* |
| SBP00090 | Pomegranate | *Corynebacterium pelargi* |
| SBP00090 | Pomegranate | *Corynebacterium riegelii* |
| SBP00090 | Pomegranate | *Corynebacterium variabile* |
| SBP00090 | Pomegranate | *Corynebacterium vitaeruminis* |
| SBP00090 | Pomegranate | *Coxiella burnetii* |
| SBP00090 | Pomegranate | *Crinalium epipsammum* |
| SBP00090 | Pomegranate | *Cuniculiplasma divulgatum* |
| SBP00090 | Pomegranate | *Cupriavidus metallidurans* |
| SBP00090 | Pomegranate | *Cupriavidus necator* |
| SBP00090 | Pomegranate | *Cupriavidus pinatubonensis* |
| SBP00090 | Pomegranate | *Cupriavidus taiwanensis* |
| SBP00090 | Pomegranate | *Cutibacterium acnes* |
| SBP00090 | Pomegranate | *Cylindrospermum stagnale* |
| SBP00090 | Pomegranate | *Cytophaga hutchinsonii* |
| SBP00090 | Pomegranate | *Dactylococcopsis salina* |
| SBP00090 | Pomegranate | *Dehalobacterium formicoaceticum* |
| SBP00090 | Pomegranate | *Dehalococcoides mccartyi* |
| SBP00090 | Pomegranate | *Dehalogenimonas formicexedens* |
| SBP00090 | Pomegranate | *Delftia acidovorans* |
| SBP00090 | Pomegranate | *Delftia* sp. |
| SBP00090 | Pomegranate | *Desulfatibacillum aliphaticivorans* |
| SBP00090 | Pomegranate | *Desulfoglaeba alkanexedens* |
| SBP00090 | Pomegranate | *Desulfohalobium retbaense* |
| SBP00090 | Pomegranate | *Desulfotomaculum ferrireducens* |
| SBP00090 | Pomegranate | *Desulfurobacterium thermolithotrophum* |
| SBP00090 | Pomegranate | *Desulfuromonas soudanensis* |
| SBP00090 | Pomegranate | *Dickeya zeae* |
| SBP00090 | Pomegranate | *Diolcogaster facetosa bracovirus* |
| SBP00090 | Pomegranate | *Draconibacterium orientale* |
| SBP00090 | Pomegranate | *Dyadobacter fermentans* |
| SBP00090 | Pomegranate | *Dyella japonica* |
| SBP00090 | Pomegranate | *Edwardsiella tarda* |
| SBP00090 | Pomegranate | *Elizabethkingia anophelis* |
| SBP00090 | Pomegranate | *Emcibacter congregatus* |
| SBP00090 | Pomegranate | *Ensifer adhaerens* |
| SBP00090 | Pomegranate | *Enterobacter asburiae* |
| SBP00090 | Pomegranate | *Enterobacter bugandensis* |
| SBP00090 | Pomegranate | *Enterobacter cloacae* |
| SBP00090 | Pomegranate | *Enterobacter ludwigii* |
| SBP00090 | Pomegranate | *Enterobacter* sp. Crenshaw |
| SBP00090 | Pomegranate | *Enterococcus avium* |
| SBP00090 | Pomegranate | *Enterococcus faecalis* |
| SBP00090 | Pomegranate | *Enterococcus faecium* |
| SBP00090 | Pomegranate | *Enterococcus wangshanyuanii* |
| SBP00090 | Pomegranate | *Erythrobacter* sp. HKB08 |
| SBP00090 | Pomegranate | *Erythrobacter* sp. KY5 |
| SBP00090 | Pomegranate | *Escherichia albertii* |
| SBP00090 | Pomegranate | *Escherichia coli* |
| SBP00090 | Pomegranate | *Fibrella aestuarina* |
| SBP00090 | Pomegranate | *Fictibacillus phosphorivorans* |
| SBP00090 | Pomegranate | *Finegoldia magna* |

TABLE 3-continued

List of species identified in each metagenomic sample of each SBP Sample

| SBP ID | SBP Host Common Name | Genus sp. |
|---|---|---|
| SBP00090 | Pomegranate | *Fischerella* sp. NIES-4106 |
| SBP00090 | Pomegranate | *Flammeovirga* sp. L12M1 |
| SBP00090 | Pomegranate | *Flammeovirga* sp. MY04 |
| SBP00090 | Pomegranate | *Flavisolibacter tropicus* |
| SBP00090 | Pomegranate | *Flavivirga eckloniae* |
| SBP00090 | Pomegranate | *Flavobacteriaceae bacterium* |
| SBP00090 | Pomegranate | *Flavobacterium branchiophilum* |
| SBP00090 | Pomegranate | *Flavobacterium crocinum* |
| SBP00090 | Pomegranate | *Flavobacterium kingsejongi* |
| SBP00090 | Pomegranate | *Flavobacterium magnum* |
| SBP00090 | Pomegranate | *Formosa agariphila* |
| SBP00090 | Pomegranate | *Fusobacterium mortiferum* |
| SBP00090 | Pomegranate | *Fusobacterium necrophorum* |
| SBP00090 | Pomegranate | *Fusobacterium nucleatum* |
| SBP00090 | Pomegranate | *Fusobacterium periodonticum* |
| SBP00090 | Pomegranate | *Fusobacterium ulcerans* |
| SBP00090 | Pomegranate | *Fusobacterium varium* |
| SBP00090 | Pomegranate | Gammapapillomavirus 12 |
| SBP00090 | Pomegranate | *Geminocystis* sp. NIES-3709 |
| SBP00090 | Pomegranate | *Gemmata obscuriglobus* |
| SBP00090 | Pomegranate | *Gemmobacter* sp. HYN0069 |
| SBP00090 | Pomegranate | *Geobacter* sp. DSM 9736 |
| SBP00090 | Pomegranate | *Geobacter sulfurreducens* |
| SBP00090 | Pomegranate | *Geobacter uraniireducens* |
| SBP00090 | Pomegranate | *Gilliamella apicola* |
| SBP00090 | Pomegranate | *Glaciecola* sp. THG-3.7 |
| SBP00090 | Pomegranate | *Glaesserella parasuis* |
| SBP00090 | Pomegranate | *Gloeobacter kilaueensis* |
| SBP00090 | Pomegranate | *Gottschalkia acidurici* |
| SBP00090 | Pomegranate | *Gramella* sp. SH35 |
| SBP00090 | Pomegranate | *Granulosicoccus antarcticus* |
| SBP00090 | Pomegranate | *Haemophilus haemolyticus* |
| SBP00090 | Pomegranate | *Haemophilus influenzae* |
| SBP00090 | Pomegranate | *Hahella* sp. KA22 |
| SBP00090 | Pomegranate | *Halanaerobium hydrogeniformans* |
| SBP00090 | Pomegranate | *Halobacteriovorax* sp. BALOs_7 |
| SBP00090 | Pomegranate | *Halobacteroides halobius* |
| SBP00090 | Pomegranate | *Halomicronema hongdechloris* |
| SBP00090 | Pomegranate | *Halomonas* sp. GT |
| SBP00090 | Pomegranate | *Halomonas* sp. JS92-SW72 |
| SBP00090 | Pomegranate | *Halopiger xanaduensis* |
| SBP00090 | Pomegranate | *Haloterrigena daqingensis* |
| SBP00090 | Pomegranate | *Helicobacter cholecystus* |
| SBP00090 | Pomegranate | *Helicobacter felis* |
| SBP00090 | Pomegranate | *Helicobacter mustelae* |
| SBP00090 | Pomegranate | *Helicobacter pylori* |
| SBP00090 | Pomegranate | *Herbaspirillum seropedicae* |
| SBP00090 | Pomegranate | *Hoyosella subflava* |
| SBP00090 | Pomegranate | *Hungateiclostridium clariflavum* |
| SBP00090 | Pomegranate | *Hymenobacter* sp. APR13 |
| SBP00090 | Pomegranate | *Hymenobacter* sp. sh-6 |
| SBP00090 | Pomegranate | *Ignavibacterium album* |
| SBP00090 | Pomegranate | *Ignicoccus hospitalis* |
| SBP00090 | Pomegranate | *Janthinobacterium* sp. B9-8 |
| SBP00090 | Pomegranate | *Janthinobacterium svalbardensis* |
| SBP00090 | Pomegranate | *Kangiella sediminilitoris* |
| SBP00090 | Pomegranate | *Ketobacter alkanivorans* |
| SBP00090 | Pomegranate | *Kitasatospora setae* |
| SBP00090 | Pomegranate | *Klebsiella pneumoniae* |
| SBP00090 | Pomegranate | *Kluyvera intermedia* |
| SBP00090 | Pomegranate | *Kocuria rosea* |
| SBP00090 | Pomegranate | *Kordia* sp. SMS9 |
| SBP00090 | Pomegranate | *Kutzneria albida* |
| SBP00090 | Pomegranate | *Labrenzia aggregata* |
| SBP00090 | Pomegranate | *Lachnoclostridium phytofermentans* |
| SBP00090 | Pomegranate | *Lachnoclostridium* sp. YL32 |
| SBP00090 | Pomegranate | *Lacinutrix* sp. 5H-3-7-4 |
| SBP00090 | Pomegranate | *Lacinutrix venerupis* |
| SBP00090 | Pomegranate | *Lactobacillus animalis* |
| SBP00090 | Pomegranate | *Lactobacillus brevis* |
| SBP00090 | Pomegranate | *Lactobacillus curvatus* |
| SBP00090 | Pomegranate | *Lactobacillus delbrueckii* |
| SBP00090 | Pomegranate | *Lactobacillus helveticus* |
| SBP00090 | Pomegranate | *Lactobacillus johnsonii* |
| SBP00090 | Pomegranate | *Lactobacillus koreensis* |
| SBP00090 | Pomegranate | *Lactobacillus pentosus* |

TABLE 3-continued

List of species identified in each metagenomic sample of each SBP Sample

| SBP ID | SBP Host Common Name | Genus sp. |
|---|---|---|
| SBP00090 | Pomegranate | *Lactobacillus plantarum* |
| SBP00090 | Pomegranate | *Lactobacillus rhamnosus* |
| SBP00090 | Pomegranate | *Lactobacillus sakei* |
| SBP00090 | Pomegranate | *Lactobacillus salivarius* |
| SBP00090 | Pomegranate | *Lactococcus garvieae* |
| SBP00090 | Pomegranate | *Lactococcus lactis* |
| SBP00090 | Pomegranate | *Lactococcus phage* BK5-T |
| SBP00090 | Pomegranate | *Lactococcus phage* P335 sensu lato |
| SBP00090 | Pomegranate | *Lactococcus piscium* |
| SBP00090 | Pomegranate | *Lactococcus raffinolactis* |
| SBP00090 | Pomegranate | *Legionella cherrii* |
| SBP00090 | Pomegranate | *Legionella longbeachae* |
| SBP00090 | Pomegranate | *Legionella pneumophila* |
| SBP00090 | Pomegranate | *Leifsonia xyli* |
| SBP00090 | Pomegranate | *Lelliottia amnigena* |
| SBP00090 | Pomegranate | *Leptospira interrogans* |
| SBP00090 | Pomegranate | *Leptospira kmetyi* |
| SBP00090 | Pomegranate | *Leuconostoc carnosum* |
| SBP00090 | Pomegranate | *Leuconostoc citreum* |
| SBP00090 | Pomegranate | *Leuconostoc kimchii* |
| SBP00090 | Pomegranate | *Leuconostoc mesenteroides* |
| SBP00090 | Pomegranate | *Litorilituus sediminis* |
| SBP00090 | Pomegranate | *Lutibacter profundi* |
| SBP00090 | Pomegranate | *Lutibacter* sp. LPB0138 |
| SBP00090 | Pomegranate | *Lysinibacillus sphaericus* |
| SBP00090 | Pomegranate | *Lysobacter enzymogenes* |
| SBP00090 | Pomegranate | *Magnetospira* sp. QH-2 |
| SBP00090 | Pomegranate | *Marinobacter salarius* |
| SBP00090 | Pomegranate | *Marinobacter* sp. Arc7-DN-1 |
| SBP00090 | Pomegranate | *Massilia putida* |
| SBP00090 | Pomegranate | *Melittangium boletus* |
| SBP00090 | Pomegranate | *Mesoplasma florum* |
| SBP00090 | Pomegranate | *Mesorhizobium amorphae* |
| SBP00090 | Pomegranate | *Mesorhizobium* sp. DCY119 |
| SBP00090 | Pomegranate | *Methanobrevibacter* sp. AbM4 |
| SBP00090 | Pomegranate | *Methanocella paludicola* |
| SBP00090 | Pomegranate | *Methanococcus maripaludis* |
| SBP00090 | Pomegranate | *Methanosarcina barkeri* |
| SBP00090 | Pomegranate | *Methanosarcina horonobensis* |
| SBP00090 | Pomegranate | *Methanosarcina mazei* |
| SBP00090 | Pomegranate | *Methanosarcina* sp. Kolksee |
| SBP00090 | Pomegranate | *Methanosphaera stadtmanae* |
| SBP00090 | Pomegranate | *Methanothrix soehngenii* |
| SBP00090 | Pomegranate | *Methanotorris igneus* |
| SBP00090 | Pomegranate | *Methylobacterium brachiatum* |
| SBP00090 | Pomegranate | *Methylomonas methanica* |
| SBP00090 | Pomegranate | *Methylophilus* sp. TWE2 |
| SBP00090 | Pomegranate | *Microbacterium* sp. No. 7 |
| SBP00090 | Pomegranate | *Microcystis aeruginosa* |
| SBP00090 | Pomegranate | *Micromonospora rifamycinica* |
| SBP00090 | Pomegranate | *Moorea producens* |
| SBP00090 | Pomegranate | *Moraxella bovis* |
| SBP00090 | Pomegranate | *Moraxella osloensis* |
| SBP00090 | Pomegranate | *Moritella yayanosii* |
| SBP00090 | Pomegranate | *Mucilaginibacter gotjawali* |
| SBP00090 | Pomegranate | *Mucilaginibacter mallensis* |
| SBP00090 | Pomegranate | *Mycobacterium* sp. YC-RL4 |
| SBP00090 | Pomegranate | *Mycolicibacterium hassiacum* |
| SBP00090 | Pomegranate | *Mycolicibacterium smegmatis* |
| SBP00090 | Pomegranate | *Mycoplasma bovigenitalium* |
| SBP00090 | Pomegranate | *Mycoplasma hominis* |
| SBP00090 | Pomegranate | *Myxococcus macrosporus* |
| SBP00090 | Pomegranate | *Myxococcus stipitatus* |
| SBP00090 | Pomegranate | *Myxococcus xanthus* |
| SBP00090 | Pomegranate | *Natranaerobius thermophilus* |
| SBP00090 | Pomegranate | *Natrialba magadii* |
| SBP00090 | Pomegranate | *Neisseria meningitidis* |
| SBP00090 | Pomegranate | *Neodiprion lecontei* nucleopolyhedrovirus |
| SBP00090 | Pomegranate | *Niabella ginsenosidivorans* |
| SBP00090 | Pomegranate | *Niastella koreensis* |
| SBP00090 | Pomegranate | *Nitrosococcus halophilus* |
| SBP00090 | Pomegranate | *Nitrosococcus wardiae* |
| SBP00090 | Pomegranate | *Nocardia cyriacigeorgica* |
| SBP00090 | Pomegranate | *Nocardia* sp. CFHS0054 |
| SBP00090 | Pomegranate | *Nonlabens* sp. MB-3u-79 |
| SBP00090 | Pomegranate | *Nonlabens* sp. MJ115 |

TABLE 3-continued

List of species identified in each metagenomic sample of each SBP Sample

| SBP ID | SBP Host Common Name | Genus sp. |
|---|---|---|
| SBP00090 | Pomegranate | *Nonomuraea* sp. ATCC 55076 |
| SBP00090 | Pomegranate | *Nostoc carneum* |
| SBP00090 | Pomegranate | *Nostoc flagelliforme* |
| SBP00090 | Pomegranate | *Nostoc punctiforme* |
| SBP00090 | Pomegranate | *Nostoc* sp. CENA543 |
| SBP00090 | Pomegranate | *Nostoc* sp. PCC 7107 |
| SBP00090 | Pomegranate | *Novibacillus thermophilus* |
| SBP00090 | Pomegranate | *Oceanobacillus* sp. 160 |
| SBP00090 | Pomegranate | *Ochrobactrum anthropi* |
| SBP00090 | Pomegranate | *Ochrobactrum* sp. A44 |
| SBP00090 | Pomegranate | *Oenococcus* sp. UCMA 16435 |
| SBP00090 | Pomegranate | *Oscillibacter valericigenes* |
| SBP00090 | Pomegranate | *Paenibacillus baekrokdamisoli* |
| SBP00090 | Pomegranate | *Paenibacillus bovis* |
| SBP00090 | Pomegranate | *Paenibacillus durus* |
| SBP00090 | Pomegranate | *Paenibacillus glucanolyticus* |
| SBP00090 | Pomegranate | *Paenibacillus graminis* |
| SBP00090 | Pomegranate | *Paenibacillus lentus* |
| SBP00090 | Pomegranate | *Paenibacillus odorifer* |
| SBP00090 | Pomegranate | *Paenibacillus polymyxa* |
| SBP00090 | Pomegranate | *Paenibacillus riograndensis* |
| SBP00090 | Pomegranate | *Paenibacillus* sp. FSL H7-0357 |
| SBP00090 | Pomegranate | *Paenibacillus* sp. RUD330 |
| SBP00090 | Pomegranate | *Pantoea agglomerans* |
| SBP00090 | Pomegranate | *Pantoea ananatis* |
| SBP00090 | Pomegranate | *Pantoea vagans* |
| SBP00090 | Pomegranate | *Paraburkholderia caribensis* |
| SBP00090 | Pomegranate | *Paraburkholderia fungorum* |
| SBP00090 | Pomegranate | *Paraburkholderia phymatum* |
| SBP00090 | Pomegranate | *Paraburkholderia xenovorans* |
| SBP00090 | Pomegranate | *Paracoccus* sp. BM15 |
| SBP00090 | Pomegranate | *Paraglaciecola psychrophila* |
| SBP00090 | Pomegranate | *Paraphotobacterium marinum* |
| SBP00090 | Pomegranate | *Paraprevotella xylaniphila* |
| SBP00090 | Pomegranate | *Pasteurella multocida* |
| SBP00090 | Pomegranate | Peanut chlorotic streak virus |
| SBP00090 | Pomegranate | *Pedobacter cryoconitis* |
| SBP00090 | Pomegranate | *Pedobacter steynii* |
| SBP00090 | Pomegranate | *Pelosinus fermentans* |
| SBP00090 | Pomegranate | *Pelosinus* sp. UFO1 |
| SBP00090 | Pomegranate | *Persephonella marina* |
| SBP00090 | Pomegranate | *Persicobacter* sp. JZB09 |
| SBP00090 | Pomegranate | *Phenylobacterium zucineum* |
| SBP00090 | Pomegranate | *Photobacterium profundum* |
| SBP00090 | Pomegranate | *Phyllobacterium zundukense* |
| SBP00090 | Pomegranate | *Pimelobacter simplex* |
| SBP00090 | Pomegranate | *Piscirickettsia salmonis* |
| SBP00090 | Pomegranate | *Planctomyces* sp. SH-PL14 |
| SBP00090 | Pomegranate | *Planctopirus limnophila* |
| SBP00090 | Pomegranate | *Planktothrix agardhii* |
| SBP00090 | Pomegranate | *Plautia stali* |
| SBP00090 | Pomegranate | *Plesiomonas shigelloides* |
| SBP00090 | Pomegranate | *Pleurocapsa minor* |
| SBP00090 | Pomegranate | *Polaribacter* sp. ALD11 |
| SBP00090 | Pomegranate | *Polaribacter* sp. Hel1_33_78 |
| SBP00090 | Pomegranate | *Polaribacter* sp. SA4-10 |
| SBP00090 | Pomegranate | *Polaribacter vadi* |
| SBP00090 | Pomegranate | *Polynucleobacter asymbioticus* |
| SBP00090 | Pomegranate | *Polynucleobacter necessarius* |
| SBP00090 | Pomegranate | *Prauserella marina* |
| SBP00090 | Pomegranate | *Prevotella dentalis* |
| SBP00090 | Pomegranate | *Prevotella fusca* |
| SBP00090 | Pomegranate | *Prochlorococcus marinus* |
| SBP00090 | Pomegranate | *Prochlorococcus* sp. MIT 0604 |
| SBP00090 | Pomegranate | *Propionibacterium acidifaciens* |
| SBP00090 | Pomegranate | *Proteus mirabilis* |
| SBP00090 | Pomegranate | *Proteus* phage pPM_01 |
| SBP00090 | Pomegranate | *Providencia heimbachae* |
| SBP00090 | Pomegranate | *Providencia rettgeri* |
| SBP00090 | Pomegranate | *Pseudanabaena* sp. ABRGS-3 |
| SBP00090 | Pomegranate | *Pseudanabaena* sp. PCC 7367 |
| SBP00090 | Pomegranate | *Pseudoalteromonas luteoviolacea* |
| SBP00090 | Pomegranate | *Pseudoalteromonas phenolica* |
| SBP00090 | Pomegranate | *Pseudoalteromonas* sp. R3 |
| SBP00090 | Pomegranate | *Pseudomonas aeruginosa* |
| SBP00090 | Pomegranate | *Pseudomonas brassicacearum* |

TABLE 3-continued

List of species identified in each metagenomic sample of each SBP Sample

| SBP ID | SBP Host Common Name | Genus sp. |
|---|---|---|
| SBP00090 | Pomegranate | *Pseudomonas chlororaphis* |
| SBP00090 | Pomegranate | *Pseudomonas cichorii* |
| SBP00090 | Pomegranate | *Pseudomonas citronellolis* |
| SBP00090 | Pomegranate | *Pseudomonas entomophila* |
| SBP00090 | Pomegranate | *Pseudomonas fluorescens* |
| SBP00090 | Pomegranate | *Pseudomonas knackmussii* |
| SBP00090 | Pomegranate | *Pseudomonas koreensis* |
| SBP00090 | Pomegranate | *Pseudomonas moraviensis* |
| SBP00090 | Pomegranate | *Pseudomonas poae* |
| SBP00090 | Pomegranate | *Pseudomonas putida* |
| SBP00090 | Pomegranate | *Pseudomonas sp.* |
| SBP00090 | Pomegranate | *Pseudomonas sp.* HLS-6 |
| SBP00090 | Pomegranate | *Pseudomonas sp.* K2W31S-8 |
| SBP00090 | Pomegranate | *Pseudomonas sp.* QZS01 |
| SBP00090 | Pomegranate | *Pseudomonas stutzeri* |
| SBP00090 | Pomegranate | *Pseudomonas syringae* |
| SBP00090 | Pomegranate | *Pseudomonas viridiflava* |
| SBP00090 | Pomegranate | *Pseudomonas xanthomarina* |
| SBP00090 | Pomegranate | *Pseudothermotoga thermarum* |
| SBP00090 | Pomegranate | *Pseudoxanthomonas suwonensis* |
| SBP00090 | Pomegranate | *Ralstonia insidiosa* |
| SBP00090 | Pomegranate | *Ralstonia mannitolilytica* |
| SBP00090 | Pomegranate | *Ralstonia pickettii* |
| SBP00090 | Pomegranate | *Ralstonia solanacearum* |
| SBP00090 | Pomegranate | *Raoultella ornithinolytica* |
| SBP00090 | Pomegranate | *Rathayibacter rathayi* |
| SBP00090 | Pomegranate | *Rhizobacter gummiphilus* |
| SBP00090 | Pomegranate | *Rhizobium etli* |
| SBP00090 | Pomegranate | *Rhizobium favelukesii* |
| SBP00090 | Pomegranate | *Rhizobium leguminosarum* |
| SBP00090 | Pomegranate | *Rhizobium sp.* NXC24 |
| SBP00090 | Pomegranate | *Rhodobacter sphaeroides* |
| SBP00090 | Pomegranate | *Rhodococcus erythropolis* |
| SBP00090 | Pomegranate | *Rhodococcus fascians* |
| SBP00090 | Pomegranate | *Rhodococcus opacus* |
| SBP00090 | Pomegranate | *Rhodoferax saidenbachensis* |
| SBP00090 | Pomegranate | *Rhodoplanes sp.* Z2-YC6860 |
| SBP00090 | Pomegranate | *Rhodopseudomonas palustris* |
| SBP00090 | Pomegranate | *Rhodothermus marinus* |
| SBP00090 | Pomegranate | *Riemerella anatipestifer* |
| SBP00090 | Pomegranate | *Rivularia sp.* PCC 7116 |
| SBP00090 | Pomegranate | *Runella sp.* HYN0085 |
| SBP00090 | Pomegranate | *Runella sp.* SP2 |
| SBP00090 | Pomegranate | *Saccharolobus solfataricus* |
| SBP00090 | Pomegranate | *Saccharomonospora viridis* |
| SBP00090 | Pomegranate | *Salinimonas sp.* HMF8227 |
| SBP00090 | Pomegranate | *Salmonella enterica* |
| SBP00090 | Pomegranate | *Scytonema sp.* HK-05 |
| SBP00090 | Pomegranate | *Serratia fonticola* |
| SBP00090 | Pomegranate | *Serratia marcescens* |
| SBP00090 | Pomegranate | *Shewanella baltica* |
| SBP00090 | Pomegranate | *Shewanella piezotolerans* |
| SBP00090 | Pomegranate | *Shewanella psychrophila* |
| SBP00090 | Pomegranate | *Shewanella sp.* TH2012 |
| SBP00090 | Pomegranate | *Siansivirga zeaxanthinifaciens* |
| SBP00090 | Pomegranate | *Sinorhizobium meliloti* |
| SBP00090 | Pomegranate | *Snodgrassella alvi* |
| SBP00090 | Pomegranate | *Solitalea canadensis* |
| SBP00090 | Pomegranate | *Sorangium cellulosum* |
| SBP00090 | Pomegranate | *Sphingobacterium daejeonense* |
| SBP00090 | Pomegranate | *Sphingobacterium mizutaii* |
| SBP00090 | Pomegranate | *Sphingobium cloacae* |
| SBP00090 | Pomegranate | *Sphingomonas sp.* FARSPH |
| SBP00090 | Pomegranate | *Sphingomonas sp.* LM7 |
| SBP00090 | Pomegranate | *Sphingopyxis granuli* |
| SBP00090 | Pomegranate | *Sphingopyxis sp.* EG6 |
| SBP00090 | Pomegranate | *Sphingorhabdus sp.* Alg231-15 |
| SBP00090 | Pomegranate | *Spirosoma aerolatum* |
| SBP00090 | Pomegranate | *Spirosoma radiotolerans* |
| SBP00090 | Pomegranate | *Sporosarcina psychrophila* |
| SBP00090 | Pomegranate | *Sporosarcina ureae* |
| SBP00090 | Pomegranate | *Stanieria sp.* NIES-3757 |
| SBP00090 | Pomegranate | *Staphylococcus agnetis* |
| SBP00090 | Pomegranate | *Staphylococcus aureus* |
| SBP00090 | Pomegranate | *Staphylococcus epidermidis* |
| SBP00090 | Pomegranate | *Staphylococcus equorum* |

TABLE 3-continued

List of species identified in each metagenomic sample of each SBP Sample

| SBP ID | SBP Host Common Name | Genus sp. |
|---|---|---|
| SBP00090 | Pomegranate | *Staphylococcus hominis* |
| SBP00090 | Pomegranate | *Staphylococcus hyicus* |
| SBP00090 | Pomegranate | *Staphylococcus nepalensis* |
| SBP00090 | Pomegranate | *Staphylococcus schleiferi* |
| SBP00090 | Pomegranate | *Staphylococcus simiae* |
| SBP00090 | Pomegranate | *Staphylococcus simulans* |
| SBP00090 | Pomegranate | *Staphylococcus xylosus* |
| SBP00090 | Pomegranate | *Stella humosa* |
| SBP00090 | Pomegranate | *Stenotrophomonas maltophilia* |
| SBP00090 | Pomegranate | *Stenotrophomonas sp.* |
| SBP00090 | Pomegranate | *Streptobacillus moniliformis* |
| SBP00090 | Pomegranate | *Streptococcus equi* |
| SBP00090 | Pomegranate | *Streptococcus iniae* |
| SBP00090 | Pomegranate | *Streptococcus macedonicus* |
| SBP00090 | Pomegranate | *Streptococcus parauberis* |
| SBP00090 | Pomegranate | *Streptococcus pneumoniae* |
| SBP00090 | Pomegranate | *Streptococcus porcinus* |
| SBP00090 | Pomegranate | *Streptococcus pyogenes* |
| SBP00090 | Pomegranate | *Streptococcus* sp. FDAARGOS_192 |
| SBP00090 | Pomegranate | *Streptococcus* sp. HSISM1 |
| SBP00090 | Pomegranate | *Streptococcus suis* |
| SBP00090 | Pomegranate | *Streptococcus thermophilus* |
| SBP00090 | Pomegranate | *Streptococcus urinalis* |
| SBP00090 | Pomegranate | *Streptomyces formicae* |
| SBP00090 | Pomegranate | *Streptomyces hygroscopicus* |
| SBP00090 | Pomegranate | *Streptomyces luteoverticillatus* |
| SBP00090 | Pomegranate | *Streptomyces lydicus* |
| SBP00090 | Pomegranate | *Streptomyces niveus* |
| SBP00090 | Pomegranate | *Streptomyces pristinaespiralis* |
| SBP00090 | Pomegranate | *Streptomyces qaidamensis* |
| SBP00090 | Pomegranate | *Streptomyces* sp. 2323.1 |
| SBP00090 | Pomegranate | *Streptomyces* sp. M2 |
| SBP00090 | Pomegranate | *Streptomyces* sp. MK45 |
| SBP00090 | Pomegranate | *Streptomyces* sp. WAC 01438 |
| SBP00090 | Pomegranate | *Streptomyces venezuelae* |
| SBP00090 | Pomegranate | *Streptosporangium roseum* |
| SBP00090 | Pomegranate | *Sulfitobacter* sp. D7 |
| SBP00090 | Pomegranate | *Sulfolobus acidocaldarius* |
| SBP00090 | Pomegranate | *Sulfurihydrogenibium* sp. YO3AOP1 |
| SBP00090 | Pomegranate | *Synechococcus* sp. JA-3-3Ab |
| SBP00090 | Pomegranate | *Synechococcus* sp. KORDI-49 |
| SBP00090 | Pomegranate | *Synechococcus* sp. KORDI-52 |
| SBP00090 | Pomegranate | *Synechococcus* sp. PCC 7002 |
| SBP00090 | Pomegranate | *Synechococcus* sp. PCC 7502 |
| SBP00090 | Pomegranate | *Syntrophobotulus glycolicus* |
| SBP00090 | Pomegranate | *Tannerella* sp. oral taxon HOT-286 |
| SBP00090 | Pomegranate | *Tenacibaculum dicentrarchi* |
| SBP00090 | Pomegranate | *Tenacibaculum mesophilum* |
| SBP00090 | Pomegranate | *Tepidanaerobacter acetatoxydans* |
| SBP00090 | Pomegranate | *Thalassolituus oleivorans* |
| SBP00090 | Pomegranate | *Thermoanaerobacterium thermosaccharolyticum* |
| SBP00090 | Pomegranate | *Thermobifida fusca* |
| SBP00090 | Pomegranate | *Thermoclostridium stercorarium* |
| SBP00090 | Pomegranate | *Thermococcus profundus* |
| SBP00090 | Pomegranate | *Thermodesulfobium acidiphilum* |
| SBP00090 | Pomegranate | *Thermus* sp. YIM 78456 |
| SBP00090 | Pomegranate | *Thioalkalivibrio versutus* |
| SBP00090 | Pomegranate | *Treponema denticola* |
| SBP00090 | Pomegranate | *Trichodesmium erythraeum* |
| SBP00090 | Pomegranate | *Trichormus variabilis* |
| SBP00090 | Pomegranate | *Tumebacillus avium* |
| SBP00090 | Pomegranate | *Undibacterium parvum* |
| SBP00090 | Pomegranate | *Ureaplasma urealyticum* |
| SBP00090 | Pomegranate | *Vagococcus penaei* |
| SBP00090 | Pomegranate | *Variovorax paradoxus* |
| SBP00090 | Pomegranate | *Veillonella rodentium* |
| SBP00090 | Pomegranate | *Verrucomicrobium* sp. GAS474 |
| SBP00090 | Pomegranate | *Vibrio anguillarum* |
| SBP00090 | Pomegranate | *Vibrio campbellii* |
| SBP00090 | Pomegranate | *Vibrio coralliilyticus* |
| SBP00090 | Pomegranate | *Vibrio diabolicus* |
| SBP00090 | Pomegranate | *Vibrio fluvialis* |
| SBP00090 | Pomegranate | *Vibrio nigripulchritudo* |
| SBP00090 | Pomegranate | *Vibrio parahaemolyticus* |
| SBP00090 | Pomegranate | *Vibrio tapetis* |
| SBP00090 | Pomegranate | *Vibrio vulnificus* |

TABLE 3-continued

List of species identified in each metagenomic sample of each SBP Sample

| SBP ID | SBP Host Common Name | Genus sp. |
|---|---|---|
| SBP00090 | Pomegranate | *Virgibacillus halodenitrificans* |
| SBP00090 | Pomegranate | *Virgibacillus phasianinus* |
| SBP00090 | Pomegranate | *Virgibacillus* sp. Bac330 |
| SBP00090 | Pomegranate | *Virgibacillus* sp. SK37 |
| SBP00090 | Pomegranate | *Vogesella* sp. LIG4 |
| SBP00090 | Pomegranate | *Weissella cibaria* |
| SBP00090 | Pomegranate | *Weissella koreensis* |
| SBP00090 | Pomegranate | *Weissella paramesenteroides* |
| SBP00090 | Pomegranate | *Winogradskyella* sp. RHA_55 |
| SBP00090 | Pomegranate | *Xanthomonas campestris* |
| SBP00090 | Pomegranate | *Xanthomonas citri* |
| SBP00090 | Pomegranate | *Xanthomonas vesicatoria* |
| SBP00090 | Pomegranate | *Xenorhabdus bovienii* |
| SBP00090 | Pomegranate | *Xenorhabdus poinarii* |
| SBP00090 | Pomegranate | *Yersinia enterocolitica* |
| SBP00090 | Pomegranate | *Yersinia similis* |
| SBP00090 | Pomegranate | *Zhongshania aliphaticivorans* |
| SBP00090 | Pomegranate | *Zymobacter palmae* |
| SBP00091 | Fermented Tomatoes | *Acidovorax* sp. 1608163 |
| SBP00091 | Fermented Tomatoes | *Acidovorax* sp. 1608163 |
| SBP00091 | Fermented Tomatoes | *Acinetobacter oleivorans* |
| SBP00091 | Fermented Tomatoes | *Acinetobacter oleivorans* |
| SBP00091 | Fermented Tomatoes | *Acinetobacter radioresistens* |
| SBP00091 | Fermented Tomatoes | *Acinetobacter radioresistens* |
| SBP00091 | Fermented Tomatoes | *Alistipes shahii* |
| SBP00091 | Fermented Tomatoes | *Alistipes shahii* |
| SBP00091 | Fermented Tomatoes | *Altererythrobacter* sp. ZODW24 |
| SBP00091 | Fermented Tomatoes | *Altererythrobacter* sp. ZODW24 |
| SBP00091 | Fermented Tomatoes | *Bacillus aryabhattai* |
| SBP00091 | Fermented Tomatoes | *Bacillus aryabhattai* |
| SBP00091 | Fermented Tomatoes | *Bacillus cereus* |
| SBP00091 | Fermented Tomatoes | *Bacillus cereus* |
| SBP00091 | Fermented Tomatoes | *Bacillus paralicheniformis* |
| SBP00091 | Fermented Tomatoes | *Bacillus paralicheniformis* |
| SBP00091 | Fermented Tomatoes | *Bacillus pumilus* |
| SBP00091 | Fermented Tomatoes | *Bacillus pumilus* |
| SBP00091 | Fermented Tomatoes | *Bacteroides uniformis* |
| SBP00091 | Fermented Tomatoes | *Bacteroides uniformis* |
| SBP00091 | Fermented Tomatoes | *Bartonella vinsonii* |
| SBP00091 | Fermented Tomatoes | *Bartonella vinsonii* |
| SBP00091 | Fermented Tomatoes | *Bathymodiolus thermophilus thioautotrophic gill* symbiont |
| SBP00091 | Fermented Tomatoes | *Bathymodiolus thermophilus thioautotrophic gill* symbiont |
| SBP00091 | Fermented Tomatoes | *Bradyrhizobium* sp. BTAi1 |
| SBP00091 | Fermented Tomatoes | *Bradyrhizobium* sp. BTAi1 |
| SBP00091 | Fermented Tomatoes | *Bradyrhizobium* sp. SK17 |
| SBP00091 | Fermented Tomatoes | *Bradyrhizobium* sp. SK17 |
| SBP00091 | Fermented Tomatoes | *Burkholderia* sp. OLGA172 |
| SBP00091 | Fermented Tomatoes | *Burkholderia* sp. OLGA172 |
| SBP00091 | Fermented Tomatoes | *Calothrix brevissima* |
| SBP00091 | Fermented Tomatoes | *Calothrix brevissima* |
| SBP00091 | Fermented Tomatoes | *Candidatus Nitrosocaldus islandicus* |
| SBP00091 | Fermented Tomatoes | *Candidatus Nitrosocaldus islandicus* |
| SBP00091 | Fermented Tomatoes | *Candidatus Protochlamydia amoebophila* |
| SBP00091 | Fermented Tomatoes | *Candidatus Protochlamydia amoebophila* |
| SBP00091 | Fermented Tomatoes | *Candidatus Rickettsiella viridis* |
| SBP00091 | Fermented Tomatoes | *Candidatus Rickettsiella viridis* |
| SBP00091 | Fermented Tomatoes | *Candidatus Tachikawaea gelatinosa* |
| SBP00091 | Fermented Tomatoes | *Candidatus Tachikawaea gelatinosa* |
| SBP00091 | Fermented Tomatoes | *Capnocytophaga haemolytica* |
| SBP00091 | Fermented Tomatoes | *Capnocytophaga haemolytica* |
| SBP00091 | Fermented Tomatoes | *Cellvibrio japonicus* |
| SBP00091 | Fermented Tomatoes | *Cellvibrio japonicus* |
| SBP00091 | Fermented Tomatoes | *Chromohalobacter salexigens* |
| SBP00091 | Fermented Tomatoes | *Chromohalobacter salexigens* |
| SBP00091 | Fermented Tomatoes | *Citrobacter koseri* |
| SBP00091 | Fermented Tomatoes | *Citrobacter koseri* |
| SBP00091 | Fermented Tomatoes | *Cloacibacillus porcorum* |
| SBP00091 | Fermented Tomatoes | *Cloacibacillus porcorum* |
| SBP00091 | Fermented Tomatoes | *Clostridium* sp. DL-VIII |
| SBP00091 | Fermented Tomatoes | *Clostridium* sp. DL-VIII |
| SBP00091 | Fermented Tomatoes | *Cutibacterium acnes* |
| SBP00091 | Fermented Tomatoes | *Cutibacterium acnes* |
| SBP00091 | Fermented Tomatoes | *Dolichospermum compactum* |
| SBP00091 | Fermented Tomatoes | *Dolichospermum compactum* |
| SBP00091 | Fermented Tomatoes | *Ehrlichia ruminantium* |
| SBP00091 | Fermented Tomatoes | *Ehrlichia ruminantium* |

TABLE 3-continued

List of species identified in each metagenomic sample of each SBP Sample

| SBP ID | SBP Host Common Name | Genus sp. |
|---|---|---|
| SBP00091 | Fermented Tomatoes | *Enterobacter cloacae* |
| SBP00091 | Fermented Tomatoes | *Enterobacter cloacae* |
| SBP00091 | Fermented Tomatoes | *Enterobacter cloacae* complex sp. |
| SBP00091 | Fermented Tomatoes | *Enterobacter cloacae* complex sp. |
| SBP00091 | Fermented Tomatoes | *Enterobacter hormaechei* |
| SBP00091 | Fermented Tomatoes | *Enterobacter hormaechei* |
| SBP00091 | Fermented Tomatoes | *Enterobacter ludwigii* |
| SBP00091 | Fermented Tomatoes | *Enterobacter ludwigii* |
| SBP00091 | Fermented Tomatoes | *Enterococcus wangshanyuanii* |
| SBP00091 | Fermented Tomatoes | *Enterococcus wangshanyuanii* |
| SBP00091 | Fermented Tomatoes | *Ereboglobus luteus* |
| SBP00091 | Fermented Tomatoes | *Ereboglobus luteus* |
| SBP00091 | Fermented Tomatoes | *Erythrobacter atlanticus* |
| SBP00091 | Fermented Tomatoes | *Erythrobacter atlanticus* |
| SBP00091 | Fermented Tomatoes | *Escherichia coli* |
| SBP00091 | Fermented Tomatoes | *Escherichia coli* |
| SBP00091 | Fermented Tomatoes | *Flammeovirgaceae bacterium* 311 |
| SBP00091 | Fermented Tomatoes | *Flammeovirgaceae bacterium* 311 |
| SBP00091 | Fermented Tomatoes | *Geobacter daltonii* |
| SBP00091 | Fermented Tomatoes | *Geobacter daltonii* |
| SBP00091 | Fermented Tomatoes | *Janthinobacterium svalbardensis* |
| SBP00091 | Fermented Tomatoes | *Janthinobacterium svalbardensis* |
| SBP00091 | Fermented Tomatoes | *Kangiella sediminilitoris* |
| SBP00091 | Fermented Tomatoes | *Kangiella sediminilitoris* |
| SBP00091 | Fermented Tomatoes | *Klebsiella oxytoca* |
| SBP00091 | Fermented Tomatoes | *Klebsiella oxytoca* |
| SBP00091 | Fermented Tomatoes | *Klebsiella pneumoniae* |
| SBP00091 | Fermented Tomatoes | *Klebsiella pneumoniae* |
| SBP00091 | Fermented Tomatoes | *Kluyvera intermedia* |
| SBP00091 | Fermented Tomatoes | *Kluyvera intermedia* |
| SBP00091 | Fermented Tomatoes | *Lactobacillus acidophilus* |
| SBP00091 | Fermented Tomatoes | *Lactobacillus acidophilus* |
| SBP00091 | Fermented Tomatoes | *Lactobacillus brevis* |
| SBP00091 | Fermented Tomatoes | *Lactobacillus brevis* |
| SBP00091 | Fermented Tomatoes | *Lactobacillus coryniformis* |
| SBP00091 | Fermented Tomatoes | *Lactobacillus coryniformis* |
| SBP00091 | Fermented Tomatoes | *Lactobacillus crispatus* |
| SBP00091 | Fermented Tomatoes | *Lactobacillus crispatus* |
| SBP00091 | Fermented Tomatoes | *Lactobacillus crustorum* |
| SBP00091 | Fermented Tomatoes | *Lactobacillus crustorum* |
| SBP00091 | Fermented Tomatoes | *Lactobacillus curvatus* |
| SBP00091 | Fermented Tomatoes | *Lactobacillus curvatus* |
| SBP00091 | Fermented Tomatoes | *Lactobacillus fermentum* |
| SBP00091 | Fermented Tomatoes | *Lactobacillus fermentum* |
| SBP00091 | Fermented Tomatoes | *Lactobacillus gallinarum* |
| SBP00091 | Fermented Tomatoes | *Lactobacillus gallinarum* |
| SBP00091 | Fermented Tomatoes | *Lactobacillus helveticus* |
| SBP00091 | Fermented Tomatoes | *Lactobacillus helveticus* |
| SBP00091 | Fermented Tomatoes | *Lactobacillus johnsonii* |
| SBP00091 | Fermented Tomatoes | *Lactobacillus johnsonii* |
| SBP00091 | Fermented Tomatoes | *Lactobacillus kefiranofaciens* |
| SBP00091 | Fermented Tomatoes | *Lactobacillus kefiranofaciens* |
| SBP00091 | Fermented Tomatoes | *Lactobacillus koreensis* |
| SBP00091 | Fermented Tomatoes | *Lactobacillus koreensis* |
| SBP00091 | Fermented Tomatoes | *Lactobacillus plantarum* |
| SBP00091 | Fermented Tomatoes | *Lactobacillus plantarum* |
| SBP00091 | Fermented Tomatoes | *Lactobacillus sakei* |
| SBP00091 | Fermented Tomatoes | *Lactobacillus sakei* |
| SBP00091 | Fermented Tomatoes | *Lactococcus lactis* |
| SBP00091 | Fermented Tomatoes | *Lactococcus lactis* |
| SBP00091 | Fermented Tomatoes | *Lactococcus piscium* |
| SBP00091 | Fermented Tomatoes | *Lactococcus piscium* |
| SBP00091 | Fermented Tomatoes | *Legionella cherrii* |
| SBP00091 | Fermented Tomatoes | *Legionella cherrii* |
| SBP00091 | Fermented Tomatoes | *Legionella pneumophila* |
| SBP00091 | Fermented Tomatoes | *Legionella pneumophila* |
| SBP00091 | Fermented Tomatoes | *Lelliottia amnigena* |
| SBP00091 | Fermented Tomatoes | *Lelliottia amnigena* |
| SBP00091 | Fermented Tomatoes | *Leminorella richardii* |
| SBP00091 | Fermented Tomatoes | *Leminorella richardii* |
| SBP00091 | Fermented Tomatoes | *Leucania separata* nucleopolyhedrovirus |
| SBP00091 | Fermented Tomatoes | *Leucania separata* nucleopolyhedrovirus |
| SBP00091 | Fermented Tomatoes | *Leuconostoc carnosum* |
| SBP00091 | Fermented Tomatoes | *Leuconostoc carnosum* |
| SBP00091 | Fermented Tomatoes | *Leuconostoc citreum* |
| SBP00091 | Fermented Tomatoes | *Leuconostoc citreum* |

TABLE 3-continued

List of species identified in each metagenomic sample of each SBP Sample

| SBP ID | SBP Host Common Name | Genus sp. |
| --- | --- | --- |
| SBP00091 | Fermented Tomatoes | *Leuconostoc garlicum* |
| SBP00091 | Fermented Tomatoes | *Leuconostoc garlicum* |
| SBP00091 | Fermented Tomatoes | *Leuconostoc gelidum* |
| SBP00091 | Fermented Tomatoes | *Leuconostoc gelidum* |
| SBP00091 | Fermented Tomatoes | *Leuconostoc kimchii* |
| SBP00091 | Fermented Tomatoes | *Leuconostoc kimchii* |
| SBP00091 | Fermented Tomatoes | *Leuconostoc lactis* |
| SBP00091 | Fermented Tomatoes | *Leuconostoc lactis* |
| SBP00091 | Fermented Tomatoes | *Leuconostoc mesenteroides* |
| SBP00091 | Fermented Tomatoes | *Leuconostoc mesenteroides* |
| SBP00091 | Fermented Tomatoes | *Leuconostoc suionicum* |
| SBP00091 | Fermented Tomatoes | *Leuconostoc suionicum* |
| SBP00091 | Fermented Tomatoes | *Lysobacter enzymogenes* |
| SBP00091 | Fermented Tomatoes | *Lysobacter enzymogenes* |
| SBP00091 | Fermented Tomatoes | *Magnetococcus marinus* |
| SBP00091 | Fermented Tomatoes | *Magnetococcus marinus* |
| SBP00091 | Fermented Tomatoes | *Methylomonas koyamae* |
| SBP00091 | Fermented Tomatoes | *Methylomonas koyamae* |
| SBP00091 | Fermented Tomatoes | *Moraxella osloensis* |
| SBP00091 | Fermented Tomatoes | *Moraxella osloensis* |
| SBP00091 | Fermented Tomatoes | *Musca* hytrovirus |
| SBP00091 | Fermented Tomatoes | *Musca* hytrovirus |
| SBP00091 | Fermented Tomatoes | *Mycoplasma dispar* |
| SBP00091 | Fermented Tomatoes | *Mycoplasma dispar* |
| SBP00091 | Fermented Tomatoes | *Nitrososphaera viennensis* |
| SBP00091 | Fermented Tomatoes | *Nitrososphaera viennensis* |
| SBP00091 | Fermented Tomatoes | *Nonlabens* sp. MJ115 |
| SBP00091 | Fermented Tomatoes | *Nonlabens* sp. MJ115 |
| SBP00091 | Fermented Tomatoes | *Nostoc sphaeroides* |
| SBP00091 | Fermented Tomatoes | *Nostoc sphaeroides* |
| SBP00091 | Fermented Tomatoes | *Octadecabacter arcticus* |
| SBP00091 | Fermented Tomatoes | *Octadecabacter arcticus* |
| SBP00091 | Fermented Tomatoes | *Pandoravirus inopinatum* |
| SBP00091 | Fermented Tomatoes | *Pandoravirus inopinatum* |
| SBP00091 | Fermented Tomatoes | *Pandoravirus neocaledonia* |
| SBP00091 | Fermented Tomatoes | *Pandoravirus neocaledonia* |
| SBP00091 | Fermented Tomatoes | *Pandoravirus salinus* |
| SBP00091 | Fermented Tomatoes | *Pandoravirus salinus* |
| SBP00091 | Fermented Tomatoes | *Pantoea agglomerans* |
| SBP00091 | Fermented Tomatoes | *Pantoea agglomerans* |
| SBP00091 | Fermented Tomatoes | *Pantoea ananatis* |
| SBP00091 | Fermented Tomatoes | *Pantoea ananatis* |
| SBP00091 | Fermented Tomatoes | *Pasteurella multocida* |
| SBP00091 | Fermented Tomatoes | *Pasteurella multocida* |
| SBP00091 | Fermented Tomatoes | *Pediococcus claussenii* |
| SBP00091 | Fermented Tomatoes | *Pediococcus claussenii* |
| SBP00091 | Fermented Tomatoes | *Pediococcus pentosaceus* |
| SBP00091 | Fermented Tomatoes | *Pediococcus pentosaceus* |
| SBP00091 | Fermented Tomatoes | *Peridroma alphabaculovirus* |
| SBP00091 | Fermented Tomatoes | *Peridroma alphabaculovirus* |
| SBP00091 | Fermented Tomatoes | *Photobacterium damselae* |
| SBP00091 | Fermented Tomatoes | *Photobacterium damselae* |
| SBP00091 | Fermented Tomatoes | *Piscirickettsia salmonis* |
| SBP00091 | Fermented Tomatoes | *Piscirickettsia salmonis* |
| SBP00091 | Fermented Tomatoes | *Plautia stali* |
| SBP00091 | Fermented Tomatoes | *Plautia stali* |
| SBP00091 | Fermented Tomatoes | *Polaribacter* sp. KT25b |
| SBP00091 | Fermented Tomatoes | *Polaribacter* sp. KT25b |
| SBP00091 | Fermented Tomatoes | *Porphyrobacter* HT-58-2 |
| SBP00091 | Fermented Tomatoes | *Porphyrobacter* HT-58-2 |
| SBP00091 | Fermented Tomatoes | *Proteus mirabilis* |
| SBP00091 | Fermented Tomatoes | *Proteus mirabilis* |
| SBP00091 | Fermented Tomatoes | *Pseudomonas fluorescens* |
| SBP00091 | Fermented Tomatoes | *Pseudomonas fluorescens* |
| SBP00091 | Fermented Tomatoes | *Pseudomonas poae* |
| SBP00091 | Fermented Tomatoes | *Pseudomonas poae* |
| SBP00091 | Fermented Tomatoes | *Pseudomonas protegens* |
| SBP00091 | Fermented Tomatoes | *Pseudomonas protegens* |
| SBP00091 | Fermented Tomatoes | *Pseudomonas putida* |
| SBP00091 | Fermented Tomatoes | *Pseudomonas putida* |
| SBP00091 | Fermented Tomatoes | *Pseudomonas* sp. |
| SBP00091 | Fermented Tomatoes | *Pseudomonas* sp. |
| SBP00091 | Fermented Tomatoes | *Pseudomonas trivialis* |
| SBP00091 | Fermented Tomatoes | *Pseudomonas trivialis* |
| SBP00091 | Fermented Tomatoes | *Ralstonia insidiosa* |
| SBP00091 | Fermented Tomatoes | *Ralstonia insidiosa* |

TABLE 3-continued

List of species identified in each metagenomic sample of each SBP Sample

| SBP ID | SBP Host Common Name | Genus sp. |
|---|---|---|
| SBP00091 | Fermented Tomatoes | *Ralstonia mannitolilytica* |
| SBP00091 | Fermented Tomatoes | *Ralstonia mannitolilytica* |
| SBP00091 | Fermented Tomatoes | *Ralstonia pickettii* |
| SBP00091 | Fermented Tomatoes | *Ralstonia pickettii* |
| SBP00091 | Fermented Tomatoes | *Ralstonia solanacearum* |
| SBP00091 | Fermented Tomatoes | *Ralstonia solanacearum* |
| SBP00091 | Fermented Tomatoes | *Rhizobium tropici* |
| SBP00091 | Fermented Tomatoes | *Rhizobium tropici* |
| SBP00091 | Fermented Tomatoes | *Rhodococcus fascians* |
| SBP00091 | Fermented Tomatoes | *Rhodococcus fascians* |
| SBP00091 | Fermented Tomatoes | *Rhodoplanes* sp. Z2-YC6860 |
| SBP00091 | Fermented Tomatoes | *Rhodoplanes* sp. Z2-YC6860 |
| SBP00091 | Fermented Tomatoes | *Rufibacter* sp. DG15C |
| SBP00091 | Fermented Tomatoes | *Rufibacter* sp. DG15C |
| SBP00091 | Fermented Tomatoes | *Salinicola tamaricis* |
| SBP00091 | Fermented Tomatoes | *Salinicola tamaricis* |
| SBP00091 | Fermented Tomatoes | *Salinivibrio kushneri* |
| SBP00091 | Fermented Tomatoes | *Salinivibrio kushneri* |
| SBP00091 | Fermented Tomatoes | *Serratia marcescens* |
| SBP00091 | Fermented Tomatoes | *Serratia marcescens* |
| SBP00091 | Fermented Tomatoes | *Sinorhizobium americanum* |
| SBP00091 | Fermented Tomatoes | *Sinorhizobium americanum* |
| SBP00091 | Fermented Tomatoes | *Sinorhizobium fredii* |
| SBP00091 | Fermented Tomatoes | *Sinorhizobium fredii* |
| SBP00091 | Fermented Tomatoes | *Sinorhizobium* sp. CCBAU 05631 |
| SBP00091 | Fermented Tomatoes | *Sinorhizobium* sp. CCBAU 05631 |
| SBP00091 | Fermented Tomatoes | *Staphylococcus kloosii* |
| SBP00091 | Fermented Tomatoes | *Staphylococcus kloosii* |
| SBP00091 | Fermented Tomatoes | *Staphylococcus simiae* |
| SBP00091 | Fermented Tomatoes | *Staphylococcus simiae* |
| SBP00091 | Fermented Tomatoes | *Staphylococcus succinus* |
| SBP00091 | Fermented Tomatoes | *Staphylococcus succinus* |
| SBP00091 | Fermented Tomatoes | *Staphylococcus xylosus* |
| SBP00091 | Fermented Tomatoes | *Staphylococcus xylosus* |
| SBP00091 | Fermented Tomatoes | *Stenotrophomonas maltophilia* |
| SBP00091 | Fermented Tomatoes | *Stenotrophomonas maltophilia* |
| SBP00091 | Fermented Tomatoes | *Stenotrophomonas* sp. |
| SBP00091 | Fermented Tomatoes | *Stenotrophomonas* sp. |
| SBP00091 | Fermented Tomatoes | *Stenotrophomonas* sp. ESTM1D_MKCIP4_1 |
| SBP00091 | Fermented Tomatoes | *Stenotrophomonas* sp. ESTM1D_MKCIP4_1 |
| SBP00091 | Fermented Tomatoes | *Stenotrophomonas* sp. G4 |
| SBP00091 | Fermented Tomatoes | *Stenotrophomonas* sp. G4 |
| SBP00091 | Fermented Tomatoes | *Stenotrophomonas* sp. MYb57 |
| SBP00091 | Fermented Tomatoes | *Stenotrophomonas* sp. MYb57 |
| SBP00091 | Fermented Tomatoes | *Streptococcus pyogenes* |
| SBP00091 | Fermented Tomatoes | *Streptococcus pyogenes* |
| SBP00091 | Fermented Tomatoes | *Streptococcus suis* |
| SBP00091 | Fermented Tomatoes | *Streptococcus suis* |
| SBP00091 | Fermented Tomatoes | *Streptococcus thermophilus* |
| SBP00091 | Fermented Tomatoes | *Streptococcus thermophilus* |
| SBP00091 | Fermented Tomatoes | *Streptomyces griseus* |
| SBP00091 | Fermented Tomatoes | *Streptomyces griseus* |
| SBP00091 | Fermented Tomatoes | *Synechococcus* sp. RCC307 |
| SBP00091 | Fermented Tomatoes | *Synechococcus* sp. RCC307 |
| SBP00091 | Fermented Tomatoes | *Tenacibaculum dicentrarchi* |
| SBP00091 | Fermented Tomatoes | *Tenacibaculum dicentrarchi* |
| SBP00091 | Fermented Tomatoes | *Tetragenococcus halophilus* |
| SBP00091 | Fermented Tomatoes | *Tetragenococcus halophilus* |
| SBP00091 | Fermented Tomatoes | *Thalassococcus* sp. S3 |
| SBP00091 | Fermented Tomatoes | *Thalassococcus* sp. S3 |
| SBP00091 | Fermented Tomatoes | *Thermococcus chitonophagus* |
| SBP00091 | Fermented Tomatoes | *Thermococcus chitonophagus* |
| SBP00091 | Fermented Tomatoes | Tobacco vein clearing virus |
| SBP00091 | Fermented Tomatoes | Tobacco vein clearing virus |
| SBP00091 | Fermented Tomatoes | *Treponema primitia* |
| SBP00091 | Fermented Tomatoes | *Treponema primitia* |
| SBP00091 | Fermented Tomatoes | *Vibrio parahaemolyticus* |
| SBP00091 | Fermented Tomatoes | *Vibrio parahaemolyticus* |
| SBP00091 | Fermented Tomatoes | *Virgibacillus phasianinus* |
| SBP00091 | Fermented Tomatoes | *Virgibacillus phasianinus* |
| SBP00091 | Fermented Tomatoes | *Weissella ceti* |
| SBP00091 | Fermented Tomatoes | *Weissella ceti* |
| SBP00091 | Fermented Tomatoes | *Weissella cibaria* |
| SBP00091 | Fermented Tomatoes | *Weissella cibaria* |
| SBP00091 | Fermented Tomatoes | *Weissella confusa* |
| SBP00091 | Fermented Tomatoes | *Weissella confusa* |

TABLE 3-continued

List of species identified in each metagenomic sample of each SBP Sample

| SBP ID | SBP Host Common Name | Genus sp. |
|---|---|---|
| SBP00091 | Fermented Tomatoes | *Weissella hellenica* |
| SBP00091 | Fermented Tomatoes | *Weissella hellenica* |
| SBP00091 | Fermented Tomatoes | *Weissella koreensis* |
| SBP00091 | Fermented Tomatoes | *Weissella koreensis* |
| SBP00091 | Fermented Tomatoes | *Weissella paramesenteroides* |
| SBP00091 | Fermented Tomatoes | *Weissella paramesenteroides* |
| SBP00091 | Fermented Tomatoes | *Weissella viridescens* |
| SBP00091 | Fermented Tomatoes | *Weissella viridescens* |
| SBP00091 | Fermented Tomatoes | *Zymobacter palmae* |
| SBP00091 | Fermented Tomatoes | *Zymobacter palmae* |
| SBP00092 | Kimchi | [*Enterobacter*] *lignolyticus* |
| SBP00092 | Kimchi | [*Enterobacter*] *lignolyticus* |
| SBP00092 | Kimchi | [*Polyangium*] *brachysporum* |
| SBP00092 | Kimchi | [*Polyangium*] *brachysporum* |
| SBP00092 | Kimchi | [*Pseudomonas*] *mesoacidophila* |
| SBP00092 | Kimchi | [*Pseudomonas*] *mesoacidophila* |
| SBP00092 | Kimchi | *Acetobacter aceti* |
| SBP00092 | Kimchi | *Acetobacter aceti* |
| SBP00092 | Kimchi | *Achromobacter denitrificans* |
| SBP00092 | Kimchi | *Achromobacter denitrificans* |
| SBP00092 | Kimchi | *Achromobacter insolitus* |
| SBP00092 | Kimchi | *Achromobacter insolitus* |
| SBP00092 | Kimchi | *Achromobacter* sp. AONIH1 |
| SBP00092 | Kimchi | *Achromobacter* sp. AONIH1 |
| SBP00092 | Kimchi | *Achromobacter* sp. B7 |
| SBP00092 | Kimchi | *Achromobacter* sp. B7 |
| SBP00092 | Kimchi | *Achromobacter* sp. MFA1 R4 |
| SBP00092 | Kimchi | *Achromobacter* sp. MFA1 R4 |
| SBP00092 | Kimchi | *Achromobacter spanius* |
| SBP00092 | Kimchi | *Achromobacter spanius* |
| SBP00092 | Kimchi | *Achromobacter xylosoxidans* |
| SBP00092 | Kimchi | *Achromobacter xylosoxidans* |
| SBP00092 | Kimchi | *Acidihalobacter prosperus* |
| SBP00092 | Kimchi | *Acidihalobacter prosperus* |
| SBP00092 | Kimchi | *Acidipropionibacterium acidipropionici* |
| SBP00092 | Kimchi | *Acidipropionibacterium acidipropionici* |
| SBP00092 | Kimchi | *Acidisphaera* sp. G45-3 |
| SBP00092 | Kimchi | *Acidisphaera* sp. G45-3 |
| SBP00092 | Kimchi | *Acidovorax avenae* |
| SBP00092 | Kimchi | *Acidovorax avenae* |
| SBP00092 | Kimchi | *Acidovorax carolinensis* |
| SBP00092 | Kimchi | *Acidovorax carolinensis* |
| SBP00092 | Kimchi | *Acidovorax cattleyae* |
| SBP00092 | Kimchi | *Acidovorax cattleyae* |
| SBP00092 | Kimchi | *Acidovorax citrulli* |
| SBP00092 | Kimchi | *Acidovorax citrulli* |
| SBP00092 | Kimchi | *Acidovorax ebreus* |
| SBP00092 | Kimchi | *Acidovorax ebreus* |
| SBP00092 | Kimchi | *Acidovorax* sp. 1608163 |
| SBP00092 | Kimchi | *Acidovorax* sp. 1608163 |
| SBP00092 | Kimchi | *Acidovorax* sp. JS42 |
| SBP00092 | Kimchi | *Acidovorax* sp. JS42 |
| SBP00092 | Kimchi | *Acidovorax* sp. KKS102 |
| SBP00092 | Kimchi | *Acidovorax* sp. KKS102 |
| SBP00092 | Kimchi | *Acidovorax* sp. RAC01 |
| SBP00092 | Kimchi | *Acidovorax* sp. RAC01 |
| SBP00092 | Kimchi | *Acidovorax* sp. T1 |
| SBP00092 | Kimchi | *Acidovorax* sp. T1 |
| SBP00092 | Kimchi | *Acinetobacter baumannii* |
| SBP00092 | Kimchi | *Acinetobacter baumannii* |
| SBP00092 | Kimchi | *Acinetobacter calcoaceticus* |
| SBP00092 | Kimchi | *Acinetobacter calcoaceticus* |
| SBP00092 | Kimchi | *Acinetobacter haemolyticus* |
| SBP00092 | Kimchi | *Acinetobacter haemolyticus* |
| SBP00092 | Kimchi | *Acinetobacter johnsonii* |
| SBP00092 | Kimchi | *Acinetobacter johnsonii* |
| SBP00092 | Kimchi | *Acinetobacter junii* |
| SBP00092 | Kimchi | *Acinetobacter junii* |
| SBP00092 | Kimchi | *Acinetobacter lwoffii* |
| SBP00092 | Kimchi | *Acinetobacter lwoffii* |
| SBP00092 | Kimchi | *Acinetobacter pittii* |
| SBP00092 | Kimchi | *Acinetobacter pittii* |
| SBP00092 | Kimchi | *Acinetobacter radioresistens* |
| SBP00092 | Kimchi | *Acinetobacter radioresistens* |
| SBP00092 | Kimchi | *Acinetobacter* sp. ACNIH2 |
| SBP00092 | Kimchi | *Acinetobacter* sp. ACNIH2 |

TABLE 3-continued

List of species identified in each metagenomic sample of each SBP Sample

| SBP ID | SBP Host Common Name | Genus sp. |
|---|---|---|
| SBP00092 | Kimchi | *Acinetobacter* sp. TTH0-4 |
| SBP00092 | Kimchi | *Acinetobacter* sp. TTH0-4 |
| SBP00092 | Kimchi | *Acinetobacter* sp. WCHAc010034 |
| SBP00092 | Kimchi | *Acinetobacter* sp. WCHAc010034 |
| SBP00092 | Kimchi | *Acinetobacter* sp. WCHAc060092 |
| SBP00092 | Kimchi | *Acinetobacter* sp. WCHAc060092 |
| SBP00092 | Kimchi | *Acinetobacter ursingii* |
| SBP00092 | Kimchi | *Acinetobacter ursingii* |
| SBP00092 | Kimchi | *Actinoalloteichus* sp. AHMU CJ021 |
| SBP00092 | Kimchi | *Actinoalloteichus* sp. AHMU CJ021 |
| SBP00092 | Kimchi | *Actinomyces radicidentis* |
| SBP00092 | Kimchi | *Actinomyces radicidentis* |
| SBP00092 | Kimchi | *Actinoplanes derwentensis* |
| SBP00092 | Kimchi | *Actinoplanes derwentensis* |
| SBP00092 | Kimchi | *Actinoplanes friuliensis* |
| SBP00092 | Kimchi | *Actinoplanes friuliensis* |
| SBP00092 | Kimchi | *Actinoplanes missouriensis* |
| SBP00092 | Kimchi | *Actinoplanes missouriensis* |
| SBP00092 | Kimchi | *Actinoplanes* sp. N902-109 |
| SBP00092 | Kimchi | *Actinoplanes* sp. N902-109 |
| SBP00092 | Kimchi | *Actinoplanes* sp. OR16 |
| SBP00092 | Kimchi | *Actinoplanes* sp. OR16 |
| SBP00092 | Kimchi | *Actinoplanes teichomyceticus* |
| SBP00092 | Kimchi | *Actinoplanes teichomyceticus* |
| SBP00092 | Kimchi | *Advenella kashmirensis* |
| SBP00092 | Kimchi | *Advenella kashmirensis* |
| SBP00092 | Kimchi | *Advenella mimigardefordensis* |
| SBP00092 | Kimchi | *Advenella mimigardefordensis* |
| SBP00092 | Kimchi | *Aerococcus viridans* |
| SBP00092 | Kimchi | *Aerococcus viridans* |
| SBP00092 | Kimchi | *Aeromicrobium choanae* |
| SBP00092 | Kimchi | *Aeromicrobium choanae* |
| SBP00092 | Kimchi | *Aeromicrobium erythreum* |
| SBP00092 | Kimchi | *Aeromicrobium erythreum* |
| SBP00092 | Kimchi | *Aeromicrobium marinum* |
| SBP00092 | Kimchi | *Aeromicrobium marinum* |
| SBP00092 | Kimchi | *Aeromicrobium* sp. 592 |
| SBP00092 | Kimchi | *Aeromicrobium* sp. 592 |
| SBP00092 | Kimchi | *Aeromicrobium* sp. A1-2 |
| SBP00092 | Kimchi | *Aeromicrobium* sp. A1-2 |
| SBP00092 | Kimchi | *Aeromonas caviae* |
| SBP00092 | Kimchi | *Aeromonas caviae* |
| SBP00092 | Kimchi | *Aeromonas hydrophila* |
| SBP00092 | Kimchi | *Aeromonas hydrophila* |
| SBP00092 | Kimchi | *Aeromonas media* |
| SBP00092 | Kimchi | *Aeromonas media* |
| SBP00092 | Kimchi | *Aeromonas rivipollensis* |
| SBP00092 | Kimchi | *Aeromonas rivipollensis* |
| SBP00092 | Kimchi | *Aeromonas salmonicida* |
| SBP00092 | Kimchi | *Aeromonas salmonicida* |
| SBP00092 | Kimchi | *Aeromonas* sp. |
| SBP00092 | Kimchi | *Aeromonas* sp. |
| SBP00092 | Kimchi | *Aeromonas* sp. CU5 |
| SBP00092 | Kimchi | *Aeromonas* sp. CU5 |
| SBP00092 | Kimchi | *Aeromonas veronii* |
| SBP00092 | Kimchi | *Aeromonas veronii* |
| SBP00092 | Kimchi | *Afipia* sp. GAS231 |
| SBP00092 | Kimchi | *Afipia* sp. GAS231 |
| SBP00092 | Kimchi | *Agrobacterium fabrum* |
| SBP00092 | Kimchi | *Agrobacterium fabrum* |
| SBP00092 | Kimchi | *Agrobacterium larrymoorei* |
| SBP00092 | Kimchi | *Agrobacterium larrymoorei* |
| SBP00092 | Kimchi | *Agrobacterium rhizogenes* |
| SBP00092 | Kimchi | *Agrobacterium rhizogenes* |
| SBP00092 | Kimchi | *Agrobacterium* sp. |
| SBP00092 | Kimchi | *Agrobacterium* sp. |
| SBP00092 | Kimchi | *Agrobacterium* sp. 33MFTa1.1 |
| SBP00092 | Kimchi | *Agrobacterium* sp. 33MFTa1.1 |
| SBP00092 | Kimchi | *Agrobacterium* sp. H13-3 |
| SBP00092 | Kimchi | *Agrobacterium* sp. H13-3 |
| SBP00092 | Kimchi | *Agrobacterium* sp. RAC06 |
| SBP00092 | Kimchi | *Agrobacterium* sp. RAC06 |
| SBP00092 | Kimchi | *Agrobacterium tumefaciens* |
| SBP00092 | Kimchi | *Agrobacterium tumefaciens* |
| SBP00092 | Kimchi | *Agrobacterium vitis* |
| SBP00092 | Kimchi | *Agrobacterium vitis* |

TABLE 3-continued

List of species identified in each metagenomic sample of each SBP Sample

| SBP ID | SBP Host Common Name | Genus sp. |
|---|---|---|
| SBP00092 | Kimchi | *Agrococcus carbonis* |
| SBP00092 | Kimchi | *Agrococcus carbonis* |
| SBP00092 | Kimchi | *Agrococcus jejuensis* |
| SBP00092 | Kimchi | *Agrococcus jejuensis* |
| SBP00092 | Kimchi | *Agrococcus* sp. SGAir0287 |
| SBP00092 | Kimchi | *Agrococcus* sp. SGAir0287 |
| SBP00092 | Kimchi | *Agromyces aureus* |
| SBP00092 | Kimchi | *Agromyces aureus* |
| SBP00092 | Kimchi | *Agromyces flavus* |
| SBP00092 | Kimchi | *Agromyces flavus* |
| SBP00092 | Kimchi | *Agromyces* sp. 30A |
| SBP00092 | Kimchi | *Agromyces* sp. 30A |
| SBP00092 | Kimchi | *Agromyces* sp. LHK192 |
| SBP00092 | Kimchi | *Agromyces* sp. LHK192 |
| SBP00092 | Kimchi | *Alcaligenes faecalis* |
| SBP00092 | Kimchi | *Alcaligenes faecalis* |
| SBP00092 | Kimchi | *Alcanivorax* sp. N3-2A |
| SBP00092 | Kimchi | *Alcanivorax* sp. N3-2A |
| SBP00092 | Kimchi | *Algibacter alginicilyticus* |
| SBP00092 | Kimchi | *Algibacter alginicilyticus* |
| SBP00092 | Kimchi | *Alicycliphilus denitrificans* |
| SBP00092 | Kimchi | *Alicycliphilus denitrificans* |
| SBP00092 | Kimchi | *Alloactinosynnema* sp. L-07 |
| SBP00092 | Kimchi | *Alloactinosynnema* sp. L-07 |
| SBP00092 | Kimchi | *Allokutzneria albata* |
| SBP00092 | Kimchi | *Allokutzneria albata* |
| SBP00092 | Kimchi | *Alphaproteobacteria bacterium* WS11 |
| SBP00092 | Kimchi | *Alphaproteobacteria bacterium* WS11 |
| SBP00092 | Kimchi | *Altererythrobacter atlanticus* |
| SBP00092 | Kimchi | *Altererythrobacter atlanticus* |
| SBP00092 | Kimchi | *Altererythrobacter dongtanensis* |
| SBP00092 | Kimchi | *Altererythrobacter dongtanensis* |
| SBP00092 | Kimchi | *Altererythrobacter mangrovi* |
| SBP00092 | Kimchi | *Altererythrobacter mangrovi* |
| SBP00092 | Kimchi | *Altererythrobacter namhicola* |
| SBP00092 | Kimchi | *Altererythrobacter namhicola* |
| SBP00092 | Kimchi | *Altererythrobacter* sp. B11 |
| SBP00092 | Kimchi | *Altererythrobacter* sp. B11 |
| SBP00092 | Kimchi | *Altererythrobacter* sp. NS1 |
| SBP00092 | Kimchi | *Altererythrobacter* sp. NS1 |
| SBP00092 | Kimchi | *Aminobacter aminovorans* |
| SBP00092 | Kimchi | *Aminobacter aminovorans* |
| SBP00092 | Kimchi | *Aminobacter* sp. MSH1 |
| SBP00092 | Kimchi | *Aminobacter* sp. MSH1 |
| SBP00092 | Kimchi | *Amycolatopsis keratiniphila* |
| SBP00092 | Kimchi | *Amycolatopsis keratiniphila* |
| SBP00092 | Kimchi | *Amycolatopsis mediterranei* |
| SBP00092 | Kimchi | *Amycolatopsis mediterranei* |
| SBP00092 | Kimchi | *Amycolatopsis methanolica* |
| SBP00092 | Kimchi | *Amycolatopsis methanolica* |
| SBP00092 | Kimchi | *Amycolatopsis orientalis* |
| SBP00092 | Kimchi | *Amycolatopsis orientalis* |
| SBP00092 | Kimchi | *Amycolatopsis* sp. BJA-103 |
| SBP00092 | Kimchi | *Amycolatopsis* sp. BJA-103 |
| SBP00092 | Kimchi | *Anaeromyxobacter* sp. Fw109-5 |
| SBP00092 | Kimchi | *Anaeromyxobacter* sp. Fw109-5 |
| SBP00092 | Kimchi | *Anderseniella* sp. Alg231-50 |
| SBP00092 | Kimchi | *Anderseniella* sp. Alg231-50 |
| SBP00092 | Kimchi | *Aquabacterium olei* |
| SBP00092 | Kimchi | *Aquabacterium olei* |
| SBP00092 | Kimchi | *Aquitalea magnusonii* |
| SBP00092 | Kimchi | *Aquitalea magnusonii* |
| SBP00092 | Kimchi | *Archangium gephyra* |
| SBP00092 | Kimchi | *Archangium gephyra* |
| SBP00092 | Kimchi | *Arcobacter cryaerophilus* |
| SBP00092 | Kimchi | *Arcobacter cryaerophilus* |
| SBP00092 | Kimchi | *Arcobacter trophiarum* |
| SBP00092 | Kimchi | *Arcobacter trophiarum* |
| SBP00092 | Kimchi | *Aromatoleum aromaticum* |
| SBP00092 | Kimchi | *Aromatoleum aromaticum* |
| SBP00092 | Kimchi | *Arsenicicoccus* sp. oral taxon 190 |
| SBP00092 | Kimchi | *Arsenicicoccus* sp. oral taxon 190 |
| SBP00092 | Kimchi | *Arthrobacter alpinus* |
| SBP00092 | Kimchi | *Arthrobacter alpinus* |
| SBP00092 | Kimchi | *Arthrobacter* sp. FB24 |
| SBP00092 | Kimchi | *Arthrobacter* sp. FB24 |

TABLE 3-continued

List of species identified in each metagenomic sample of each SBP Sample

| SBP ID | SBP Host Common Name | Genus sp. |
|---|---|---|
| SBP00092 | Kimchi | *Arthrobacter* sp. PGP41 |
| SBP00092 | Kimchi | *Arthrobacter* sp. PGP41 |
| SBP00092 | Kimchi | *Arthrobacter* sp. QXT-31 |
| SBP00092 | Kimchi | *Arthrobacter* sp. QXT-31 |
| SBP00092 | Kimchi | *Arthrobacter* sp. U41 |
| SBP00092 | Kimchi | *Arthrobacter* sp. U41 |
| SBP00092 | Kimchi | *Arthrobacter* sp. YC-RL1 |
| SBP00092 | Kimchi | *Arthrobacter* sp. YC-RL1 |
| SBP00092 | Kimchi | *Arthrobacter* sp. YN |
| SBP00092 | Kimchi | *Arthrobacter* sp. YN |
| SBP00092 | Kimchi | *Asticcacaulis excentricus* |
| SBP00092 | Kimchi | *Asticcacaulis excentricus* |
| SBP00092 | Kimchi | *Atlantibacter hermannii* |
| SBP00092 | Kimchi | *Atlantibacter hermannii* |
| SBP00092 | Kimchi | *Auraticoccus monumenti* |
| SBP00092 | Kimchi | *Auraticoccus monumenti* |
| SBP00092 | Kimchi | *Aureimonas* sp. AU20 |
| SBP00092 | Kimchi | *Aureimonas* sp. AU20 |
| SBP00092 | Kimchi | *Azoarcus communis* |
| SBP00092 | Kimchi | *Azoarcus communis* |
| SBP00092 | Kimchi | *Azoarcus* sp. CIB |
| SBP00092 | Kimchi | *Azoarcus* sp. CIB |
| SBP00092 | Kimchi | *Azoarcus* sp. DN11 |
| SBP00092 | Kimchi | *Azoarcus* sp. DN11 |
| SBP00092 | Kimchi | *Azoarcus* sp. KH32C |
| SBP00092 | Kimchi | *Azoarcus* sp. KH32C |
| SBP00092 | Kimchi | *Azoarcus* sp. SY39 |
| SBP00092 | Kimchi | *Azoarcus* sp. SY39 |
| SBP00092 | Kimchi | *Azorhizobium caulinodans* |
| SBP00092 | Kimchi | *Azorhizobium caulinodans* |
| SBP00092 | Kimchi | *Azospira oryzae* |
| SBP00092 | Kimchi | *Azospira oryzae* |
| SBP00092 | Kimchi | *Azospirillum brasilense* |
| SBP00092 | Kimchi | *Azospirillum brasilense* |
| SBP00092 | Kimchi | *Azospirillum lipoferum* |
| SBP00092 | Kimchi | *Azospirillum lipoferum* |
| SBP00092 | Kimchi | *Azospirillum* sp. CFH 70021 |
| SBP00092 | Kimchi | *Azospirillum* sp. CFH 70021 |
| SBP00092 | Kimchi | *Azospirillum* sp. M2T2B2 |
| SBP00092 | Kimchi | *Azospirillum* sp. M2T2B2 |
| SBP00092 | Kimchi | *Azospirillum* sp. TSA2s |
| SBP00092 | Kimchi | *Azospirillum* sp. TSA2s |
| SBP00092 | Kimchi | *Azospirillum* sp. TSH100 |
| SBP00092 | Kimchi | *Azospirillum* sp. TSH100 |
| SBP00092 | Kimchi | *Azospirillum thiophilum* |
| SBP00092 | Kimchi | *Azospirillum thiophilum* |
| SBP00092 | Kimchi | *Azotobacter chroococcum* |
| SBP00092 | Kimchi | *Azotobacter chroococcum* |
| SBP00092 | Kimchi | *Bacillus cereus* |
| SBP00092 | Kimchi | *Bacillus cereus* |
| SBP00092 | Kimchi | *Bacillus megaterium* |
| SBP00092 | Kimchi | *Bacillus megaterium* |
| SBP00092 | Kimchi | *Bacillus paralicheniformis* |
| SBP00092 | Kimchi | *Bacillus paralicheniformis* |
| SBP00092 | Kimchi | *Bacillus pumilus* |
| SBP00092 | Kimchi | *Bacillus pumilus* |
| SBP00092 | Kimchi | *Bacillus safensis* |
| SBP00092 | Kimchi | *Bacillus safensis* |
| SBP00092 | Kimchi | *Bacillus* sp. (in: Bacteria) |
| SBP00092 | Kimchi | *Bacillus* sp. (in: Bacteria) |
| SBP00092 | Kimchi | *Bacillus subtilis* |
| SBP00092 | Kimchi | *Bacillus subtilis* |
| SBP00092 | Kimchi | *Bacteroides salanitronis* |
| SBP00092 | Kimchi | *Bacteroides salanitronis* |
| SBP00092 | Kimchi | *Bacteroides vulgatus* |
| SBP00092 | Kimchi | *Bacteroides vulgatus* |
| SBP00092 | Kimchi | *Betaproteobacteria bacterium* GR16-43 |
| SBP00092 | Kimchi | *Betaproteobacteria bacterium* GR16-43 |
| SBP00092 | Kimchi | *Beutenbergia cavernae* |
| SBP00092 | Kimchi | *Beutenbergia cavernae* |
| SBP00092 | Kimchi | *Blastochloris* sp. GI |
| SBP00092 | Kimchi | *Blastochloris* sp. GI |
| SBP00092 | Kimchi | *Blastochloris viridis* |
| SBP00092 | Kimchi | *Blastochloris viridis* |
| SBP00092 | Kimchi | *Blastococcus saxobsidens* |
| SBP00092 | Kimchi | *Blastococcus saxobsidens* |

TABLE 3-continued

List of species identified in each metagenomic sample of each SBP Sample

| SBP ID | SBP Host Common Name | Genus sp. |
|---|---|---|
| SBP00092 | Kimchi | *Bordetella avium* |
| SBP00092 | Kimchi | *Bordetella avium* |
| SBP00092 | Kimchi | *Bordetella bronchialis* |
| SBP00092 | Kimchi | *Bordetella bronchialis* |
| SBP00092 | Kimchi | *Bordetella bronchiseptica* |
| SBP00092 | Kimchi | *Bordetella bronchiseptica* |
| SBP00092 | Kimchi | *Bordetella flabilis* |
| SBP00092 | Kimchi | *Bordetella flabilis* |
| SBP00092 | Kimchi | *Bordetella* genomosp. 13 |
| SBP00092 | Kimchi | *Bordetella* genomosp. 13 |
| SBP00092 | Kimchi | *Bordetella* genomosp. 8 |
| SBP00092 | Kimchi | *Bordetella* genomosp. 8 |
| SBP00092 | Kimchi | *Bordetella* genomosp. 9 |
| SBP00092 | Kimchi | *Bordetella* genomosp. 9 |
| SBP00092 | Kimchi | *Bordetella hinzii* |
| SBP00092 | Kimchi | *Bordetella hinzii* |
| SBP00092 | Kimchi | *Bordetella holmesii* |
| SBP00092 | Kimchi | *Bordetella holmesii* |
| SBP00092 | Kimchi | *Bordetella petrii* |
| SBP00092 | Kimchi | *Bordetella petrii* |
| SBP00092 | Kimchi | *Bordetella pseudohinzii* |
| SBP00092 | Kimchi | *Bordetella pseudohinzii* |
| SBP00092 | Kimchi | *Bordetella* sp. H567 |
| SBP00092 | Kimchi | *Bordetella* sp. H567 |
| SBP00092 | Kimchi | *Bordetella* sp. N |
| SBP00092 | Kimchi | *Bordetella* sp. N |
| SBP00092 | Kimchi | *Bordetella trematum* |
| SBP00092 | Kimchi | *Bordetella trematum* |
| SBP00092 | Kimchi | *Bosea* sp. AS-1 |
| SBP00092 | Kimchi | *Bosea* sp. AS-1 |
| SBP00092 | Kimchi | *Bosea* sp. PAMC 26642 |
| SBP00092 | Kimchi | *Bosea* sp. PAMC 26642 |
| SBP00092 | Kimchi | *Bosea* sp. RAC05 |
| SBP00092 | Kimchi | *Bosea* sp. RAC05 |
| SBP00092 | Kimchi | *Bosea* sp. Tri-49 |
| SBP00092 | Kimchi | *Bosea* sp. Tri-49 |
| SBP00092 | Kimchi | *Bosea vaviloviae* |
| SBP00092 | Kimchi | *Bosea vaviloviae* |
| SBP00092 | Kimchi | *Brachybacterium faecium* |
| SBP00092 | Kimchi | *Brachybacterium faecium* |
| SBP00092 | Kimchi | *Brachybacterium ginsengisoli* |
| SBP00092 | Kimchi | *Brachybacterium ginsengisoli* |
| SBP00092 | Kimchi | *Brachybacterium saurashtrense* |
| SBP00092 | Kimchi | *Brachybacterium saurashtrense* |
| SBP00092 | Kimchi | *Brachybacterium* sp. VM2412 |
| SBP00092 | Kimchi | *Brachybacterium* sp. VM2412 |
| SBP00092 | Kimchi | *Bradyrhizobiaceae bacterium* SG-6C |
| SBP00092 | Kimchi | *Bradyrhizobiaceae bacterium* SG-6C |
| SBP00092 | Kimchi | *Bradyrhizobium diazoefficiens* |
| SBP00092 | Kimchi | *Bradyrhizobium diazoefficiens* |
| SBP00092 | Kimchi | *Bradyrhizobium erythrophlei* |
| SBP00092 | Kimchi | *Bradyrhizobium erythrophlei* |
| SBP00092 | Kimchi | *Bradyrhizobium guangdongense* |
| SBP00092 | Kimchi | *Bradyrhizobium guangdongense* |
| SBP00092 | Kimchi | *Bradyrhizobium guangxiense* |
| SBP00092 | Kimchi | *Bradyrhizobium guangxiense* |
| SBP00092 | Kimchi | *Bradyrhizobium icense* |
| SBP00092 | Kimchi | *Bradyrhizobium icense* |
| SBP00092 | Kimchi | *Bradyrhizobium japonicum* |
| SBP00092 | Kimchi | *Bradyrhizobium japonicum* |
| SBP00092 | Kimchi | *Bradyrhizobium lablabi* |
| SBP00092 | Kimchi | *Bradyrhizobium lablabi* |
| SBP00092 | Kimchi | *Bradyrhizobium oligotrophicum* |
| SBP00092 | Kimchi | *Bradyrhizobium oligotrophicum* |
| SBP00092 | Kimchi | *Bradyrhizobium ottawaense* |
| SBP00092 | Kimchi | *Bradyrhizobium ottawaense* |
| SBP00092 | Kimchi | *Bradyrhizobium* sp. |
| SBP00092 | Kimchi | *Bradyrhizobium* sp. |
| SBP00092 | Kimchi | *Bradyrhizobium* sp. 2 3951MB |
| SBP00092 | Kimchi | *Bradyrhizobium* sp. 2 3951MB |
| SBP00092 | Kimchi | *Bradyrhizobium* sp. 3 |
| SBP00092 | Kimchi | *Bradyrhizobium* sp. 3 |
| SBP00092 | Kimchi | *Bradyrhizobium* sp. 3 8551MB |
| SBP00092 | Kimchi | *Bradyrhizobium* sp. 3 8551MB |
| SBP00092 | Kimchi | *Bradyrhizobium* sp. BTAi1 |
| SBP00092 | Kimchi | *Bradyrhizobium* sp. BTAi1 |

TABLE 3-continued

List of species identified in each metagenomic sample of each SBP Sample

| SBP ID | SBP Host Common Name | Genus sp. |
|---|---|---|
| SBP00092 | Kimchi | *Bradyrhizobium* sp. CCBAU 51670 |
| SBP00092 | Kimchi | *Bradyrhizobium* sp. CCBAU 51670 |
| SBP00092 | Kimchi | *Bradyrhizobium* sp. CCBAU 51778 |
| SBP00092 | Kimchi | *Bradyrhizobium* sp. CCBAU 51778 |
| SBP00092 | Kimchi | *Bradyrhizobium* sp. CCGE-LA001 |
| SBP00092 | Kimchi | *Bradyrhizobium* sp. CCGE-LA001 |
| SBP00092 | Kimchi | *Bradyrhizobium* sp. ORS 278 |
| SBP00092 | Kimchi | *Bradyrhizobium* sp. ORS 278 |
| SBP00092 | Kimchi | *Bradyrhizobium* sp. ORS 285 |
| SBP00092 | Kimchi | *Bradyrhizobium* sp. ORS 285 |
| SBP00092 | Kimchi | *Bradyrhizobium* sp. ORS 3257 |
| SBP00092 | Kimchi | *Bradyrhizobium* sp. ORS 3257 |
| SBP00092 | Kimchi | *Bradyrhizobium* sp. S23321 |
| SBP00092 | Kimchi | *Bradyrhizobium* sp. S23321 |
| SBP00092 | Kimchi | *Bradyrhizobium* sp. SK17 |
| SBP00092 | Kimchi | *Bradyrhizobium* sp. SK17 |
| SBP00092 | Kimchi | *Bradyrhizobium* sp. WSM471 |
| SBP00092 | Kimchi | *Bradyrhizobium* sp. WSM471 |
| SBP00092 | Kimchi | *Breoghania* sp. L-A4 |
| SBP00092 | Kimchi | *Breoghania* sp. L-A4 |
| SBP00092 | Kimchi | *Brevibacterium aurantiacum* |
| SBP00092 | Kimchi | *Brevibacterium aurantiacum* |
| SBP00092 | Kimchi | *Brevibacterium linens* |
| SBP00092 | Kimchi | *Brevibacterium linens* |
| SBP00092 | Kimchi | *Brevundimonas diminuta* |
| SBP00092 | Kimchi | *Brevundimonas diminuta* |
| SBP00092 | Kimchi | *Brevundimonas naejangsanensis* |
| SBP00092 | Kimchi | *Brevundimonas naejangsanensis* |
| SBP00092 | Kimchi | *Brevundimonas* sp. DS20 |
| SBP00092 | Kimchi | *Brevundimonas* sp. DS20 |
| SBP00092 | Kimchi | *Brevundimonas* sp. GW460-12-10-14-LB2 |
| SBP00092 | Kimchi | *Brevundimonas* sp. GW460-12-10-14-LB2 |
| SBP00092 | Kimchi | *Brevundimonas* sp. LM2 |
| SBP00092 | Kimchi | *Brevundimonas* sp. LM2 |
| SBP00092 | Kimchi | *Brevundimonas subvibrioides* |
| SBP00092 | Kimchi | *Brevundimonas subvibrioides* |
| SBP00092 | Kimchi | *Brevundimonas vancanneytii* |
| SBP00092 | Kimchi | *Brevundimonas vancanneytii* |
| SBP00092 | Kimchi | *Brevundimonas vesicularis* |
| SBP00092 | Kimchi | *Brevundimonas vesicularis* |
| SBP00092 | Kimchi | *Brochothrix thermosphacta* |
| SBP00092 | Kimchi | *Brochothrix thermosphacta* |
| SBP00092 | Kimchi | *Burkholderia ambifaria* |
| SBP00092 | Kimchi | *Burkholderia ambifaria* |
| SBP00092 | Kimchi | *Burkholderia cenocepacia* |
| SBP00092 | Kimchi | *Burkholderia cenocepacia* |
| SBP00092 | Kimchi | *Burkholderia cepacia* |
| SBP00092 | Kimchi | *Burkholderia cepacia* |
| SBP00092 | Kimchi | *Burkholderia contaminans* |
| SBP00092 | Kimchi | *Burkholderia contaminans* |
| SBP00092 | Kimchi | *Burkholderia gladioli* |
| SBP00092 | Kimchi | *Burkholderia gladioli* |
| SBP00092 | Kimchi | *Burkholderia glumae* |
| SBP00092 | Kimchi | *Burkholderia glumae* |
| SBP00092 | Kimchi | *Burkholderia insecticola* |
| SBP00092 | Kimchi | *Burkholderia insecticola* |
| SBP00092 | Kimchi | *Burkholderia lata* |
| SBP00092 | Kimchi | *Burkholderia lata* |
| SBP00092 | Kimchi | *Burkholderia metallica* |
| SBP00092 | Kimchi | *Burkholderia metallica* |
| SBP00092 | Kimchi | *Burkholderia multivorans* |
| SBP00092 | Kimchi | *Burkholderia multivorans* |
| SBP00092 | Kimchi | *Burkholderia plantarii* |
| SBP00092 | Kimchi | *Burkholderia plantarii* |
| SBP00092 | Kimchi | *Burkholderia pseudomallei* |
| SBP00092 | Kimchi | *Burkholderia pseudomallei* |
| SBP00092 | Kimchi | *Burkholderia pyrrocinia* |
| SBP00092 | Kimchi | *Burkholderia pyrrocinia* |
| SBP00092 | Kimchi | *Burkholderia seminalis* |
| SBP00092 | Kimchi | *Burkholderia seminalis* |
| SBP00092 | Kimchi | *Burkholderia* sp. AD24 |
| SBP00092 | Kimchi | *Burkholderia* sp. AD24 |
| SBP00092 | Kimchi | *Burkholderia* sp. Bp7605 |
| SBP00092 | Kimchi | *Burkholderia* sp. Bp7605 |
| SBP00092 | Kimchi | *Burkholderia* sp. CCGE1001 |
| SBP00092 | Kimchi | *Burkholderia* sp. CCGE1001 |

TABLE 3-continued

List of species identified in each metagenomic sample of each SBP Sample

| SBP ID | SBP Host Common Name | Genus sp. |
|---|---|---|
| SBP00092 | Kimchi | Burkholderia sp. CCGE1002 |
| SBP00092 | Kimchi | Burkholderia sp. CCGE1002 |
| SBP00092 | Kimchi | Burkholderia sp. CCGE1003 |
| SBP00092 | Kimchi | Burkholderia sp. CCGE1003 |
| SBP00092 | Kimchi | Burkholderia sp. IDO3 |
| SBP00092 | Kimchi | Burkholderia sp. IDO3 |
| SBP00092 | Kimchi | Burkholderia sp. JP2-270 |
| SBP00092 | Kimchi | Burkholderia sp. JP2-270 |
| SBP00092 | Kimchi | Burkholderia sp. OLGA172 |
| SBP00092 | Kimchi | Burkholderia sp. OLGA172 |
| SBP00092 | Kimchi | Burkholderia sp. PAMC 28687 |
| SBP00092 | Kimchi | Burkholderia sp. PAMC 28687 |
| SBP00092 | Kimchi | Burkholderia stabilis |
| SBP00092 | Kimchi | Burkholderia stabilis |
| SBP00092 | Kimchi | Burkholderia stagnalis |
| SBP00092 | Kimchi | Burkholderia stagnalis |
| SBP00092 | Kimchi | Burkholderia territorii |
| SBP00092 | Kimchi | Burkholderia territorii |
| SBP00092 | Kimchi | Burkholderia thailandensis |
| SBP00092 | Kimchi | Burkholderia thailandensis |
| SBP00092 | Kimchi | Burkholderia ubonensis |
| SBP00092 | Kimchi | Burkholderia ubonensis |
| SBP00092 | Kimchi | Burkholderiales bacterium GJ-E10 |
| SBP00092 | Kimchi | Burkholderiales bacterium GJ-E10 |
| SBP00092 | Kimchi | Burkholderiales bacterium JOSHI_001 |
| SBP00092 | Kimchi | Burkholderiales bacterium JOSHI_001 |
| SBP00092 | Kimchi | Buttiauxella sp. 3AFRM03 |
| SBP00092 | Kimchi | Buttiauxella sp. 3AFRM03 |
| SBP00092 | Kimchi | Candidatus Accumulibacter phosphatis |
| SBP00092 | Kimchi | Candidatus Accumulibacter phosphatis |
| SBP00092 | Kimchi | Candidatus Filomicrobium marinum |
| SBP00092 | Kimchi | Candidatus Filomicrobium marinum |
| SBP00092 | Kimchi | Candidatus Methylopumilus turicensis |
| SBP00092 | Kimchi | Candidatus Methylopumilus turicensis |
| SBP00092 | Kimchi | Candidatus Solibacter usitatus |
| SBP00092 | Kimchi | Candidatus Solibacter usitatus |
| SBP00092 | Kimchi | Candidatus Symbiobacter mobilis |
| SBP00092 | Kimchi | Candidatus Symbiobacter mobilis |
| SBP00092 | Kimchi | Candidatus Thiodictyon syntrophicum |
| SBP00092 | Kimchi | Candidatus Thiodictyon syntrophicum |
| SBP00092 | Kimchi | Capnocytophaga sputigena |
| SBP00092 | Kimchi | Capnocytophaga sputigena |
| SBP00092 | Kimchi | Carnobacterium inhibens |
| SBP00092 | Kimchi | Carnobacterium inhibens |
| SBP00092 | Kimchi | Carnobacterium maltaromaticum |
| SBP00092 | Kimchi | Carnobacterium maltaromaticum |
| SBP00092 | Kimchi | Castellaniella defragrans |
| SBP00092 | Kimchi | Castellaniella defragrans |
| SBP00092 | Kimchi | Catenulispora acidiphila |
| SBP00092 | Kimchi | Catenulispora acidiphila |
| SBP00092 | Kimchi | Cauliflower mosaic virus |
| SBP00092 | Kimchi | Cauliflower mosaic virus |
| SBP00092 | Kimchi | Caulobacter flavus |
| SBP00092 | Kimchi | Caulobacter flavus |
| SBP00092 | Kimchi | Caulobacter henricii |
| SBP00092 | Kimchi | Caulobacter henricii |
| SBP00092 | Kimchi | Caulobacter mirabilis |
| SBP00092 | Kimchi | Caulobacter mirabilis |
| SBP00092 | Kimchi | Caulobacter segnis |
| SBP00092 | Kimchi | Caulobacter segnis |
| SBP00092 | Kimchi | Caulobacter sp. FWC26 |
| SBP00092 | Kimchi | Caulobacter sp. FWC26 |
| SBP00092 | Kimchi | Caulobacter sp. K31 |
| SBP00092 | Kimchi | Caulobacter sp. K31 |
| SBP00092 | Kimchi | Caulobacter vibrioides |
| SBP00092 | Kimchi | Caulobacter vibrioides |
| SBP00092 | Kimchi | Caulobacteraceae bacterium OTSz_A_272 |
| SBP00092 | Kimchi | Caulobacteraceae bacterium OTSz_A_272 |
| SBP00092 | Kimchi | Cedecea lapagei |
| SBP00092 | Kimchi | Cedecea lapagei |
| SBP00092 | Kimchi | Cedecea neteri |
| SBP00092 | Kimchi | Cedecea neteri |
| SBP00092 | Kimchi | Celeribacter ethanolicus |
| SBP00092 | Kimchi | Celeribacter ethanolicus |
| SBP00092 | Kimchi | Celeribacter indicus |
| SBP00092 | Kimchi | Celeribacter indicus |

TABLE 3-continued

List of species identified in each metagenomic sample of each SBP Sample

| SBP ID | SBP Host Common Name | Genus sp. |
|---|---|---|
| SBP00092 | Kimchi | Celeribacter manganoxidans |
| SBP00092 | Kimchi | Celeribacter manganoxidans |
| SBP00092 | Kimchi | Cellulomonas fimi |
| SBP00092 | Kimchi | Cellulomonas fimi |
| SBP00092 | Kimchi | Cellulomonas flavigena |
| SBP00092 | Kimchi | Cellulomonas flavigena |
| SBP00092 | Kimchi | Cellulomonas gilvus |
| SBP00092 | Kimchi | Cellulomonas gilvus |
| SBP00092 | Kimchi | Cellulomonas sp. PSBB021 |
| SBP00092 | Kimchi | Cellulomonas sp. PSBB021 |
| SBP00092 | Kimchi | Cellulosimicrobium cellulans |
| SBP00092 | Kimchi | Cellulosimicrobium cellulans |
| SBP00092 | Kimchi | Cellulosimicrobium sp. TH-20 |
| SBP00092 | Kimchi | Cellulosimicrobium sp. TH-20 |
| SBP00092 | Kimchi | Cellvibrio sp. PSBB023 |
| SBP00092 | Kimchi | Cellvibrio sp. PSBB023 |
| SBP00092 | Kimchi | Chania multitudinisentens |
| SBP00092 | Kimchi | Chania multitudinisentens |
| SBP00092 | Kimchi | Chelativorans sp. BNC1 |
| SBP00092 | Kimchi | Chelativorans sp. BNC1 |
| SBP00092 | Kimchi | Chelatococcus daeguensis |
| SBP00092 | Kimchi | Chelatococcus daeguensis |
| SBP00092 | Kimchi | Chelatococcus sp. CO-6 |
| SBP00092 | Kimchi | Chelatococcus sp. CO-6 |
| SBP00092 | Kimchi | Chitinophaga pinensis |
| SBP00092 | Kimchi | Chitinophaga pinensis |
| SBP00092 | Kimchi | Chondromyces crocatus |
| SBP00092 | Kimchi | Chondromyces crocatus |
| SBP00092 | Kimchi | Chromobacterium rhizoryzae |
| SBP00092 | Kimchi | Chromobacterium rhizoryzae |
| SBP00092 | Kimchi | Chromobacterium sp. ATCC 53434 |
| SBP00092 | Kimchi | Chromobacterium sp. ATCC 53434 |
| SBP00092 | Kimchi | Chromobacterium violaceum |
| SBP00092 | Kimchi | Chromobacterium violaceum |
| SBP00092 | Kimchi | Chromohalobacter salexigens |
| SBP00092 | Kimchi | Chromohalobacter salexigens |
| SBP00092 | Kimchi | Chryseobacterium antarcticum |
| SBP00092 | Kimchi | Chryseobacterium antarcticum |
| SBP00092 | Kimchi | Chryseobacterium arthrosphaerae |
| SBP00092 | Kimchi | Chryseobacterium arthrosphaerae |
| SBP00092 | Kimchi | Chryseobacterium balustinum |
| SBP00092 | Kimchi | Chryseobacterium balustinum |
| SBP00092 | Kimchi | Chryseobacterium bernardetii |
| SBP00092 | Kimchi | Chryseobacterium bernardetii |
| SBP00092 | Kimchi | Chryseobacterium camelliae |
| SBP00092 | Kimchi | Chryseobacterium camelliae |
| SBP00092 | Kimchi | Chryseobacterium carnipullorum |
| SBP00092 | Kimchi | Chryseobacterium carnipullorum |
| SBP00092 | Kimchi | Chryseobacterium carnis |
| SBP00092 | Kimchi | Chryseobacterium carnis |
| SBP00092 | Kimchi | Chryseobacterium gallinarum |
| SBP00092 | Kimchi | Chryseobacterium gallinarum |
| SBP00092 | Kimchi | Chryseobacterium glaciei |
| SBP00092 | Kimchi | Chryseobacterium glaciei |
| SBP00092 | Kimchi | Chryseobacterium gleum |
| SBP00092 | Kimchi | Chryseobacterium gleum |
| SBP00092 | Kimchi | Chryseobacterium haifense |
| SBP00092 | Kimchi | Chryseobacterium haifense |
| SBP00092 | Kimchi | Chryseobacterium indologenes |
| SBP00092 | Kimchi | Chryseobacterium indologenes |
| SBP00092 | Kimchi | Chryseobacterium indoltheticum |
| SBP00092 | Kimchi | Chryseobacterium indoltheticum |
| SBP00092 | Kimchi | Chryseobacterium jeonii |
| SBP00092 | Kimchi | Chryseobacterium jeonii |
| SBP00092 | Kimchi | Chryseobacterium joostei |
| SBP00092 | Kimchi | Chryseobacterium joostei |
| SBP00092 | Kimchi | Chryseobacterium lactis |
| SBP00092 | Kimchi | Chryseobacterium lactis |
| SBP00092 | Kimchi | Chryseobacterium nakagawai |
| SBP00092 | Kimchi | Chryseobacterium nakagawai |
| SBP00092 | Kimchi | Chryseobacterium piperi |
| SBP00092 | Kimchi | Chryseobacterium piperi |
| SBP00092 | Kimchi | Chryseobacterium shandongense |
| SBP00092 | Kimchi | Chryseobacterium shandongense |
| SBP00092 | Kimchi | Chryseobacterium sp. 17S1E7 |
| SBP00092 | Kimchi | Chryseobacterium sp. 17S1E7 |

TABLE 3-continued

List of species identified in each metagenomic sample of each SBP Sample

| SBP ID | SBP Host Common Name | Genus sp. |
|---|---|---|
| SBP00092 | Kimchi | *Chryseobacterium* sp. 3008163 |
| SBP00092 | Kimchi | *Chryseobacterium* sp. 3008163 |
| SBP00092 | Kimchi | *Chryseobacterium* sp. 6424 |
| SBP00092 | Kimchi | *Chryseobacterium* sp. 6424 |
| SBP00092 | Kimchi | *Chryseobacterium* sp. FS649 |
| SBP00092 | Kimchi | *Chryseobacterium* sp. FS649 |
| SBP00092 | Kimchi | *Chryseobacterium* sp. G0186 |
| SBP00092 | Kimchi | *Chryseobacterium* sp. G0186 |
| SBP00092 | Kimchi | *Chryseobacterium* sp. G0201 |
| SBP00092 | Kimchi | *Chryseobacterium* sp. G0201 |
| SBP00092 | Kimchi | *Chryseobacterium* sp. H3001 |
| SBP00092 | Kimchi | *Chryseobacterium* sp. H3001 |
| SBP00092 | Kimchi | *Chryseobacterium* sp. H6466 |
| SBP00092 | Kimchi | *Chryseobacterium* sp. H6466 |
| SBP00092 | Kimchi | *Chryseobacterium* sp. IHB B 17019 |
| SBP00092 | Kimchi | *Chryseobacterium* sp. IHB B 17019 |
| SBP00092 | Kimchi | *Chryseobacterium* sp. StRB126 |
| SBP00092 | Kimchi | *Chryseobacterium* sp. StRB126 |
| SBP00092 | Kimchi | *Chryseobacterium* sp. T16E-39 |
| SBP00092 | Kimchi | *Chryseobacterium* sp. T16E-39 |
| SBP00092 | Kimchi | *Chryseobacterium taklimakanense* |
| SBP00092 | Kimchi | *Chryseobacterium taklimakanense* |
| SBP00092 | Kimchi | *Citrobacter amalonaticus* |
| SBP00092 | Kimchi | *Citrobacter amalonaticus* |
| SBP00092 | Kimchi | *Citrobacter farmeri* |
| SBP00092 | Kimchi | *Citrobacter farmeri* |
| SBP00092 | Kimchi | *Citrobacter freundii* |
| SBP00092 | Kimchi | *Citrobacter freundii* |
| SBP00092 | Kimchi | *Citrobacter freundii* complex sp. CFNIH3 |
| SBP00092 | Kimchi | *Citrobacter freundii* complex sp. CFNIH3 |
| SBP00092 | Kimchi | *Citrobacter koseri* |
| SBP00092 | Kimchi | *Citrobacter koseri* |
| SBP00092 | Kimchi | *Citrobacter rodentium* |
| SBP00092 | Kimchi | *Citrobacter rodentium* |
| SBP00092 | Kimchi | *Citrobacter werkmanii* |
| SBP00092 | Kimchi | *Citrobacter werkmanii* |
| SBP00092 | Kimchi | *Citrobacter youngae* |
| SBP00092 | Kimchi | *Citrobacter youngae* |
| SBP00092 | Kimchi | *Citromicrobium* sp. JL477 |
| SBP00092 | Kimchi | *Citromicrobium* sp. JL477 |
| SBP00092 | Kimchi | *Clavibacter michiganensis* |
| SBP00092 | Kimchi | *Clavibacter michiganensis* |
| SBP00092 | Kimchi | *Cloacibacterium normanense* |
| SBP00092 | Kimchi | *Cloacibacterium normanense* |
| SBP00092 | Kimchi | *Clostridioides difficile* |
| SBP00092 | Kimchi | *Clostridioides difficile* |
| SBP00092 | Kimchi | *Clostridium saccharoperbutylacetonicum* |
| SBP00092 | Kimchi | *Clostridium saccharoperbutylacetonicum* |
| SBP00092 | Kimchi | *Clostridium tetani* |
| SBP00092 | Kimchi | *Clostridium tetani* |
| SBP00092 | Kimchi | *Collimonas arenae* |
| SBP00092 | Kimchi | *Collimonas arenae* |
| SBP00092 | Kimchi | *Collimonas fungivorans* |
| SBP00092 | Kimchi | *Collimonas fungivorans* |
| SBP00092 | Kimchi | *Collimonas pratensis* |
| SBP00092 | Kimchi | *Collimonas pratensis* |
| SBP00092 | Kimchi | *Comamonas aquatica* |
| SBP00092 | Kimchi | *Comamonas aquatica* |
| SBP00092 | Kimchi | *Comamonas kerstersii* |
| SBP00092 | Kimchi | *Comamonas kerstersii* |
| SBP00092 | Kimchi | *Comamonas serinivorans* |
| SBP00092 | Kimchi | *Comamonas serinivorans* |
| SBP00092 | Kimchi | *Comamonas terrigena* |
| SBP00092 | Kimchi | *Comamonas terrigena* |
| SBP00092 | Kimchi | *Comamonas testosteroni* |
| SBP00092 | Kimchi | *Comamonas testosteroni* |
| SBP00092 | Kimchi | *Comamonas thiooxydans* |
| SBP00092 | Kimchi | *Comamonas thiooxydans* |
| SBP00092 | Kimchi | *Conexibacter woesei* |
| SBP00092 | Kimchi | *Conexibacter woesei* |
| SBP00092 | Kimchi | *Confluentimicrobium* sp. EMB200-NS6 |
| SBP00092 | Kimchi | *Confluentimicrobium* sp. EMB200-NS6 |
| SBP00092 | Kimchi | *Corallococcus coralloides* |
| SBP00092 | Kimchi | *Corallococcus coralloides* |
| SBP00092 | Kimchi | *Corynebacterium diphtheriae* |
| SBP00092 | Kimchi | *Corynebacterium diphtheriae* |

TABLE 3-continued

List of species identified in each metagenomic sample of each SBP Sample

| SBP ID | SBP Host Common Name | Genus sp. |
|---|---|---|
| SBP00092 | Kimchi | *Corynebacterium halotolerans* |
| SBP00092 | Kimchi | *Corynebacterium halotolerans* |
| SBP00092 | Kimchi | *Corynebacterium segmentosum* |
| SBP00092 | Kimchi | *Corynebacterium segmentosum* |
| SBP00092 | Kimchi | *Corynebacterium xerosis* |
| SBP00092 | Kimchi | *Corynebacterium xerosis* |
| SBP00092 | Kimchi | *Crenobacter* sp. K1W11S-77 |
| SBP00092 | Kimchi | *Crenobacter* sp. K1W11S-77 |
| SBP00092 | Kimchi | *Croceicoccus marinus* |
| SBP00092 | Kimchi | *Croceicoccus marinus* |
| SBP00092 | Kimchi | *Croceicoccus naphthovorans* |
| SBP00092 | Kimchi | *Croceicoccus naphthovorans* |
| SBP00092 | Kimchi | *Cronobacter condimenti* |
| SBP00092 | Kimchi | *Cronobacter condimenti* |
| SBP00092 | Kimchi | *Cronobacter dublinensis* |
| SBP00092 | Kimchi | *Cronobacter dublinensis* |
| SBP00092 | Kimchi | *Cronobacter muytjensii* |
| SBP00092 | Kimchi | *Cronobacter muytjensii* |
| SBP00092 | Kimchi | *Cronobacter sakazakii* |
| SBP00092 | Kimchi | *Cronobacter sakazakii* |
| SBP00092 | Kimchi | *Cronobacter turicensis* |
| SBP00092 | Kimchi | *Cronobacter turicensis* |
| SBP00092 | Kimchi | *Cryobacterium* sp. GCJ02 |
| SBP00092 | Kimchi | *Cryobacterium* sp. GCJ02 |
| SBP00092 | Kimchi | *Cryobacterium* sp. LW097 |
| SBP00092 | Kimchi | *Cryobacterium* sp. LW097 |
| SBP00092 | Kimchi | *Cupriavidus basilensis* |
| SBP00092 | Kimchi | *Cupriavidus basilensis* |
| SBP00092 | Kimchi | *Cupriavidus gilardii* |
| SBP00092 | Kimchi | *Cupriavidus gilardii* |
| SBP00092 | Kimchi | *Cupriavidus metallidurans* |
| SBP00092 | Kimchi | *Cupriavidus metallidurans* |
| SBP00092 | Kimchi | *Cupriavidus necator* |
| SBP00092 | Kimchi | *Cupriavidus necator* |
| SBP00092 | Kimchi | *Cupriavidus oxalaticus* |
| SBP00092 | Kimchi | *Cupriavidus oxalaticus* |
| SBP00092 | Kimchi | *Cupriavidus pauculus* |
| SBP00092 | Kimchi | *Cupriavidus pauculus* |
| SBP00092 | Kimchi | *Cupriavidus pinatubonensis* |
| SBP00092 | Kimchi | *Cupriavidus pinatubonensis* |
| SBP00092 | Kimchi | *Cupriavidus* sp. USMAA2-4 |
| SBP00092 | Kimchi | *Cupriavidus* sp. USMAA2-4 |
| SBP00092 | Kimchi | *Cupriavidus taiwanensis* |
| SBP00092 | Kimchi | *Cupriavidus taiwanensis* |
| SBP00092 | Kimchi | *Curtobacterium pusillum* |
| SBP00092 | Kimchi | *Curtobacterium pusillum* |
| SBP00092 | Kimchi | *Curtobacterium* sp. BH-2-1-1 |
| SBP00092 | Kimchi | *Curtobacterium* sp. BH-2-1-1 |
| SBP00092 | Kimchi | *Curtobacterium* sp. MR_MD2014 |
| SBP00092 | Kimchi | *Curtobacterium* sp. MR_MD2014 |
| SBP00092 | Kimchi | *Curtobacterium* sp. SGAir0471 |
| SBP00092 | Kimchi | *Curtobacterium* sp. SGAir0471 |
| SBP00092 | Kimchi | *Curvibacter* sp. AEP1-3 |
| SBP00092 | Kimchi | *Curvibacter* sp. AEP1-3 |
| SBP00092 | Kimchi | *Cutibacterium acnes* |
| SBP00092 | Kimchi | *Cutibacterium acnes* |
| SBP00092 | Kimchi | *Cystobacter fuscus* |
| SBP00092 | Kimchi | *Cystobacter fuscus* |
| SBP00092 | Kimchi | *Dechloromonas aromatica* |
| SBP00092 | Kimchi | *Dechloromonas aromatica* |
| SBP00092 | Kimchi | *Defluviimonas alba* |
| SBP00092 | Kimchi | *Defluviimonas alba* |
| SBP00092 | Kimchi | *Deinococcus gobiensis* |
| SBP00092 | Kimchi | *Deinococcus gobiensis* |
| SBP00092 | Kimchi | *Deinococcus puniceus* |
| SBP00092 | Kimchi | *Deinococcus puniceus* |
| SBP00092 | Kimchi | *Deinococcus swuensis* |
| SBP00092 | Kimchi | *Deinococcus swuensis* |
| SBP00092 | Kimchi | *Deinococcus wulumuqiensis* |
| SBP00092 | Kimchi | *Deinococcus wulumuqiensis* |
| SBP00092 | Kimchi | *Delftia acidovorans* |
| SBP00092 | Kimchi | *Delftia acidovorans* |
| SBP00092 | Kimchi | *Delftia* sp. |
| SBP00092 | Kimchi | *Delftia* sp. |
| SBP00092 | Kimchi | *Delftia tsuruhatensis* |
| SBP00092 | Kimchi | *Delftia tsuruhatensis* |

TABLE 3-continued

List of species identified in each metagenomic sample of each SBP Sample

| SBP ID | SBP Host Common Name | Genus sp. |
| --- | --- | --- |
| SBP00092 | Kimchi | *Dermacoccus nishinomiyaensis* |
| SBP00092 | Kimchi | *Dermacoccus nishinomiyaensis* |
| SBP00092 | Kimchi | *Desulfovibrio piger* |
| SBP00092 | Kimchi | *Desulfovibrio piger* |
| SBP00092 | Kimchi | *Devosia* sp. 1566 |
| SBP00092 | Kimchi | *Devosia* sp. 1566 |
| SBP00092 | Kimchi | *Devosia* sp. A16 |
| SBP00092 | Kimchi | *Devosia* sp. A16 |
| SBP00092 | Kimchi | *Devosia* sp. HS989 |
| SBP00092 | Kimchi | *Devosia* sp. HS989 |
| SBP00092 | Kimchi | *Devosia* sp. I507 |
| SBP00092 | Kimchi | *Devosia* sp. I507 |
| SBP00092 | Kimchi | *Diaphorobacter polyhydroxybutyrativorans* |
| SBP00092 | Kimchi | *Diaphorobacter polyhydroxybutyrativorans* |
| SBP00092 | Kimchi | *Dickeya chrysanthemi* |
| SBP00092 | Kimchi | *Dickeya chrysanthemi* |
| SBP00092 | Kimchi | *Dickeya dadantii* |
| SBP00092 | Kimchi | *Dickeya dadantii* |
| SBP00092 | Kimchi | *Dickeya dianthicola* |
| SBP00092 | Kimchi | *Dickeya dianthicola* |
| SBP00092 | Kimchi | *Dickeya* sp. Secpp 1600 |
| SBP00092 | Kimchi | *Dickeya* sp. Secpp 1600 |
| SBP00092 | Kimchi | *Dickeya zeae* |
| SBP00092 | Kimchi | *Dickeya zeae* |
| SBP00092 | Kimchi | *Dietzia psychralcaliphila* |
| SBP00092 | Kimchi | *Dietzia psychralcaliphila* |
| SBP00092 | Kimchi | *Dietzia* sp. JS16-p6b |
| SBP00092 | Kimchi | *Dietzia* sp. JS16-p6b |
| SBP00092 | Kimchi | *Dinoroseobacter shibae* |
| SBP00092 | Kimchi | *Dinoroseobacter shibae* |
| SBP00092 | Kimchi | *Dokdonella koreensis* |
| SBP00092 | Kimchi | *Dokdonella koreensis* |
| SBP00092 | Kimchi | *Dyadobacter fermentans* |
| SBP00092 | Kimchi | *Dyadobacter fermentans* |
| SBP00092 | Kimchi | *Dyella japonica* |
| SBP00092 | Kimchi | *Dyella japonica* |
| SBP00092 | Kimchi | *Dyella* sp. M7H15-1 |
| SBP00092 | Kimchi | *Dyella* sp. M7H15-1 |
| SBP00092 | Kimchi | *Dyella thiooxydans* |
| SBP00092 | Kimchi | *Dyella thiooxydans* |
| SBP00092 | Kimchi | *Edwardsiella tarda* |
| SBP00092 | Kimchi | *Edwardsiella tarda* |
| SBP00092 | Kimchi | *Egibacter rhizosphaerae* |
| SBP00092 | Kimchi | *Egibacter rhizosphaerae* |
| SBP00092 | Kimchi | *Elizabethkingia anophelis* |
| SBP00092 | Kimchi | *Elizabethkingia anophelis* |
| SBP00092 | Kimchi | *Elizabethkingia bruuniana* |
| SBP00092 | Kimchi | *Elizabethkingia bruuniana* |
| SBP00092 | Kimchi | *Ensifer adhaerens* |
| SBP00092 | Kimchi | *Ensifer adhaerens* |
| SBP00092 | Kimchi | *Ensifer sojae* |
| SBP00092 | Kimchi | *Ensifer sojae* |
| SBP00092 | Kimchi | *Enterobacter asburiae* |
| SBP00092 | Kimchi | *Enterobacter asburiae* |
| SBP00092 | Kimchi | *Enterobacter bugandensis* |
| SBP00092 | Kimchi | *Enterobacter bugandensis* |
| SBP00092 | Kimchi | *Enterobacter cancerogenus* |
| SBP00092 | Kimchi | *Enterobacter cancerogenus* |
| SBP00092 | Kimchi | *Enterobacter cloacae* |
| SBP00092 | Kimchi | *Enterobacter cloacae* |
| SBP00092 | Kimchi | *Enterobacter cloacae* complex sp. |
| SBP00092 | Kimchi | *Enterobacter cloacae* complex sp. |
| SBP00092 | Kimchi | *Enterobacter cloacae* complex sp. ECNIH7 |
| SBP00092 | Kimchi | *Enterobacter cloacae* complex sp. ECNIH7 |
| SBP00092 | Kimchi | *Enterobacter hormaechei* |
| SBP00092 | Kimchi | *Enterobacter hormaechei* |
| SBP00092 | Kimchi | *Enterobacter kobei* |
| SBP00092 | Kimchi | *Enterobacter kobei* |
| SBP00092 | Kimchi | *Enterobacter ludwigii* |
| SBP00092 | Kimchi | *Enterobacter ludwigii* |
| SBP00092 | Kimchi | *Enterobacter roggenkampii* |
| SBP00092 | Kimchi | *Enterobacter roggenkampii* |
| SBP00092 | Kimchi | *Enterobacter soli* |
| SBP00092 | Kimchi | *Enterobacter soli* |
| SBP00092 | Kimchi | *Enterobacter* sp. 638 |
| SBP00092 | Kimchi | *Enterobacter* sp. 638 |

TABLE 3-continued

List of species identified in each metagenomic sample of each SBP Sample

| SBP ID | SBP Host Common Name | Genus sp. |
|---|---|---|
| SBP00092 | Kimchi | Enterobacter sp. Crenshaw |
| SBP00092 | Kimchi | Enterobacter sp. Crenshaw |
| SBP00092 | Kimchi | Enterobacter sp. FY-07 |
| SBP00092 | Kimchi | Enterobacter sp. FY-07 |
| SBP00092 | Kimchi | Enterobacter sp. HK169 |
| SBP00092 | Kimchi | Enterobacter sp. HK169 |
| SBP00092 | Kimchi | Enterobacter sp. N18-03635 |
| SBP00092 | Kimchi | Enterobacter sp. N18-03635 |
| SBP00092 | Kimchi | Enterobacter sp. ODB01 |
| SBP00092 | Kimchi | Enterobacter sp. ODB01 |
| SBP00092 | Kimchi | Enterobacter sp. R4-368 |
| SBP00092 | Kimchi | Enterobacter sp. R4-368 |
| SBP00092 | Kimchi | Enterobacter sp. SA187 |
| SBP00092 | Kimchi | Enterobacter sp. SA187 |
| SBP00092 | Kimchi | Enterobacteriaceae bacterium strain FGI 57 |
| SBP00092 | Kimchi | Enterobacteriaceae bacterium strain FGI 57 |
| SBP00092 | Kimchi | Enterobacteriaceae bacterium w6 |
| SBP00092 | Kimchi | Enterobacteriaceae bacterium w6 |
| SBP00092 | Kimchi | Enterococcus casseliflavus |
| SBP00092 | Kimchi | Enterococcus casseliflavus |
| SBP00092 | Kimchi | Enterococcus durans |
| SBP00092 | Kimchi | Enterococcus durans |
| SBP00092 | Kimchi | Enterococcus faecalis |
| SBP00092 | Kimchi | Enterococcus faecalis |
| SBP00092 | Kimchi | Enterococcus faecium |
| SBP00092 | Kimchi | Enterococcus faecium |
| SBP00092 | Kimchi | Enterococcus hirae |
| SBP00092 | Kimchi | Enterococcus hirae |
| SBP00092 | Kimchi | Ereboglobus luteus |
| SBP00092 | Kimchi | Ereboglobus luteus |
| SBP00092 | Kimchi | Erwinia amylovora |
| SBP00092 | Kimchi | Erwinia amylovora |
| SBP00092 | Kimchi | Erwinia billingiae |
| SBP00092 | Kimchi | Erwinia billingiae |
| SBP00092 | Kimchi | Erwinia gerundensis |
| SBP00092 | Kimchi | Erwinia gerundensis |
| SBP00092 | Kimchi | Erwinia persicina |
| SBP00092 | Kimchi | Erwinia persicina |
| SBP00092 | Kimchi | Erwinia pyrifoliae |
| SBP00092 | Kimchi | Erwinia pyrifoliae |
| SBP00092 | Kimchi | Erwinia sp. |
| SBP00092 | Kimchi | Erwinia sp. |
| SBP00092 | Kimchi | Erwinia sp. Ejp617 |
| SBP00092 | Kimchi | Erwinia sp. Ejp617 |
| SBP00092 | Kimchi | Erwinia tasmaniensis |
| SBP00092 | Kimchi | Erwinia tasmaniensis |
| SBP00092 | Kimchi | Erythrobacter atlanticus |
| SBP00092 | Kimchi | Erythrobacter atlanticus |
| SBP00092 | Kimchi | Erythrobacter flavus |
| SBP00092 | Kimchi | Erythrobacter flavus |
| SBP00092 | Kimchi | Erythrobacter gangjinensis |
| SBP00092 | Kimchi | Erythrobacter gangjinensis |
| SBP00092 | Kimchi | Erythrobacter litoralis |
| SBP00092 | Kimchi | Erythrobacter litoralis |
| SBP00092 | Kimchi | Erythrobacter sp. HKB08 |
| SBP00092 | Kimchi | Erythrobacter sp. HKB08 |
| SBP00092 | Kimchi | Erythrobacter sp. HL-111 |
| SBP00092 | Kimchi | Erythrobacter sp. HL-111 |
| SBP00092 | Kimchi | Erythrobacter sp. KY5 |
| SBP00092 | Kimchi | Erythrobacter sp. KY5 |
| SBP00092 | Kimchi | Escherichia albertii |
| SBP00092 | Kimchi | Escherichia albertii |
| SBP00092 | Kimchi | Escherichia coli |
| SBP00092 | Kimchi | Escherichia coli |
| SBP00092 | Kimchi | Escherichia fergusonii |
| SBP00092 | Kimchi | Escherichia fergusonii |
| SBP00092 | Kimchi | Exiguobacterium sp. N4-1P |
| SBP00092 | Kimchi | Exiguobacterium sp. N4-1P |
| SBP00092 | Kimchi | Fimbriimonas ginsengisoli |
| SBP00092 | Kimchi | Fimbriimonas ginsengisoli |
| SBP00092 | Kimchi | Flavobacteriaceae bacterium 3519-10 |
| SBP00092 | Kimchi | Flavobacteriaceae bacterium 3519-10 |
| SBP00092 | Kimchi | Flavobacterium album |
| SBP00092 | Kimchi | Flavobacterium album |
| SBP00092 | Kimchi | Flavobacterium anhuiense |
| SBP00092 | Kimchi | Flavobacterium anhuiense |

TABLE 3-continued

List of species identified in each metagenomic sample of each SBP Sample

| SBP ID | SBP Host Common Name | Genus sp. |
|---|---|---|
| SBP00092 | Kimchi | *Flavobacterium arcticum* |
| SBP00092 | Kimchi | *Flavobacterium arcticum* |
| SBP00092 | Kimchi | *Flavobacterium branchiophilum* |
| SBP00092 | Kimchi | *Flavobacterium branchiophilum* |
| SBP00092 | Kimchi | *Flavobacterium columnare* |
| SBP00092 | Kimchi | *Flavobacterium columnare* |
| SBP00092 | Kimchi | *Flavobacterium commune* |
| SBP00092 | Kimchi | *Flavobacterium commune* |
| SBP00092 | Kimchi | *Flavobacterium crassostreae* |
| SBP00092 | Kimchi | *Flavobacterium crassostreae* |
| SBP00092 | Kimchi | *Flavobacterium crocinum* |
| SBP00092 | Kimchi | *Flavobacterium crocinum* |
| SBP00092 | Kimchi | *Flavobacterium faecale* |
| SBP00092 | Kimchi | *Flavobacterium faecale* |
| SBP00092 | Kimchi | *Flavobacterium gilvum* |
| SBP00092 | Kimchi | *Flavobacterium gilvum* |
| SBP00092 | Kimchi | *Flavobacterium indicum* |
| SBP00092 | Kimchi | *Flavobacterium indicum* |
| SBP00092 | Kimchi | *Flavobacterium johnsoniae* |
| SBP00092 | Kimchi | *Flavobacterium johnsoniae* |
| SBP00092 | Kimchi | *Flavobacterium kingsejongi* |
| SBP00092 | Kimchi | *Flavobacterium kingsejongi* |
| SBP00092 | Kimchi | *Flavobacterium pallidum* |
| SBP00092 | Kimchi | *Flavobacterium pallidum* |
| SBP00092 | Kimchi | *Flavobacterium psychrophilum* |
| SBP00092 | Kimchi | *Flavobacterium psychrophilum* |
| SBP00092 | Kimchi | *Flavobacterium* sp. 140616W15 |
| SBP00092 | Kimchi | *Flavobacterium* sp. 140616W15 |
| SBP00092 | Kimchi | *Flavobacterium* sp. CJ74 |
| SBP00092 | Kimchi | *Flavobacterium* sp. CJ74 |
| SBP00092 | Kimchi | *Flavobacterium* sp. HYN0086 |
| SBP00092 | Kimchi | *Flavobacterium* sp. HYN0086 |
| SBP00092 | Kimchi | *Flavobacterium* sp. MEBiC07310 |
| SBP00092 | Kimchi | *Flavobacterium* sp. MEBiC07310 |
| SBP00092 | Kimchi | *Frankia inefficax* |
| SBP00092 | Kimchi | *Frankia inefficax* |
| SBP00092 | Kimchi | *Frankia* sp. QA3 |
| SBP00092 | Kimchi | *Frankia* sp. QA3 |
| SBP00092 | Kimchi | *Frateuria aurantia* |
| SBP00092 | Kimchi | *Frateuria aurantia* |
| SBP00092 | Kimchi | *Friedmanniella luteola* |
| SBP00092 | Kimchi | *Friedmanniella luteola* |
| SBP00092 | Kimchi | *Friedmanniella sagamiharensis* |
| SBP00092 | Kimchi | *Friedmanniella sagamiharensis* |
| SBP00092 | Kimchi | *Frondihabitans* sp. 762G35 |
| SBP00092 | Kimchi | *Frondihabitans* sp. 762G35 |
| SBP00092 | Kimchi | *Frondihabitans* sp. PAMC 28766 |
| SBP00092 | Kimchi | *Frondihabitans* sp. PAMC 28766 |
| SBP00092 | Kimchi | *Fuerstia marisgermanicae* |
| SBP00092 | Kimchi | *Fuerstia marisgermanicae* |
| SBP00092 | Kimchi | *Gemella morbillorum* |
| SBP00092 | Kimchi | *Gemella morbillorum* |
| SBP00092 | Kimchi | *Gemmata obscuriglobus* |
| SBP00092 | Kimchi | *Gemmata obscuriglobus* |
| SBP00092 | Kimchi | *Gemmata* sp. SH-PL17 |
| SBP00092 | Kimchi | *Gemmata* sp. SH-PL17 |
| SBP00092 | Kimchi | *Gemmatirosa kalamazoonesis* |
| SBP00092 | Kimchi | *Gemmatirosa kalamazoonesis* |
| SBP00092 | Kimchi | *Gemmobacter* sp. HYN0069 |
| SBP00092 | Kimchi | *Gemmobacter* sp. HYN0069 |
| SBP00092 | Kimchi | *Geobacter daltonii* |
| SBP00092 | Kimchi | *Geobacter daltonii* |
| SBP00092 | Kimchi | *Geobacter sulfurreducens* |
| SBP00092 | Kimchi | *Geobacter sulfurreducens* |
| SBP00092 | Kimchi | *Geodermatophilus obscurus* |
| SBP00092 | Kimchi | *Geodermatophilus obscurus* |
| SBP00092 | Kimchi | *Georgenia* sp. ZLJ0423 |
| SBP00092 | Kimchi | *Georgenia* sp. ZLJ0423 |
| SBP00092 | Kimchi | *Gibbsiella quercinecans* |
| SBP00092 | Kimchi | *Gibbsiella quercinecans* |
| SBP00092 | Kimchi | *Gluconobacter oxydans* |
| SBP00092 | Kimchi | *Gluconobacter oxydans* |
| SBP00092 | Kimchi | *Gordonia iterans* |
| SBP00092 | Kimchi | *Gordonia iterans* |
| SBP00092 | Kimchi | *Gordonia polyisoprenivorans* |
| SBP00092 | Kimchi | *Gordonia polyisoprenivorans* |

TABLE 3-continued

List of species identified in each metagenomic sample of each SBP Sample

| SBP ID | SBP Host Common Name | Genus sp. |
| --- | --- | --- |
| SBP00092 | Kimchi | *Gordonia* sp. KTR9 |
| SBP00092 | Kimchi | *Gordonia* sp. KTR9 |
| SBP00092 | Kimchi | *Gordonia* sp. MMS17-SY073 |
| SBP00092 | Kimchi | *Gordonia* sp. MMS17-SY073 |
| SBP00092 | Kimchi | *Gordonia* sp. YC-JH1 |
| SBP00092 | Kimchi | *Gordonia* sp. YC-JH1 |
| SBP00092 | Kimchi | *Granulibacter bethesdensis* |
| SBP00092 | Kimchi | *Granulibacter bethesdensis* |
| SBP00092 | Kimchi | *Haematobacter massiliensis* |
| SBP00092 | Kimchi | *Haematobacter massiliensis* |
| SBP00092 | Kimchi | *Hafnia alvei* |
| SBP00092 | Kimchi | *Hafnia alvei* |
| SBP00092 | Kimchi | *Hafnia paralvei* |
| SBP00092 | Kimchi | *Hafnia paralvei* |
| SBP00092 | Kimchi | *Hafnia* sp. CBA7124 |
| SBP00092 | Kimchi | *Hafnia* sp. CBA7124 |
| SBP00092 | Kimchi | *Haliangium ochraceum* |
| SBP00092 | Kimchi | *Haliangium ochraceum* |
| SBP00092 | Kimchi | *Halomonas* sp. 1513 |
| SBP00092 | Kimchi | *Halomonas* sp. 1513 |
| SBP00092 | Kimchi | *Halomonas* sp. A3H3 |
| SBP00092 | Kimchi | *Halomonas* sp. A3H3 |
| SBP00092 | Kimchi | *Halomonas* sp. JS92-SW72 |
| SBP00092 | Kimchi | *Halomonas* sp. JS92-SW72 |
| SBP00092 | Kimchi | *Halorhodospira halophila* |
| SBP00092 | Kimchi | *Halorhodospira halophila* |
| SBP00092 | Kimchi | *Halothiobacillus neapolitanus* |
| SBP00092 | Kimchi | *Halothiobacillus neapolitanus* |
| SBP00092 | Kimchi | *Hartmannibacter diazotrophicus* |
| SBP00092 | Kimchi | *Hartmannibacter diazotrophicus* |
| SBP00092 | Kimchi | *Herbaspirillum hiltneri* |
| SBP00092 | Kimchi | *Herbaspirillum hiltneri* |
| SBP00092 | Kimchi | *Herbaspirillum huttiense* |
| SBP00092 | Kimchi | *Herbaspirillum huttiense* |
| SBP00092 | Kimchi | *Herbaspirillum robiniae* |
| SBP00092 | Kimchi | *Herbaspirillum robiniae* |
| SBP00092 | Kimchi | *Herbaspirillum rubrisubalbicans* |
| SBP00092 | Kimchi | *Herbaspirillum rubrisubalbicans* |
| SBP00092 | Kimchi | *Herbaspirillum seropedicae* |
| SBP00092 | Kimchi | *Herbaspirillum seropedicae* |
| SBP00092 | Kimchi | *Herbaspirillum* sp. meg3 |
| SBP00092 | Kimchi | *Herbaspirillum* sp. meg3 |
| SBP00092 | Kimchi | *Herminiimonas arsenicoxydans* |
| SBP00092 | Kimchi | *Herminiimonas arsenicoxydans* |
| SBP00092 | Kimchi | *Hoeflea phototrophica* |
| SBP00092 | Kimchi | *Hoeflea phototrophica* |
| SBP00092 | Kimchi | *Hoeflea* sp. IMCC20628 |
| SBP00092 | Kimchi | *Hoeflea* sp. IMCC20628 |
| SBP00092 | Kimchi | *Hydrogenophaga crassostreae* |
| SBP00092 | Kimchi | *Hydrogenophaga crassostreae* |
| SBP00092 | Kimchi | *Hydrogenophaga pseudoflava* |
| SBP00092 | Kimchi | *Hydrogenophaga pseudoflava* |
| SBP00092 | Kimchi | *Hydrogenophaga* sp. NH-16 |
| SBP00092 | Kimchi | *Hydrogenophaga* sp. NH-16 |
| SBP00092 | Kimchi | *Hydrogenophaga* sp. PBC |
| SBP00092 | Kimchi | *Hydrogenophaga* sp. PBC |
| SBP00092 | Kimchi | *Hydrogenophaga* sp. RAC07 |
| SBP00092 | Kimchi | *Hydrogenophaga* sp. RAC07 |
| SBP00092 | Kimchi | *Hydrogenophilus thermoluteolus* |
| SBP00092 | Kimchi | *Hydrogenophilus thermoluteolus* |
| SBP00092 | Kimchi | *Hylemonella gracilis* |
| SBP00092 | Kimchi | *Hylemonella gracilis* |
| SBP00092 | Kimchi | *Hymenobacter* sp. APR13 |
| SBP00092 | Kimchi | *Hymenobacter* sp. APR13 |
| SBP00092 | Kimchi | *Hyphomicrobium denitrificans* |
| SBP00092 | Kimchi | *Hyphomicrobium denitrificans* |
| SBP00092 | Kimchi | *Hyphomicrobium nitrativorans* |
| SBP00092 | Kimchi | *Hyphomicrobium nitrativorans* |
| SBP00092 | Kimchi | *Hyphomicrobium* sp. MC1 |
| SBP00092 | Kimchi | *Hyphomicrobium* sp. MC1 |
| SBP00092 | Kimchi | *Immundisolibacter cernigliae* |
| SBP00092 | Kimchi | *Immundisolibacter cernigliae* |
| SBP00092 | Kimchi | *Indioceanicola profundi* |
| SBP00092 | Kimchi | *Indioceanicola profundi* |
| SBP00092 | Kimchi | *Inhella inkyongensis* |
| SBP00092 | Kimchi | *Inhella inkyongensis* |

TABLE 3-continued

List of species identified in each metagenomic sample of each SBP Sample

| SBP ID | SBP Host Common Name | Genus sp. |
|---|---|---|
| SBP00092 | Kimchi | *Intrasporangium calvum* |
| SBP00092 | Kimchi | *Intrasporangium calvum* |
| SBP00092 | Kimchi | *Isoptericola dokdonensis* |
| SBP00092 | Kimchi | *Isoptericola dokdonensis* |
| SBP00092 | Kimchi | *Isoptericola variabilis* |
| SBP00092 | Kimchi | *Isoptericola variabilis* |
| SBP00092 | Kimchi | *Janibacter indicus* |
| SBP00092 | Kimchi | *Janibacter indicus* |
| SBP00092 | Kimchi | *Janibacter limosus* |
| SBP00092 | Kimchi | *Janibacter limosus* |
| SBP00092 | Kimchi | *Jannaschia* sp. CCS1 |
| SBP00092 | Kimchi | *Jannaschia* sp. CCS1 |
| SBP00092 | Kimchi | *Janthinobacterium agaricidamnosum* |
| SBP00092 | Kimchi | *Janthinobacterium agaricidamnosum* |
| SBP00092 | Kimchi | *Janthinobacterium* sp. 1_2014MBL_MicDiv |
| SBP00092 | Kimchi | *Janthinobacterium* sp. 1_2014MBL_MicDiv |
| SBP00092 | Kimchi | *Janthinobacterium* sp. 17J80-10 |
| SBP00092 | Kimchi | *Janthinobacterium* sp. 17J80-10 |
| SBP00092 | Kimchi | *Janthinobacterium* sp. B9-8 |
| SBP00092 | Kimchi | *Janthinobacterium* sp. B9-8 |
| SBP00092 | Kimchi | *Janthinobacterium* sp. LM6 |
| SBP00092 | Kimchi | *Janthinobacterium* sp. LM6 |
| SBP00092 | Kimchi | *Janthinobacterium* sp. Marseille |
| SBP00092 | Kimchi | *Janthinobacterium* sp. Marseille |
| SBP00092 | Kimchi | *Janthinobacterium svalbardensis* |
| SBP00092 | Kimchi | *Janthinobacterium svalbardensis* |
| SBP00092 | Kimchi | *Jeotgalicoccus saudimassiliensis* |
| SBP00092 | Kimchi | *Jeotgalicoccus saudimassiliensis* |
| SBP00092 | Kimchi | *Jiangella alkaliphila* |
| SBP00092 | Kimchi | *Jiangella alkaliphila* |
| SBP00092 | Kimchi | *Jiangella* sp. DSM 45060 |
| SBP00092 | Kimchi | *Jiangella* sp. DSM 45060 |
| SBP00092 | Kimchi | *Ketogulonicigenium robustum* |
| SBP00092 | Kimchi | *Ketogulonicigenium robustum* |
| SBP00092 | Kimchi | *Ketogulonicigenium vulgare* |
| SBP00092 | Kimchi | *Ketogulonicigenium vulgare* |
| SBP00092 | Kimchi | *Kibdelosporangium phytohabitans* |
| SBP00092 | Kimchi | *Kibdelosporangium phytohabitans* |
| SBP00092 | Kimchi | *Kineococcus radiotolerans* |
| SBP00092 | Kimchi | *Kineococcus radiotolerans* |
| SBP00092 | Kimchi | *Kitasatospora aureofaciens* |
| SBP00092 | Kimchi | *Kitasatospora aureofaciens* |
| SBP00092 | Kimchi | *Kitasatospora setae* |
| SBP00092 | Kimchi | *Kitasatospora setae* |
| SBP00092 | Kimchi | *Klebsiella aerogenes* |
| SBP00092 | Kimchi | *Klebsiella aerogenes* |
| SBP00092 | Kimchi | *Klebsiella michiganensis* |
| SBP00092 | Kimchi | *Klebsiella michiganensis* |
| SBP00092 | Kimchi | *Klebsiella oxytoca* |
| SBP00092 | Kimchi | *Klebsiella oxytoca* |
| SBP00092 | Kimchi | *Klebsiella pneumoniae* |
| SBP00092 | Kimchi | *Klebsiella pneumoniae* |
| SBP00092 | Kimchi | *Klebsiella quasipneumoniae* |
| SBP00092 | Kimchi | *Klebsiella quasipneumoniae* |
| SBP00092 | Kimchi | *Klebsiella quasivariicola* |
| SBP00092 | Kimchi | *Klebsiella quasivariicola* |
| SBP00092 | Kimchi | *Klebsiella* sp. FDAARGOS_511 |
| SBP00092 | Kimchi | *Klebsiella* sp. FDAARGOS_511 |
| SBP00092 | Kimchi | *Klebsiella* sp. WCHKl090001 |
| SBP00092 | Kimchi | *Klebsiella* sp. WCHKl090001 |
| SBP00092 | Kimchi | *Klebsiella variicola* |
| SBP00092 | Kimchi | *Klebsiella variicola* |
| SBP00092 | Kimchi | *Kluyvera intermedia* |
| SBP00092 | Kimchi | *Kluyvera intermedia* |
| SBP00092 | Kimchi | *Kocuria indica* |
| SBP00092 | Kimchi | *Kocuria indica* |
| SBP00092 | Kimchi | *Kocuria palustris* |
| SBP00092 | Kimchi | *Kocuria palustris* |
| SBP00092 | Kimchi | *Kocuria rosea* |
| SBP00092 | Kimchi | *Kocuria rosea* |
| SBP00092 | Kimchi | *Kocuria turfanensis* |
| SBP00092 | Kimchi | *Kocuria turfanensis* |
| SBP00092 | Kimchi | *Komagataeibacter saccharivorans* |
| SBP00092 | Kimchi | *Komagataeibacter saccharivorans* |
| SBP00092 | Kimchi | *Kosakonia cowanii* |
| SBP00092 | Kimchi | *Kosakonia cowanii* |

TABLE 3-continued

List of species identified in each metagenomic sample of each SBP Sample

| SBP ID | SBP Host Common Name | Genus sp. |
| --- | --- | --- |
| SBP00092 | Kimchi | *Kosakonia oryzae* |
| SBP00092 | Kimchi | *Kosakonia oryzae* |
| SBP00092 | Kimchi | *Kosakonia sacchari* |
| SBP00092 | Kimchi | *Kosakonia sacchari* |
| SBP00092 | Kimchi | *Kosakonia* sp. CCTCC M2018092 |
| SBP00092 | Kimchi | *Kosakonia* sp. CCTCC M2018092 |
| SBP00092 | Kimchi | *Kribbella flavida* |
| SBP00092 | Kimchi | *Kribbella flavida* |
| SBP00092 | Kimchi | *Kutzneria albida* |
| SBP00092 | Kimchi | *Kutzneria albida* |
| SBP00092 | Kimchi | *Kytococcus sedentarius* |
| SBP00092 | Kimchi | *Kytococcus sedentarius* |
| SBP00092 | Kimchi | *Labrenzia* sp. VG12 |
| SBP00092 | Kimchi | *Labrenzia* sp. VG12 |
| SBP00092 | Kimchi | *Lactobacillus acidipiscis* |
| SBP00092 | Kimchi | *Lactobacillus acidipiscis* |
| SBP00092 | Kimchi | *Lactobacillus agilis* |
| SBP00092 | Kimchi | *Lactobacillus agilis* |
| SBP00092 | Kimchi | *Lactobacillus alimentarius* |
| SBP00092 | Kimchi | *Lactobacillus alimentarius* |
| SBP00092 | Kimchi | *Lactobacillus amylophilus* |
| SBP00092 | Kimchi | *Lactobacillus amylophilus* |
| SBP00092 | Kimchi | *Lactobacillus animalis* |
| SBP00092 | Kimchi | *Lactobacillus animalis* |
| SBP00092 | Kimchi | *Lactobacillus backii* |
| SBP00092 | Kimchi | *Lactobacillus backii* |
| SBP00092 | Kimchi | *Lactobacillus brevis* |
| SBP00092 | Kimchi | *Lactobacillus brevis* |
| SBP00092 | Kimchi | *Lactobacillus buchneri* |
| SBP00092 | Kimchi | *Lactobacillus buchneri* |
| SBP00092 | Kimchi | *Lactobacillus casei* |
| SBP00092 | Kimchi | *Lactobacillus casei* |
| SBP00092 | Kimchi | *Lactobacillus coryniformis* |
| SBP00092 | Kimchi | *Lactobacillus coryniformis* |
| SBP00092 | Kimchi | *Lactobacillus crispatus* |
| SBP00092 | Kimchi | *Lactobacillus crispatus* |
| SBP00092 | Kimchi | *Lactobacillus crustorum* |
| SBP00092 | Kimchi | *Lactobacillus crustorum* |
| SBP00092 | Kimchi | *Lactobacillus curvatus* |
| SBP00092 | Kimchi | *Lactobacillus curvatus* |
| SBP00092 | Kimchi | *Lactobacillus delbrueckii* |
| SBP00092 | Kimchi | *Lactobacillus delbrueckii* |
| SBP00092 | Kimchi | *Lactobacillus farciminis* |
| SBP00092 | Kimchi | *Lactobacillus farciminis* |
| SBP00092 | Kimchi | *Lactobacillus fermentum* |
| SBP00092 | Kimchi | *Lactobacillus fermentum* |
| SBP00092 | Kimchi | *Lactobacillus fuchuensis* |
| SBP00092 | Kimchi | *Lactobacillus fuchuensis* |
| SBP00092 | Kimchi | *Lactobacillus gallinarum* |
| SBP00092 | Kimchi | *Lactobacillus gallinarum* |
| SBP00092 | Kimchi | *Lactobacillus gasseri* |
| SBP00092 | Kimchi | *Lactobacillus gasseri* |
| SBP00092 | Kimchi | *Lactobacillus helveticus* |
| SBP00092 | Kimchi | *Lactobacillus helveticus* |
| SBP00092 | Kimchi | *Lactobacillus hokkaidonensis* |
| SBP00092 | Kimchi | *Lactobacillus hokkaidonensis* |
| SBP00092 | Kimchi | *Lactobacillus hordei* |
| SBP00092 | Kimchi | *Lactobacillus hordei* |
| SBP00092 | Kimchi | *Lactobacillus johnsonii* |
| SBP00092 | Kimchi | *Lactobacillus johnsonii* |
| SBP00092 | Kimchi | *Lactobacillus kefiranofaciens* |
| SBP00092 | Kimchi | *Lactobacillus kefiranofaciens* |
| SBP00092 | Kimchi | *Lactobacillus koreensis* |
| SBP00092 | Kimchi | *Lactobacillus koreensis* |
| SBP00092 | Kimchi | *Lactobacillus lindneri* |
| SBP00092 | Kimchi | *Lactobacillus lindneri* |
| SBP00092 | Kimchi | *Lactobacillus oligofermentans* |
| SBP00092 | Kimchi | *Lactobacillus oligofermentans* |
| SBP00092 | Kimchi | *Lactobacillus parabuchneri* |
| SBP00092 | Kimchi | *Lactobacillus parabuchneri* |
| SBP00092 | Kimchi | *Lactobacillus paracasei* |
| SBP00092 | Kimchi | *Lactobacillus paracasei* |
| SBP00092 | Kimchi | *Lactobacillus paracollinoides* |
| SBP00092 | Kimchi | *Lactobacillus paracollinoides* |
| SBP00092 | Kimchi | *Lactobacillus paraplantarum* |
| SBP00092 | Kimchi | *Lactobacillus paraplantarum* |

TABLE 3-continued

List of species identified in each metagenomic sample of each SBP Sample

| SBP ID | SBP Host Common Name | Genus sp. |
|---|---|---|
| SBP00092 | Kimchi | *Lactobacillus pentosus* |
| SBP00092 | Kimchi | *Lactobacillus pentosus* |
| SBP00092 | Kimchi | *Lactobacillus plantarum* |
| SBP00092 | Kimchi | *Lactobacillus plantarum* |
| SBP00092 | Kimchi | *Lactobacillus reuteri* |
| SBP00092 | Kimchi | *Lactobacillus reuteri* |
| SBP00092 | Kimchi | *Lactobacillus rhamnosus* |
| SBP00092 | Kimchi | *Lactobacillus rhamnosus* |
| SBP00092 | Kimchi | *Lactobacillus sakei* |
| SBP00092 | Kimchi | *Lactobacillus sakei* |
| SBP00092 | Kimchi | *Lactobacillus salivarius* |
| SBP00092 | Kimchi | *Lactobacillus salivarius* |
| SBP00092 | Kimchi | *Lactobacillus sanfranciscensis* |
| SBP00092 | Kimchi | *Lactobacillus sanfranciscensis* |
| SBP00092 | Kimchi | *Lactobacillus* sp. CBA3605 |
| SBP00092 | Kimchi | *Lactobacillus* sp. CBA3605 |
| SBP00092 | Kimchi | *Lactobacillus* sp. CBA3606 |
| SBP00092 | Kimchi | *Lactobacillus* sp. CBA3606 |
| SBP00092 | Kimchi | *Lactobacillus zymae* |
| SBP00092 | Kimchi | *Lactobacillus zymae* |
| SBP00092 | Kimchi | *Lactococcus garvieae* |
| SBP00092 | Kimchi | *Lactococcus garvieae* |
| SBP00092 | Kimchi | *Lactococcus lactis* |
| SBP00092 | Kimchi | *Lactococcus lactis* |
| SBP00092 | Kimchi | *Lactococcus piscium* |
| SBP00092 | Kimchi | *Lactococcus piscium* |
| SBP00092 | Kimchi | *Lactococcus raffinolactis* |
| SBP00092 | Kimchi | *Lactococcus raffinolactis* |
| SBP00092 | Kimchi | *Lacunisphaera limnophila* |
| SBP00092 | Kimchi | *Lacunisphaera limnophila* |
| SBP00092 | Kimchi | *Lautropia mirabilis* |
| SBP00092 | Kimchi | *Lautropia mirabilis* |
| SBP00092 | Kimchi | *Leclercia adecarboxylata* |
| SBP00092 | Kimchi | *Leclercia adecarboxylata* |
| SBP00092 | Kimchi | *Leclercia* sp. LSNIH1 |
| SBP00092 | Kimchi | *Leclercia* sp. LSNIH1 |
| SBP00092 | Kimchi | *Leclercia* sp. LSNIH3 |
| SBP00092 | Kimchi | *Leclercia* sp. LSNIH3 |
| SBP00092 | Kimchi | *Leifsonia* sp. 21MFCrub1.1 |
| SBP00092 | Kimchi | *Leifsonia* sp. 21MFCrub1.1 |
| SBP00092 | Kimchi | *Leifsonia xyli* |
| SBP00092 | Kimchi | *Leifsonia xyli* |
| SBP00092 | Kimchi | *Leisingera methylohalidivorans* |
| SBP00092 | Kimchi | *Leisingera methylohalidivorans* |
| SBP00092 | Kimchi | *Lelliottia amnigena* |
| SBP00092 | Kimchi | *Lelliottia amnigena* |
| SBP00092 | Kimchi | *Lelliottia jeotgali* |
| SBP00092 | Kimchi | *Lelliottia jeotgali* |
| SBP00092 | Kimchi | *Lelliottia nimipressuralis* |
| SBP00092 | Kimchi | *Lelliottia nimipressuralis* |
| SBP00092 | Kimchi | *Lelliottia* sp. WB101 |
| SBP00092 | Kimchi | *Lelliottia* sp. WB101 |
| SBP00092 | Kimchi | *Leminorella richardii* |
| SBP00092 | Kimchi | *Leminorella richardii* |
| SBP00092 | Kimchi | *Lentzea guizhouensis* |
| SBP00092 | Kimchi | *Lentzea guizhouensis* |
| SBP00092 | Kimchi | *Leptothrix cholodnii* |
| SBP00092 | Kimchi | *Leptothrix cholodnii* |
| SBP00092 | Kimchi | *Leucobacter triazinivorans* |
| SBP00092 | Kimchi | *Leucobacter triazinivorans* |
| SBP00092 | Kimchi | *Leuconostoc carnosum* |
| SBP00092 | Kimchi | *Leuconostoc carnosum* |
| SBP00092 | Kimchi | *Leuconostoc citreum* |
| SBP00092 | Kimchi | *Leuconostoc citreum* |
| SBP00092 | Kimchi | *Leuconostoc garlicum* |
| SBP00092 | Kimchi | *Leuconostoc garlicum* |
| SBP00092 | Kimchi | *Leuconostoc gelidum* |
| SBP00092 | Kimchi | *Leuconostoc gelidum* |
| SBP00092 | Kimchi | *Leuconostoc kimchii* |
| SBP00092 | Kimchi | *Leuconostoc kimchii* |
| SBP00092 | Kimchi | *Leuconostoc lactis* |
| SBP00092 | Kimchi | *Leuconostoc lactis* |
| SBP00092 | Kimchi | *Leuconostoc mesenteroides* |
| SBP00092 | Kimchi | *Leuconostoc mesenteroides* |
| SBP00092 | Kimchi | *Leuconostoc* sp. C2 |
| SBP00092 | Kimchi | *Leuconostoc* sp. C2 |

TABLE 3-continued

List of species identified in each metagenomic sample of each SBP Sample

| SBP ID | SBP Host Common Name | Genus sp. |
| --- | --- | --- |
| SBP00092 | Kimchi | *Leuconostoc suionicum* |
| SBP00092 | Kimchi | *Leuconostoc suionicum* |
| SBP00092 | Kimchi | *Limnohabitans* sp. 103DPR2 |
| SBP00092 | Kimchi | *Limnohabitans* sp. 103DPR2 |
| SBP00092 | Kimchi | *Limnohabitans* sp. 63ED37-2 |
| SBP00092 | Kimchi | *Limnohabitans* sp. 63ED37-2 |
| SBP00092 | Kimchi | *Listeria monocytogenes* |
| SBP00092 | Kimchi | *Listeria monocytogenes* |
| SBP00092 | Kimchi | *Lonsdalea britannica* |
| SBP00092 | Kimchi | *Lonsdalea britannica* |
| SBP00092 | Kimchi | *Luteibacter rhizovicinus* |
| SBP00092 | Kimchi | *Luteibacter rhizovicinus* |
| SBP00092 | Kimchi | *Luteimonas* sp. 100111 |
| SBP00092 | Kimchi | *Luteimonas* sp. 100111 |
| SBP00092 | Kimchi | *Luteimonas* sp. 83-4 |
| SBP00092 | Kimchi | *Luteimonas* sp. 83-4 |
| SBP00092 | Kimchi | *Luteimonas* sp. JM171 |
| SBP00092 | Kimchi | *Luteimonas* sp. JM171 |
| SBP00092 | Kimchi | *Luteipulveratus mongoliensis* |
| SBP00092 | Kimchi | *Luteipulveratus mongoliensis* |
| SBP00092 | Kimchi | *Luteitalea pratensis* |
| SBP00092 | Kimchi | *Luteitalea pratensis* |
| SBP00092 | Kimchi | *Lutibacter profundi* |
| SBP00092 | Kimchi | *Lutibacter profundi* |
| SBP00092 | Kimchi | *Lutibacter* sp. LPB0138 |
| SBP00092 | Kimchi | *Lutibacter* sp. LPB0138 |
| SBP00092 | Kimchi | *Lysobacter antibioticus* |
| SBP00092 | Kimchi | *Lysobacter antibioticus* |
| SBP00092 | Kimchi | *Lysobacter capsici* |
| SBP00092 | Kimchi | *Lysobacter capsici* |
| SBP00092 | Kimchi | *Lysobacter enzymogenes* |
| SBP00092 | Kimchi | *Lysobacter enzymogenes* |
| SBP00092 | Kimchi | *Lysobacter gummosus* |
| SBP00092 | Kimchi | *Lysobacter gummosus* |
| SBP00092 | Kimchi | *Lysobacter maris* |
| SBP00092 | Kimchi | *Lysobacter maris* |
| SBP00092 | Kimchi | *Lysobacter* sp. TY2-98 |
| SBP00092 | Kimchi | *Lysobacter* sp. TY2-98 |
| SBP00092 | Kimchi | *Magnetospirillum gryphiswaldense* |
| SBP00092 | Kimchi | *Magnetospirillum gryphiswaldense* |
| SBP00092 | Kimchi | *Magnetospirillum magneticum* |
| SBP00092 | Kimchi | *Magnetospirillum magneticum* |
| SBP00092 | Kimchi | *Magnetospirillum* sp. XM-1 |
| SBP00092 | Kimchi | *Magnetospirillum* sp. XM-1 |
| SBP00092 | Kimchi | *Mariniflexile* sp. TRM1-10 |
| SBP00092 | Kimchi | *Mariniflexile* sp. TRM1-10 |
| SBP00092 | Kimchi | *Marinobacter hydrocarbonoclasticus* |
| SBP00092 | Kimchi | *Marinobacter hydrocarbonoclasticus* |
| SBP00092 | Kimchi | *Marinovum algicola* |
| SBP00092 | Kimchi | *Marinovum algicola* |
| SBP00092 | Kimchi | *Marmoricola scoriae* |
| SBP00092 | Kimchi | *Marmoricola scoriae* |
| SBP00092 | Kimchi | *Martelella endophytica* |
| SBP00092 | Kimchi | *Martelella endophytica* |
| SBP00092 | Kimchi | *Martelella mediterranea* |
| SBP00092 | Kimchi | *Martelella mediterranea* |
| SBP00092 | Kimchi | *Martelella* sp. AD-3 |
| SBP00092 | Kimchi | *Martelella* sp. AD-3 |
| SBP00092 | Kimchi | *Massilia albidiflava* |
| SBP00092 | Kimchi | *Massilia albidiflava* |
| SBP00092 | Kimchi | *Massilia armeniaca* |
| SBP00092 | Kimchi | *Massilia armeniaca* |
| SBP00092 | Kimchi | *Massilia lutea* |
| SBP00092 | Kimchi | *Massilia lutea* |
| SBP00092 | Kimchi | *Massilia oculi* |
| SBP00092 | Kimchi | *Massilia oculi* |
| SBP00092 | Kimchi | *Massilia plicata* |
| SBP00092 | Kimchi | *Massilia plicata* |
| SBP00092 | Kimchi | *Massilia putida* |
| SBP00092 | Kimchi | *Massilia putida* |
| SBP00092 | Kimchi | *Massilia* sp. NR 4-1 |
| SBP00092 | Kimchi | *Massilia* sp. NR 4-1 |
| SBP00092 | Kimchi | *Massilia* sp. WG5 |
| SBP00092 | Kimchi | *Massilia* sp. WG5 |
| SBP00092 | Kimchi | *Massilia* sp. YMA4 |
| SBP00092 | Kimchi | *Massilia* sp. YMA4 |

TABLE 3-continued

List of species identified in each metagenomic sample of each SBP Sample

| SBP ID | SBP Host Common Name | Genus sp. |
|---|---|---|
| SBP00092 | Kimchi | *Massilia umbonata* |
| SBP00092 | Kimchi | *Massilia umbonata* |
| SBP00092 | Kimchi | *Massilia violaceinigra* |
| SBP00092 | Kimchi | *Massilia violaceinigra* |
| SBP00092 | Kimchi | *Melaminivora* sp. SC2-7 |
| SBP00092 | Kimchi | *Melaminivora* sp. SC2-7 |
| SBP00092 | Kimchi | *Melaminivora* sp. SC2-9 |
| SBP00092 | Kimchi | *Melaminivora* sp. SC2-9 |
| SBP00092 | Kimchi | *Melittangium boletus* |
| SBP00092 | Kimchi | *Melittangium boletus* |
| SBP00092 | Kimchi | *Mesorhizobium amorphae* |
| SBP00092 | Kimchi | *Mesorhizobium amorphae* |
| SBP00092 | Kimchi | *Mesorhizobium australicum* |
| SBP00092 | Kimchi | *Mesorhizobium australicum* |
| SBP00092 | Kimchi | *Mesorhizobium ciceri* |
| SBP00092 | Kimchi | *Mesorhizobium ciceri* |
| SBP00092 | Kimchi | *Mesorhizobium japonicum* |
| SBP00092 | Kimchi | *Mesorhizobium japonicum* |
| SBP00092 | Kimchi | *Mesorhizobium loti* |
| SBP00092 | Kimchi | *Mesorhizobium loti* |
| SBP00092 | Kimchi | *Mesorhizobium oceanicum* |
| SBP00092 | Kimchi | *Mesorhizobium oceanicum* |
| SBP00092 | Kimchi | *Mesorhizobium opportunistum* |
| SBP00092 | Kimchi | *Mesorhizobium opportunistum* |
| SBP00092 | Kimchi | *Mesorhizobium* sp. DCY119 |
| SBP00092 | Kimchi | *Mesorhizobium* sp. DCY119 |
| SBP00092 | Kimchi | *Mesorhizobium* sp. M1B.F.Ca.ET.045.04.1.1 |
| SBP00092 | Kimchi | *Mesorhizobium* sp. M1B.F.Ca.ET.045.04.1.1 |
| SBP00092 | Kimchi | *Mesorhizobium* sp. M1D.F.Ca.ET.043.01.1.1 |
| SBP00092 | Kimchi | *Mesorhizobium* sp. M1D.F.Ca.ET.043.01.1.1 |
| SBP00092 | Kimchi | *Mesorhizobium* sp. M1E.F.Ca.ET.045.02.1.1 |
| SBP00092 | Kimchi | *Mesorhizobium* sp. M1E.F.Ca.ET.045.02.1.1 |
| SBP00092 | Kimchi | *Mesorhizobium* sp. M2A.F.Ca.ET.043.02.1.1 |
| SBP00092 | Kimchi | *Mesorhizobium* sp. M2A.F.Ca.ET.043.02.1.1 |
| SBP00092 | Kimchi | *Mesorhizobium* sp. M2A.F.Ca.ET.043.05.1.1 |
| SBP00092 | Kimchi | *Mesorhizobium* sp. M2A.F.Ca.ET.043.05.1.1 |
| SBP00092 | Kimchi | *Mesorhizobium* sp. M2A.F.Ca.ET.046.03.2.1 |
| SBP00092 | Kimchi | *Mesorhizobium* sp. M2A.F.Ca.ET.046.03.2.1 |
| SBP00092 | Kimchi | *Mesorhizobium* sp. M3A.F.Ca.ET.080.04.2.1 |
| SBP00092 | Kimchi | *Mesorhizobium* sp. M3A.F.Ca.ET.080.04.2.1 |
| SBP00092 | Kimchi | *Mesorhizobium* sp. M4B.F.Ca.ET.058.02.1.1 |
| SBP00092 | Kimchi | *Mesorhizobium* sp. M4B.F.Ca.ET.058.02.1.1 |
| SBP00092 | Kimchi | *Mesorhizobium* sp. M6A.T.Cr.TU.016.01.1.1 |
| SBP00092 | Kimchi | *Mesorhizobium* sp. M6A.T.Cr.TU.016.01.1.1 |
| SBP00092 | Kimchi | *Mesorhizobium* sp. M7A.F.Ce.TU.012.03.2.1 |
| SBP00092 | Kimchi | *Mesorhizobium* sp. M7A.F.Ce.TU.012.03.2.1 |
| SBP00092 | Kimchi | *Mesorhizobium* sp. M7D.F.Ca.US.005.01.1.1 |
| SBP00092 | Kimchi | *Mesorhizobium* sp. M7D.F.Ca.US.005.01.1.1 |
| SBP00092 | Kimchi | *Mesorhizobium* sp. M9A.F.Ca.ET.002.03.1.2 |
| SBP00092 | Kimchi | *Mesorhizobium* sp. M9A.F.Ca.ET.002.03.1.2 |
| SBP00092 | Kimchi | *Mesorhizobium* sp. WSM1497 |
| SBP00092 | Kimchi | *Mesorhizobium* sp. WSM1497 |
| SBP00092 | Kimchi | *Methylibium petroleiphilum* |
| SBP00092 | Kimchi | *Methylibium petroleiphilum* |
| SBP00092 | Kimchi | *Methylobacterium aquaticum* |
| SBP00092 | Kimchi | *Methylobacterium aquaticum* |
| SBP00092 | Kimchi | *Methylobacterium brachiatum* |
| SBP00092 | Kimchi | *Methylobacterium brachiatum* |
| SBP00092 | Kimchi | *Methylobacterium currus* |
| SBP00092 | Kimchi | *Methylobacterium currus* |
| SBP00092 | Kimchi | *Methylobacterium nodulans* |
| SBP00092 | Kimchi | *Methylobacterium nodulans* |
| SBP00092 | Kimchi | *Methylobacterium phyllosphaerae* |
| SBP00092 | Kimchi | *Methylobacterium phyllosphaerae* |
| SBP00092 | Kimchi | *Methylobacterium radiotolerans* |
| SBP00092 | Kimchi | *Methylobacterium radiotolerans* |
| SBP00092 | Kimchi | *Methylobacterium* sp. 17SD2-17 |
| SBP00092 | Kimchi | *Methylobacterium* sp. 17SD2-17 |
| SBP00092 | Kimchi | *Methylobacterium* sp. 17Sr1-1 |
| SBP00092 | Kimchi | *Methylobacterium* sp. 17Sr1-1 |
| SBP00092 | Kimchi | *Methylobacterium* sp. 17Sr1-28 |
| SBP00092 | Kimchi | *Methylobacterium* sp. 17Sr1-28 |
| SBP00092 | Kimchi | *Methylobacterium* sp. 17Sr1-43 |
| SBP00092 | Kimchi | *Methylobacterium* sp. 17Sr1-43 |
| SBP00092 | Kimchi | *Methylobacterium* sp. 4-46 |
| SBP00092 | Kimchi | *Methylobacterium* sp. 4-46 |

TABLE 3-continued

List of species identified in each metagenomic sample of each SBP Sample

| SBP ID | SBP Host Common Name | Genus sp. |
| --- | --- | --- |
| SBP00092 | Kimchi | *Methylobacterium* sp. AMS5 |
| SBP00092 | Kimchi | *Methylobacterium* sp. AMS5 |
| SBP00092 | Kimchi | *Methylobacterium* sp. DM1 |
| SBP00092 | Kimchi | *Methylobacterium* sp. DM1 |
| SBP00092 | Kimchi | *Methyloceanibacter caenitepidi* |
| SBP00092 | Kimchi | *Methyloceanibacter caenitepidi* |
| SBP00092 | Kimchi | *Methyloceanibacter* sp. wino2 |
| SBP00092 | Kimchi | *Methyloceanibacter* sp. wino2 |
| SBP00092 | Kimchi | *Methylocella silvestris* |
| SBP00092 | Kimchi | *Methylocella silvestris* |
| SBP00092 | Kimchi | *Methylocella tundrae* |
| SBP00092 | Kimchi | *Methylocella tundrae* |
| SBP00092 | Kimchi | *Methylococcus capsulatus* |
| SBP00092 | Kimchi | *Methylococcus capsulatus* |
| SBP00092 | Kimchi | *Methylocystis bryophila* |
| SBP00092 | Kimchi | *Methylocystis bryophila* |
| SBP00092 | Kimchi | *Methylocystis rosea* |
| SBP00092 | Kimchi | *Methylocystis rosea* |
| SBP00092 | Kimchi | *Methylocystis* sp. SC2 |
| SBP00092 | Kimchi | *Methylocystis* sp. SC2 |
| SBP00092 | Kimchi | *Methylomonas clara* |
| SBP00092 | Kimchi | *Methylomonas clara* |
| SBP00092 | Kimchi | *Methylomonas denitrificans* |
| SBP00092 | Kimchi | *Methylomonas denitrificans* |
| SBP00092 | Kimchi | *Methylophilus* sp. TWE2 |
| SBP00092 | Kimchi | *Methylophilus* sp. TWE2 |
| SBP00092 | Kimchi | *Methylorubrum extorquens* |
| SBP00092 | Kimchi | *Methylorubrum extorquens* |
| SBP00092 | Kimchi | *Methylorubrum populi* |
| SBP00092 | Kimchi | *Methylorubrum populi* |
| SBP00092 | Kimchi | *Methylosinus trichosporium* |
| SBP00092 | Kimchi | *Methylosinus trichosporium* |
| SBP00092 | Kimchi | *Methylotenera mobilis* |
| SBP00092 | Kimchi | *Methylotenera mobilis* |
| SBP00092 | Kimchi | *Methylotenera versatilis* |
| SBP00092 | Kimchi | *Methylotenera versatilis* |
| SBP00092 | Kimchi | *Methyloversatilis* sp. RAC08 |
| SBP00092 | Kimchi | *Methyloversatilis* sp. RAC08 |
| SBP00092 | Kimchi | *Methylovirgula ligni* |
| SBP00092 | Kimchi | *Methylovirgula ligni* |
| SBP00092 | Kimchi | *Methylovorus glucosotrophus* |
| SBP00092 | Kimchi | *Methylovorus glucosotrophus* |
| SBP00092 | Kimchi | *Methylovorus* sp. MP688 |
| SBP00092 | Kimchi | *Methylovorus* sp. MP688 |
| SBP00092 | Kimchi | *Microbacterium aurum* |
| SBP00092 | Kimchi | *Microbacterium aurum* |
| SBP00092 | Kimchi | *Microbacterium chocolatum* |
| SBP00092 | Kimchi | *Microbacterium chocolatum* |
| SBP00092 | Kimchi | *Microbacterium foliorum* |
| SBP00092 | Kimchi | *Microbacterium foliorum* |
| SBP00092 | Kimchi | *Microbacterium hominis* |
| SBP00092 | Kimchi | *Microbacterium hominis* |
| SBP00092 | Kimchi | *Microbacterium lemovicicum* |
| SBP00092 | Kimchi | *Microbacterium lemovicicum* |
| SBP00092 | Kimchi | *Microbacterium oleivorans* |
| SBP00092 | Kimchi | *Microbacterium oleivorans* |
| SBP00092 | Kimchi | *Microbacterium oxydans* |
| SBP00092 | Kimchi | *Microbacterium oxydans* |
| SBP00092 | Kimchi | *Microbacterium pygmaeum* |
| SBP00092 | Kimchi | *Microbacterium pygmaeum* |
| SBP00092 | Kimchi | *Microbacterium sediminis* |
| SBP00092 | Kimchi | *Microbacterium sediminis* |
| SBP00092 | Kimchi | *Microbacterium* sp. 1.5R |
| SBP00092 | Kimchi | *Microbacterium* sp. 1.5R |
| SBP00092 | Kimchi | *Microbacterium* sp. 10M-3C3 |
| SBP00092 | Kimchi | *Microbacterium* sp. 10M-3C3 |
| SBP00092 | Kimchi | *Microbacterium* sp. ABRD_28 |
| SBP00092 | Kimchi | *Microbacterium* sp. ABRD_28 |
| SBP00092 | Kimchi | *Microbacterium* sp. BH-3-3-3 |
| SBP00092 | Kimchi | *Microbacterium* sp. BH-3-3-3 |
| SBP00092 | Kimchi | *Microbacterium* sp. CGR1 |
| SBP00092 | Kimchi | *Microbacterium* sp. CGR1 |
| SBP00092 | Kimchi | *Microbacterium* sp. LKL04 |
| SBP00092 | Kimchi | *Microbacterium* sp. LKL04 |
| SBP00092 | Kimchi | *Microbacterium* sp. No. 7 |
| SBP00092 | Kimchi | *Microbacterium* sp. No. 7 |

TABLE 3-continued

List of species identified in each metagenomic sample of each SBP Sample

| SBP ID | SBP Host Common Name | Genus sp. |
| --- | --- | --- |
| SBP00092 | Kimchi | *Microbacterium* sp. PAMC 28756 |
| SBP00092 | Kimchi | *Microbacterium* sp. PAMC 28756 |
| SBP00092 | Kimchi | *Microbacterium* sp. PMS |
| SBP00092 | Kimchi | *Microbacterium* sp. PMS |
| SBP00092 | Kimchi | *Microbacterium* sp. TPU 3598 |
| SBP00092 | Kimchi | *Microbacterium* sp. TPU 3598 |
| SBP00092 | Kimchi | *Microbacterium* sp. XT11 |
| SBP00092 | Kimchi | *Microbacterium* sp. XT11 |
| SBP00092 | Kimchi | *Microbacterium* sp. Y-01 |
| SBP00092 | Kimchi | *Microbacterium* sp. Y-01 |
| SBP00092 | Kimchi | *Microbacterium testaceum* |
| SBP00092 | Kimchi | *Microbacterium testaceum* |
| SBP00092 | Kimchi | *Micrococcus luteus* |
| SBP00092 | Kimchi | *Micrococcus luteus* |
| SBP00092 | Kimchi | *Microlunatus phosphovorus* |
| SBP00092 | Kimchi | *Microlunatus phosphovorus* |
| SBP00092 | Kimchi | *Micromonospora chokoriensis* |
| SBP00092 | Kimchi | *Micromonospora chokoriensis* |
| SBP00092 | Kimchi | *Micromonospora coriariae* |
| SBP00092 | Kimchi | *Micromonospora coriariae* |
| SBP00092 | Kimchi | *Micromonospora coxensis* |
| SBP00092 | Kimchi | *Micromonospora coxensis* |
| SBP00092 | Kimchi | *Micromonospora echinaurantiaca* |
| SBP00092 | Kimchi | *Micromonospora echinaurantiaca* |
| SBP00092 | Kimchi | *Micromonospora echinofusca* |
| SBP00092 | Kimchi | *Micromonospora echinofusca* |
| SBP00092 | Kimchi | *Micromonospora echinospora* |
| SBP00092 | Kimchi | *Micromonospora echinospora* |
| SBP00092 | Kimchi | *Micromonospora krabiensis* |
| SBP00092 | Kimchi | *Micromonospora krabiensis* |
| SBP00092 | Kimchi | *Micromonospora narathiwatensis* |
| SBP00092 | Kimchi | *Micromonospora narathiwatensis* |
| SBP00092 | Kimchi | *Micromonospora purpureochromogenes* |
| SBP00092 | Kimchi | *Micromonospora purpureochromogenes* |
| SBP00092 | Kimchi | *Micromonospora rifamycinica* |
| SBP00092 | Kimchi | *Micromonospora rifamycinica* |
| SBP00092 | Kimchi | *Micromonospora* sp. B006 |
| SBP00092 | Kimchi | *Micromonospora* sp. B006 |
| SBP00092 | Kimchi | *Micromonospora* sp. WMMA2032 |
| SBP00092 | Kimchi | *Micromonospora* sp. WMMA2032 |
| SBP00092 | Kimchi | *Microterricola viridarii* |
| SBP00092 | Kimchi | *Microterricola viridarii* |
| SBP00092 | Kimchi | *Microvirga ossetica* |
| SBP00092 | Kimchi | *Microvirga ossetica* |
| SBP00092 | Kimchi | *Microvirga* sp. 17 mud 1-3 |
| SBP00092 | Kimchi | *Microvirga* sp. 17 mud 1-3 |
| SBP00092 | Kimchi | *Microvirgula aerodenitrificans* |
| SBP00092 | Kimchi | *Microvirgula aerodenitrificans* |
| SBP00092 | Kimchi | *Miniimonas* sp. S16 |
| SBP00092 | Kimchi | *Miniimonas* sp. S16 |
| SBP00092 | Kimchi | *Mitsuaria* sp. 7 |
| SBP00092 | Kimchi | *Mitsuaria* sp. 7 |
| SBP00092 | Kimchi | *Mixta gaviniae* |
| SBP00092 | Kimchi | *Mixta gaviniae* |
| SBP00092 | Kimchi | *Modestobacter marinus* |
| SBP00092 | Kimchi | *Modestobacter marinus* |
| SBP00092 | Kimchi | *Moraxella osloensis* |
| SBP00092 | Kimchi | *Moraxella osloensis* |
| SBP00092 | Kimchi | *Morganella morganii* |
| SBP00092 | Kimchi | *Morganella morganii* |
| SBP00092 | Kimchi | *Mucilaginibacter mallensis* |
| SBP00092 | Kimchi | *Mucilaginibacter mallensis* |
| SBP00092 | Kimchi | *Mucilaginibacter paludis* |
| SBP00092 | Kimchi | *Mucilaginibacter paludis* |
| SBP00092 | Kimchi | *Mucilaginibacter* sp. PAMC 26640 |
| SBP00092 | Kimchi | *Mucilaginibacter* sp. PAMC 26640 |
| SBP00092 | Kimchi | *Mycetocola* sp. 449 |
| SBP00092 | Kimchi | *Mycetocola* sp. 449 |
| SBP00092 | Kimchi | *Mycoavidus cysteinexigens* |
| SBP00092 | Kimchi | *Mycoavidus cysteinexigens* |
| SBP00092 | Kimchi | *Mycobacterium avium* |
| SBP00092 | Kimchi | *Mycobacterium avium* |
| SBP00092 | Kimchi | *Mycobacterium dioxanotrophicus* |
| SBP00092 | Kimchi | *Mycobacterium dioxanotrophicus* |
| SBP00092 | Kimchi | *Mycobacterium paragordonae* |
| SBP00092 | Kimchi | *Mycobacterium paragordonae* |

TABLE 3-continued

List of species identified in each metagenomic sample of each SBP Sample

| SBP ID | SBP Host Common Name | Genus sp. |
|---|---|---|
| SBP00092 | Kimchi | Mycobacterium sp. djl-10 |
| SBP00092 | Kimchi | Mycobacterium sp. djl-10 |
| SBP00092 | Kimchi | Mycobacterium sp. YC-RL4 |
| SBP00092 | Kimchi | Mycobacterium sp. YC-RL4 |
| SBP00092 | Kimchi | Mycolicibacterium aurum |
| SBP00092 | Kimchi | Mycolicibacterium aurum |
| SBP00092 | Kimchi | Mycolicibacterium chubuense |
| SBP00092 | Kimchi | Mycolicibacterium chubuense |
| SBP00092 | Kimchi | Mycolicibacterium gilvum |
| SBP00092 | Kimchi | Mycolicibacterium gilvum |
| SBP00092 | Kimchi | Mycolicibacterium goodii |
| SBP00092 | Kimchi | Mycolicibacterium goodii |
| SBP00092 | Kimchi | Mycolicibacterium smegmatis |
| SBP00092 | Kimchi | Mycolicibacterium smegmatis |
| SBP00092 | Kimchi | Mycolicibacterium vaccae |
| SBP00092 | Kimchi | Mycolicibacterium vaccae |
| SBP00092 | Kimchi | Mycolicibacterium vanbaalenii |
| SBP00092 | Kimchi | Mycolicibacterium vanbaalenii |
| SBP00092 | Kimchi | Mycoplasma alkalescens |
| SBP00092 | Kimchi | Mycoplasma alkalescens |
| SBP00092 | Kimchi | Mycoplasma dispar |
| SBP00092 | Kimchi | Mycoplasma dispar |
| SBP00092 | Kimchi | Mycoplasma mycoides |
| SBP00092 | Kimchi | Mycoplasma mycoides |
| SBP00092 | Kimchi | Myxococcus stipitatus |
| SBP00092 | Kimchi | Myxococcus stipitatus |
| SBP00092 | Kimchi | Nakamurella multipartita |
| SBP00092 | Kimchi | Nakamurella multipartita |
| SBP00092 | Kimchi | Nakamurella panacisegetis |
| SBP00092 | Kimchi | Nakamurella panacisegetis |
| SBP00092 | Kimchi | Neisseria sp. 10022 |
| SBP00092 | Kimchi | Neisseria sp. 10022 |
| SBP00092 | Kimchi | Neorhizobium galegae |
| SBP00092 | Kimchi | Neorhizobium galegae |
| SBP00092 | Kimchi | Neorhizobium sp. NCHU2750 |
| SBP00092 | Kimchi | Neorhizobium sp. NCHU2750 |
| SBP00092 | Kimchi | Neorhizobium sp. SOG26 |
| SBP00092 | Kimchi | Neorhizobium sp. SOG26 |
| SBP00092 | Kimchi | Nissabacter sp. SGAir0207 |
| SBP00092 | Kimchi | Nissabacter sp. SGAir0207 |
| SBP00092 | Kimchi | Nitratireductor basaltis |
| SBP00092 | Kimchi | Nitratireductor basaltis |
| SBP00092 | Kimchi | Nitratireductor sp. OM-1 |
| SBP00092 | Kimchi | Nitratireductor sp. OM-1 |
| SBP00092 | Kimchi | Nitrobacter hamburgensis |
| SBP00092 | Kimchi | Nitrobacter hamburgensis |
| SBP00092 | Kimchi | Nitrobacter winogradskyi |
| SBP00092 | Kimchi | Nitrobacter winogradskyi |
| SBP00092 | Kimchi | Nitrospirillum amazonense |
| SBP00092 | Kimchi | Nitrospirillum amazonense |
| SBP00092 | Kimchi | Nocardia brasiliensis |
| SBP00092 | Kimchi | Nocardia brasiliensis |
| SBP00092 | Kimchi | Nocardia cyriacigeorgica |
| SBP00092 | Kimchi | Nocardia cyriacigeorgica |
| SBP00092 | Kimchi | Nocardia farcinica |
| SBP00092 | Kimchi | Nocardia farcinica |
| SBP00092 | Kimchi | Nocardia nova |
| SBP00092 | Kimchi | Nocardia nova |
| SBP00092 | Kimchi | Nocardia seriolae |
| SBP00092 | Kimchi | Nocardia seriolae |
| SBP00092 | Kimchi | Nocardia sp. CFHS0054 |
| SBP00092 | Kimchi | Nocardia sp. CFHS0054 |
| SBP00092 | Kimchi | Nocardia sp. Y48 |
| SBP00092 | Kimchi | Nocardia sp. Y48 |
| SBP00092 | Kimchi | Nocardioides baekrokdamisoli |
| SBP00092 | Kimchi | Nocardioides baekrokdamisoli |
| SBP00092 | Kimchi | Nocardioides daphniae |
| SBP00092 | Kimchi | Nocardioides daphniae |
| SBP00092 | Kimchi | Nocardioides dokdonensis |
| SBP00092 | Kimchi | Nocardioides dokdonensis |
| SBP00092 | Kimchi | Nocardioides humi |
| SBP00092 | Kimchi | Nocardioides humi |
| SBP00092 | Kimchi | Nocardioides sp. 603 |
| SBP00092 | Kimchi | Nocardioides sp. 603 |
| SBP00092 | Kimchi | Nocardioides sp. 78 |
| SBP00092 | Kimchi | Nocardioides sp. 78 |

TABLE 3-continued

List of species identified in each metagenomic sample of each SBP Sample

| SBP ID | SBP Host Common Name | Genus sp. |
| --- | --- | --- |
| SBP00092 | Kimchi | *Nocardioides* sp. CF8 |
| SBP00092 | Kimchi | *Nocardioides* sp. CF8 |
| SBP00092 | Kimchi | *Nocardioides* sp. HY056 |
| SBP00092 | Kimchi | *Nocardioides* sp. HY056 |
| SBP00092 | Kimchi | *Nocardioides* sp. JS614 |
| SBP00092 | Kimchi | *Nocardioides* sp. JS614 |
| SBP00092 | Kimchi | *Nocardiopsis alba* |
| SBP00092 | Kimchi | *Nocardiopsis alba* |
| SBP00092 | Kimchi | *Nocardiopsis dassonvillei* |
| SBP00092 | Kimchi | *Nocardiopsis dassonvillei* |
| SBP00092 | Kimchi | *Nonomuraea* sp. ATCC 55076 |
| SBP00092 | Kimchi | *Nonomuraea* sp. ATCC 55076 |
| SBP00092 | Kimchi | *Novosphingobium aromaticivorans* |
| SBP00092 | Kimchi | *Novosphingobium aromaticivorans* |
| SBP00092 | Kimchi | *Novosphingobium resinovorum* |
| SBP00092 | Kimchi | *Novosphingobium resinovorum* |
| SBP00092 | Kimchi | *Novosphingobium* sp. P6W |
| SBP00092 | Kimchi | *Novosphingobium* sp. P6W |
| SBP00092 | Kimchi | *Novosphingobium* sp. THN1 |
| SBP00092 | Kimchi | *Novosphingobium* sp. THN1 |
| SBP00092 | Kimchi | *Novosphingobium tardaugens* |
| SBP00092 | Kimchi | *Novosphingobium tardaugens* |
| SBP00092 | Kimchi | *Obesumbacterium proteus* |
| SBP00092 | Kimchi | *Obesumbacterium proteus* |
| SBP00092 | Kimchi | *Oceanithermus profundus* |
| SBP00092 | Kimchi | *Oceanithermus profundus* |
| SBP00092 | Kimchi | *Ochrobactrum anthropi* |
| SBP00092 | Kimchi | *Ochrobactrum anthropi* |
| SBP00092 | Kimchi | *Ochrobactrum pituitosum* |
| SBP00092 | Kimchi | *Ochrobactrum pituitosum* |
| SBP00092 | Kimchi | *Ochrobactrum pseudogrignonense* |
| SBP00092 | Kimchi | *Ochrobactrum pseudogrignonense* |
| SBP00092 | Kimchi | *Ochrobactrum* sp. A44 |
| SBP00092 | Kimchi | *Ochrobactrum* sp. A44 |
| SBP00092 | Kimchi | *Octadecabacter antarcticus* |
| SBP00092 | Kimchi | *Octadecabacter antarcticus* |
| SBP00092 | Kimchi | *Octadecabacter arcticus* |
| SBP00092 | Kimchi | *Octadecabacter arcticus* |
| SBP00092 | Kimchi | *Oenococcus oeni* |
| SBP00092 | Kimchi | *Oenococcus oeni* |
| SBP00092 | Kimchi | *Oenococcus sicerae* |
| SBP00092 | Kimchi | *Oenococcus sicerae* |
| SBP00092 | Kimchi | *Oligotropha carboxidovorans* |
| SBP00092 | Kimchi | *Oligotropha carboxidovorans* |
| SBP00092 | Kimchi | *Opitutaceae bacterium* TAV5 |
| SBP00092 | Kimchi | *Opitutaceae bacterium* TAV5 |
| SBP00092 | Kimchi | *Opitutus* sp. GA5368 |
| SBP00092 | Kimchi | *Opitutus* sp. GA5368 |
| SBP00092 | Kimchi | *Opitutus terrae* |
| SBP00092 | Kimchi | *Opitutus terrae* |
| SBP00092 | Kimchi | *Ornithinimicrobium* sp. AMA3305 |
| SBP00092 | Kimchi | *Ornithinimicrobium* sp. AMA3305 |
| SBP00092 | Kimchi | *Orrella dioscoreae* |
| SBP00092 | Kimchi | *Orrella dioscoreae* |
| SBP00092 | Kimchi | *Ottowia oryzae* |
| SBP00092 | Kimchi | *Ottowia oryzae* |
| SBP00092 | Kimchi | *Ottowia* sp. oral taxon 894 |
| SBP00092 | Kimchi | *Ottowia* sp. oral taxon 894 |
| SBP00092 | Kimchi | *Paludisphaera borealis* |
| SBP00092 | Kimchi | *Paludisphaera borealis* |
| SBP00092 | Kimchi | *Pandoraea faecigallinarum* |
| SBP00092 | Kimchi | *Pandoraea faecigallinarum* |
| SBP00092 | Kimchi | *Pandoraea norimbergensis* |
| SBP00092 | Kimchi | *Pandoraea norimbergensis* |
| SBP00092 | Kimchi | *Pandoraea oxalativorans* |
| SBP00092 | Kimchi | *Pandoraea oxalativorans* |
| SBP00092 | Kimchi | *Pandoraea pnomenusa* |
| SBP00092 | Kimchi | *Pandoraea pnomenusa* |
| SBP00092 | Kimchi | *Pandoraea pulmonicola* |
| SBP00092 | Kimchi | *Pandoraea pulmonicola* |
| SBP00092 | Kimchi | *Pandoraea sputorum* |
| SBP00092 | Kimchi | *Pandoraea sputorum* |
| SBP00092 | Kimchi | *Pandoraea thiooxydans* |
| SBP00092 | Kimchi | *Pandoraea thiooxydans* |
| SBP00092 | Kimchi | *Pandoraea vervacti* |
| SBP00092 | Kimchi | *Pandoraea vervacti* |

TABLE 3-continued

List of species identified in each metagenomic sample of each SBP Sample

| SBP ID | SBP Host Common Name | Genus sp. |
| --- | --- | --- |
| SBP00092 | Kimchi | *Pannonibacter phragmitetus* |
| SBP00092 | Kimchi | *Pannonibacter phragmitetus* |
| SBP00092 | Kimchi | *Pantoea agglomerans* |
| SBP00092 | Kimchi | *Pantoea agglomerans* |
| SBP00092 | Kimchi | *Pantoea alhagi* |
| SBP00092 | Kimchi | *Pantoea alhagi* |
| SBP00092 | Kimchi | *Pantoea ananatis* |
| SBP00092 | Kimchi | *Pantoea ananatis* |
| SBP00092 | Kimchi | *Pantoea* sp. At-9b |
| SBP00092 | Kimchi | *Pantoea* sp. At-9b |
| SBP00092 | Kimchi | *Pantoea* sp. PSNIH1 |
| SBP00092 | Kimchi | *Pantoea* sp. PSNIH1 |
| SBP00092 | Kimchi | *Pantoea stewartii* |
| SBP00092 | Kimchi | *Pantoea stewartii* |
| SBP00092 | Kimchi | *Pantoea vagans* |
| SBP00092 | Kimchi | *Pantoea vagans* |
| SBP00092 | Kimchi | *Paraburkholderia aromaticivorans* |
| SBP00092 | Kimchi | *Paraburkholderia aromaticivorans* |
| SBP00092 | Kimchi | *Paraburkholderia caffeinilytica* |
| SBP00092 | Kimchi | *Paraburkholderia caffeinilytica* |
| SBP00092 | Kimchi | *Paraburkholderia caledonica* |
| SBP00092 | Kimchi | *Paraburkholderia caledonica* |
| SBP00092 | Kimchi | *Paraburkholderia caribensis* |
| SBP00092 | Kimchi | *Paraburkholderia caribensis* |
| SBP00092 | Kimchi | *Paraburkholderia hospita* |
| SBP00092 | Kimchi | *Paraburkholderia hospita* |
| SBP00092 | Kimchi | *Paraburkholderia phymatum* |
| SBP00092 | Kimchi | *Paraburkholderia phymatum* |
| SBP00092 | Kimchi | *Paraburkholderia phytofirmans* |
| SBP00092 | Kimchi | *Paraburkholderia phytofirmans* |
| SBP00092 | Kimchi | *Paraburkholderia* sp. DCR13 |
| SBP00092 | Kimchi | *Paraburkholderia* sp. DCR13 |
| SBP00092 | Kimchi | *Paraburkholderia* sp. SOS3 |
| SBP00092 | Kimchi | *Paraburkholderia* sp. SOS3 |
| SBP00092 | Kimchi | *Paraburkholderia sprentiae* |
| SBP00092 | Kimchi | *Paraburkholderia sprentiae* |
| SBP00092 | Kimchi | *Paraburkholderia terricola* |
| SBP00092 | Kimchi | *Paraburkholderia terricola* |
| SBP00092 | Kimchi | *Paraburkholderia xenovorans* |
| SBP00092 | Kimchi | *Paraburkholderia xenovorans* |
| SBP00092 | Kimchi | *Paracoccus aminophilus* |
| SBP00092 | Kimchi | *Paracoccus aminophilus* |
| SBP00092 | Kimchi | *Paracoccus aminovorans* |
| SBP00092 | Kimchi | *Paracoccus aminovorans* |
| SBP00092 | Kimchi | *Paracoccus contaminans* |
| SBP00092 | Kimchi | *Paracoccus contaminans* |
| SBP00092 | Kimchi | *Paracoccus denitrificans* |
| SBP00092 | Kimchi | *Paracoccus denitrificans* |
| SBP00092 | Kimchi | *Paracoccus* sp. Arc7-R13 |
| SBP00092 | Kimchi | *Paracoccus* sp. Arc7-R13 |
| SBP00092 | Kimchi | *Paracoccus* sp. BM15 |
| SBP00092 | Kimchi | *Paracoccus* sp. BM15 |
| SBP00092 | Kimchi | *Paracoccus* sp. CBA4604 |
| SBP00092 | Kimchi | *Paracoccus* sp. CBA4604 |
| SBP00092 | Kimchi | *Paracoccus* sp. SC2-6 |
| SBP00092 | Kimchi | *Paracoccus* sp. SC2-6 |
| SBP00092 | Kimchi | *Paracoccus yeei* |
| SBP00092 | Kimchi | *Paracoccus yeei* |
| SBP00092 | Kimchi | *Paracoccus zhejiangensis* |
| SBP00092 | Kimchi | *Paracoccus zhejiangensis* |
| SBP00092 | Kimchi | *Pararhodospirillum photometricum* |
| SBP00092 | Kimchi | *Pararhodospirillum photometricum* |
| SBP00092 | Kimchi | *Parvibaculum lavamentivorans* |
| SBP00092 | Kimchi | *Parvibaculum lavamentivorans* |
| SBP00092 | Kimchi | *Pasteurella multocida* |
| SBP00092 | Kimchi | *Pasteurella multocida* |
| SBP00092 | Kimchi | *Paucibacter* sp. KCTC 42545 |
| SBP00092 | Kimchi | *Paucibacter* sp. KCTC 42545 |
| SBP00092 | Kimchi | *Pectobacterium atrosepticum* |
| SBP00092 | Kimchi | *Pectobacterium atrosepticum* |
| SBP00092 | Kimchi | *Pectobacterium carotovorum* |
| SBP00092 | Kimchi | *Pectobacterium carotovorum* |
| SBP00092 | Kimchi | *Pectobacterium parmentieri* |
| SBP00092 | Kimchi | *Pectobacterium parmentieri* |
| SBP00092 | Kimchi | *Pectobacterium phage* CBB |
| SBP00092 | Kimchi | *Pectobacterium phage* CBB |

TABLE 3-continued

List of species identified in each metagenomic sample of each SBP Sample

| SBP ID | SBP Host Common Name | Genus sp. |
|---|---|---|
| SBP00092 | Kimchi | *Pectobacterium wasabiae* |
| SBP00092 | Kimchi | *Pectobacterium wasabiae* |
| SBP00092 | Kimchi | *Pediococcus acidilactici* |
| SBP00092 | Kimchi | *Pediococcus acidilactici* |
| SBP00092 | Kimchi | *Pediococcus claussenii* |
| SBP00092 | Kimchi | *Pediococcus claussenii* |
| SBP00092 | Kimchi | *Pediococcus damnosus* |
| SBP00092 | Kimchi | *Pediococcus damnosus* |
| SBP00092 | Kimchi | *Pediococcus inopinatus* |
| SBP00092 | Kimchi | *Pediococcus inopinatus* |
| SBP00092 | Kimchi | *Pediococcus pentosaceus* |
| SBP00092 | Kimchi | *Pediococcus pentosaceus* |
| SBP00092 | Kimchi | *Pedobacter cryoconitis* |
| SBP00092 | Kimchi | *Pedobacter cryoconitis* |
| SBP00092 | Kimchi | *Pedobacter ginsengisoli* |
| SBP00092 | Kimchi | *Pedobacter ginsengisoli* |
| SBP00092 | Kimchi | *Pedobacter heparinus* |
| SBP00092 | Kimchi | *Pedobacter heparinus* |
| SBP00092 | Kimchi | *Pedobacter* sp. eg |
| SBP00092 | Kimchi | *Pedobacter* sp. eg |
| SBP00092 | Kimchi | *Pedobacter* sp. G11 |
| SBP00092 | Kimchi | *Pedobacter* sp. G11 |
| SBP00092 | Kimchi | *Pedobacter* sp. PACM 27299 |
| SBP00092 | Kimchi | *Pedobacter* sp. PACM 27299 |
| SBP00092 | Kimchi | *Pedobacter steynii* |
| SBP00092 | Kimchi | *Pedobacter steynii* |
| SBP00092 | Kimchi | *Pelagibaca abyssi* |
| SBP00092 | Kimchi | *Pelagibaca abyssi* |
| SBP00092 | Kimchi | *Pelagibacterium halotolerans* |
| SBP00092 | Kimchi | *Pelagibacterium halotolerans* |
| SBP00092 | Kimchi | *Phaeobacter gallaeciensis* |
| SBP00092 | Kimchi | *Phaeobacter gallaeciensis* |
| SBP00092 | Kimchi | *Phaeobacter inhibens* |
| SBP00092 | Kimchi | *Phaeobacter inhibens* |
| SBP00092 | Kimchi | *Phenylobacterium* sp. HYN0004 |
| SBP00092 | Kimchi | *Phenylobacterium* sp. HYN0004 |
| SBP00092 | Kimchi | *Phenylobacterium zucineum* |
| SBP00092 | Kimchi | *Phenylobacterium zucineum* |
| SBP00092 | Kimchi | *Phreatobacter cathodiphilus* |
| SBP00092 | Kimchi | *Phreatobacter cathodiphilus* |
| SBP00092 | Kimchi | *Phreatobacter stygius* |
| SBP00092 | Kimchi | *Phreatobacter stygius* |
| SBP00092 | Kimchi | *Phycicoccus dokdonensis* |
| SBP00092 | Kimchi | *Phycicoccus dokdonensis* |
| SBP00092 | Kimchi | *Phycisphaera mikurensis* |
| SBP00092 | Kimchi | *Phycisphaera mikurensis* |
| SBP00092 | Kimchi | *Phyllobacterium zundukense* |
| SBP00092 | Kimchi | *Phyllobacterium zundukense* |
| SBP00092 | Kimchi | *Phytobacter ursingii* |
| SBP00092 | Kimchi | *Phytobacter ursingii* |
| SBP00092 | Kimchi | *Pigmentiphaga* sp. H8 |
| SBP00092 | Kimchi | *Pigmentiphaga* sp. H8 |
| SBP00092 | Kimchi | *Pimelobacter simplex* |
| SBP00092 | Kimchi | *Pimelobacter simplex* |
| SBP00092 | Kimchi | *Pirellula staleyi* |
| SBP00092 | Kimchi | *Pirellula staleyi* |
| SBP00092 | Kimchi | *Planctomyces* sp. SH-PL14 |
| SBP00092 | Kimchi | *Planctomyces* sp. SH-PL14 |
| SBP00092 | Kimchi | *Planctomyces* sp. SH-PL62 |
| SBP00092 | Kimchi | *Planctomyces* sp. SH-PL62 |
| SBP00092 | Kimchi | *Planctopirus limnophila* |
| SBP00092 | Kimchi | *Planctopirus limnophila* |
| SBP00092 | Kimchi | *Plantibacter flavus* |
| SBP00092 | Kimchi | *Plantibacter flavus* |
| SBP00092 | Kimchi | *Plantibacter* sp. |
| SBP00092 | Kimchi | *Plantibacter* sp. |
| SBP00092 | Kimchi | *Plantibacter* sp. PA-3-X8 |
| SBP00092 | Kimchi | *Plantibacter* sp. PA-3-X8 |
| SBP00092 | Kimchi | *Plautia stali* |
| SBP00092 | Kimchi | *Plautia stali* |
| SBP00092 | Kimchi | *Plautia stali symbiont* |
| SBP00092 | Kimchi | *Plautia stali symbiont* |
| SBP00092 | Kimchi | *Pleomorphomonas* sp. SM30 |
| SBP00092 | Kimchi | *Pleomorphomonas* sp. SM30 |
| SBP00092 | Kimchi | *Pluralibacter gergoviae* |
| SBP00092 | Kimchi | *Pluralibacter gergoviae* |

TABLE 3-continued

List of species identified in each metagenomic sample of each SBP Sample

| SBP ID | SBP Host Common Name | Genus sp. |
| --- | --- | --- |
| SBP00092 | Kimchi | *Polaromonas naphthalenivorans* |
| SBP00092 | Kimchi | *Polaromonas naphthalenivorans* |
| SBP00092 | Kimchi | *Polaromonas* sp. JS666 |
| SBP00092 | Kimchi | *Polaromonas* sp. JS666 |
| SBP00092 | Kimchi | *Polaromonas* sp. SP1 |
| SBP00092 | Kimchi | *Polaromonas* sp. SP1 |
| SBP00092 | Kimchi | *Polymorphum gilvum* |
| SBP00092 | Kimchi | *Polymorphum gilvum* |
| SBP00092 | Kimchi | *Porphyrobacter neustonensis* |
| SBP00092 | Kimchi | *Porphyrobacter neustonensis* |
| SBP00092 | Kimchi | *Porphyrobacter* sp. CACIAM 03H1 |
| SBP00092 | Kimchi | *Porphyrobacter* sp. CACIAM 03H1 |
| SBP00092 | Kimchi | *Porphyrobacter* sp. LM 6 |
| SBP00092 | Kimchi | *Porphyrobacter* sp. LM 6 |
| SBP00092 | Kimchi | *Pragia fontium* |
| SBP00092 | Kimchi | *Pragia fontium* |
| SBP00092 | Kimchi | *Prauserella marina* |
| SBP00092 | Kimchi | *Prauserella marina* |
| SBP00092 | Kimchi | *Pseudarthrobacter chlorophenolicus* |
| SBP00092 | Kimchi | *Pseudarthrobacter chlorophenolicus* |
| SBP00092 | Kimchi | *Pseudarthrobacter equi* |
| SBP00092 | Kimchi | *Pseudarthrobacter equi* |
| SBP00092 | Kimchi | *Pseudarthrobacter phenanthrenivorans* |
| SBP00092 | Kimchi | *Pseudarthrobacter phenanthrenivorans* |
| SBP00092 | Kimchi | *Pseudarthrobacter sulfonivorans* |
| SBP00092 | Kimchi | *Pseudarthrobacter sulfonivorans* |
| SBP00092 | Kimchi | *Pseudoflavitalea* sp. 5GH32-13 |
| SBP00092 | Kimchi | *Pseudoflavitalea* sp. 5GH32-13 |
| SBP00092 | Kimchi | *Pseudolabrys taiwanensis* |
| SBP00092 | Kimchi | *Pseudolabrys taiwanensis* |
| SBP00092 | Kimchi | *Pseudomonas aeruginosa* |
| SBP00092 | Kimchi | *Pseudomonas aeruginosa* |
| SBP00092 | Kimchi | *Pseudomonas agarici* |
| SBP00092 | Kimchi | *Pseudomonas agarici* |
| SBP00092 | Kimchi | *Pseudomonas alcaligenes* |
| SBP00092 | Kimchi | *Pseudomonas alcaligenes* |
| SBP00092 | Kimchi | *Pseudomonas antarctica* |
| SBP00092 | Kimchi | *Pseudomonas antarctica* |
| SBP00092 | Kimchi | *Pseudomonas azotoformans* |
| SBP00092 | Kimchi | *Pseudomonas azotoformans* |
| SBP00092 | Kimchi | *Pseudomonas brassicacearum* |
| SBP00092 | Kimchi | *Pseudomonas brassicacearum* |
| SBP00092 | Kimchi | *Pseudomonas brenneri* |
| SBP00092 | Kimchi | *Pseudomonas brenneri* |
| SBP00092 | Kimchi | *Pseudomonas cedrina* |
| SBP00092 | Kimchi | *Pseudomonas cedrina* |
| SBP00092 | Kimchi | *Pseudomonas chlororaphis* |
| SBP00092 | Kimchi | *Pseudomonas chlororaphis* |
| SBP00092 | Kimchi | *Pseudomonas cichorii* |
| SBP00092 | Kimchi | *Pseudomonas cichorii* |
| SBP00092 | Kimchi | *Pseudomonas citronellolis* |
| SBP00092 | Kimchi | *Pseudomonas citronellolis* |
| SBP00092 | Kimchi | *Pseudomonas corrugata* |
| SBP00092 | Kimchi | *Pseudomonas corrugata* |
| SBP00092 | Kimchi | *Pseudomonas cremoricolorata* |
| SBP00092 | Kimchi | *Pseudomonas cremoricolorata* |
| SBP00092 | Kimchi | *Pseudomonas entomophila* |
| SBP00092 | Kimchi | *Pseudomonas entomophila* |
| SBP00092 | Kimchi | *Pseudomonas extremaustralis* |
| SBP00092 | Kimchi | *Pseudomonas extremaustralis* |
| SBP00092 | Kimchi | *Pseudomonas extremorientalis* |
| SBP00092 | Kimchi | *Pseudomonas extremorientalis* |
| SBP00092 | Kimchi | *Pseudomonas fluorescens* |
| SBP00092 | Kimchi | *Pseudomonas fluorescens* |
| SBP00092 | Kimchi | *Pseudomonas fragi* |
| SBP00092 | Kimchi | *Pseudomonas fragi* |
| SBP00092 | Kimchi | *Pseudomonas frederiksbergensis* |
| SBP00092 | Kimchi | *Pseudomonas frederiksbergensis* |
| SBP00092 | Kimchi | *Pseudomonas fulva* |
| SBP00092 | Kimchi | *Pseudomonas fulva* |
| SBP00092 | Kimchi | *Pseudomonas furukawaii* |
| SBP00092 | Kimchi | *Pseudomonas furukawaii* |
| SBP00092 | Kimchi | *Pseudomonas knackmussii* |
| SBP00092 | Kimchi | *Pseudomonas knackmussii* |
| SBP00092 | Kimchi | *Pseudomonas koreensis* |
| SBP00092 | Kimchi | *Pseudomonas koreensis* |

TABLE 3-continued

List of species identified in each metagenomic sample of each SBP Sample

| SBP ID | SBP Host Common Name | Genus sp. |
|---|---|---|
| SBP00092 | Kimchi | *Pseudomonas kribbensis* |
| SBP00092 | Kimchi | *Pseudomonas kribbensis* |
| SBP00092 | Kimchi | *Pseudomonas libanensis* |
| SBP00092 | Kimchi | *Pseudomonas libanensis* |
| SBP00092 | Kimchi | *Pseudomonas lini* |
| SBP00092 | Kimchi | *Pseudomonas lini* |
| SBP00092 | Kimchi | *Pseudomonas lurida* |
| SBP00092 | Kimchi | *Pseudomonas lurida* |
| SBP00092 | Kimchi | *Pseudomonas mandelii* |
| SBP00092 | Kimchi | *Pseudomonas mandelii* |
| SBP00092 | Kimchi | *Pseudomonas mediterranea* |
| SBP00092 | Kimchi | *Pseudomonas mediterranea* |
| SBP00092 | Kimchi | *Pseudomonas mendocina* |
| SBP00092 | Kimchi | *Pseudomonas mendocina* |
| SBP00092 | Kimchi | *Pseudomonas moraviensis* |
| SBP00092 | Kimchi | *Pseudomonas moraviensis* |
| SBP00092 | Kimchi | *Pseudomonas mucidolens* |
| SBP00092 | Kimchi | *Pseudomonas mucidolens* |
| SBP00092 | Kimchi | *Pseudomonas orientalis* |
| SBP00092 | Kimchi | *Pseudomonas orientalis* |
| SBP00092 | Kimchi | *Pseudomonas oryzae* |
| SBP00092 | Kimchi | *Pseudomonas oryzae* |
| SBP00092 | Kimchi | *Pseudomonas palleroniana* |
| SBP00092 | Kimchi | *Pseudomonas palleroniana* |
| SBP00092 | Kimchi | *Pseudomonas parafulva* |
| SBP00092 | Kimchi | *Pseudomonas parafulva* |
| SBP00092 | Kimchi | *Pseudomonas plecoglossicida* |
| SBP00092 | Kimchi | *Pseudomonas plecoglossicida* |
| SBP00092 | Kimchi | *Pseudomonas poae* |
| SBP00092 | Kimchi | *Pseudomonas poae* |
| SBP00092 | Kimchi | *Pseudomonas prosekii* |
| SBP00092 | Kimchi | *Pseudomonas prosekii* |
| SBP00092 | Kimchi | *Pseudomonas protegens* |
| SBP00092 | Kimchi | *Pseudomonas protegens* |
| SBP00092 | Kimchi | *Pseudomonas psychrophila* |
| SBP00092 | Kimchi | *Pseudomonas psychrophila* |
| SBP00092 | Kimchi | *Pseudomonas psychrotolerans* |
| SBP00092 | Kimchi | *Pseudomonas psychrotolerans* |
| SBP00092 | Kimchi | *Pseudomonas putida* |
| SBP00092 | Kimchi | *Pseudomonas putida* |
| SBP00092 | Kimchi | *Pseudomonas reinekei* |
| SBP00092 | Kimchi | *Pseudomonas reinekei* |
| SBP00092 | Kimchi | *Pseudomonas resinovorans* |
| SBP00092 | Kimchi | *Pseudomonas resinovorans* |
| SBP00092 | Kimchi | *Pseudomonas rhizosphaerae* |
| SBP00092 | Kimchi | *Pseudomonas rhizosphaerae* |
| SBP00092 | Kimchi | *Pseudomonas rhodesiae* |
| SBP00092 | Kimchi | *Pseudomonas rhodesiae* |
| SBP00092 | Kimchi | *Pseudomonas sabulinigri* |
| SBP00092 | Kimchi | *Pseudomonas sabulinigri* |
| SBP00092 | Kimchi | *Pseudomonas saudiphocaensis* |
| SBP00092 | Kimchi | *Pseudomonas saudiphocaensis* |
| SBP00092 | Kimchi | *Pseudomonas silesiensis* |
| SBP00092 | Kimchi | *Pseudomonas silesiensis* |
| SBP00092 | Kimchi | *Pseudomonas sp.* |
| SBP00092 | Kimchi | *Pseudomonas sp.* |
| SBP00092 | Kimchi | *Pseudomonas sp.* 02C 26 |
| SBP00092 | Kimchi | *Pseudomonas sp.* 02C 26 |
| SBP00092 | Kimchi | *Pseudomonas sp.* 31-12 |
| SBP00092 | Kimchi | *Pseudomonas sp.* 31-12 |
| SBP00092 | Kimchi | *Pseudomonas sp.* 7SR1 |
| SBP00092 | Kimchi | *Pseudomonas sp.* 7SR1 |
| SBP00092 | Kimchi | *Pseudomonas sp.* ATCC 13867 |
| SBP00092 | Kimchi | *Pseudomonas sp.* ATCC 13867 |
| SBP00092 | Kimchi | *Pseudomonas sp.* B10 |
| SBP00092 | Kimchi | *Pseudomonas sp.* B10 |
| SBP00092 | Kimchi | *Pseudomonas sp.* CMR12a |
| SBP00092 | Kimchi | *Pseudomonas sp.* CMR12a |
| SBP00092 | Kimchi | *Pseudomonas sp.* CMR5c |
| SBP00092 | Kimchi | *Pseudomonas sp.* CMR5c |
| SBP00092 | Kimchi | *Pseudomonas sp.* DY-1 |
| SBP00092 | Kimchi | *Pseudomonas sp.* DY-1 |
| SBP00092 | Kimchi | *Pseudomonas sp.* FDAARGOS_380 |
| SBP00092 | Kimchi | *Pseudomonas sp.* FDAARGOS_380 |
| SBP00092 | Kimchi | *Pseudomonas sp.* GR 6-02 |
| SBP00092 | Kimchi | *Pseudomonas sp.* GR 6-02 |

TABLE 3-continued

List of species identified in each metagenomic sample of each SBP Sample

| SBP ID | SBP Host Common Name | Genus sp. |
|---|---|---|
| SBP00092 | Kimchi | *Pseudomonas* sp. LBUM920 |
| SBP00092 | Kimchi | *Pseudomonas* sp. LBUM920 |
| SBP00092 | Kimchi | *Pseudomonas* sp. LG1D9 |
| SBP00092 | Kimchi | *Pseudomonas* sp. LG1D9 |
| SBP00092 | Kimchi | *Pseudomonas* sp. LG1E9 |
| SBP00092 | Kimchi | *Pseudomonas* sp. LG1E9 |
| SBP00092 | Kimchi | *Pseudomonas* sp. MRSN12121 |
| SBP00092 | Kimchi | *Pseudomonas* sp. MRSN12121 |
| SBP00092 | Kimchi | *Pseudomonas* sp. NS1(2017) |
| SBP00092 | Kimchi | *Pseudomonas* sp. NS1(2017) |
| SBP00092 | Kimchi | *Pseudomonas* sp. R5-89-07 |
| SBP00092 | Kimchi | *Pseudomonas* sp. R5-89-07 |
| SBP00092 | Kimchi | *Pseudomonas* sp. RU47 |
| SBP00092 | Kimchi | *Pseudomonas* sp. RU47 |
| SBP00092 | Kimchi | *Pseudomonas* sp. S-6-2 |
| SBP00092 | Kimchi | *Pseudomonas* sp. S-6-2 |
| SBP00092 | Kimchi | *Pseudomonas* sp. S09G 359 |
| SBP00092 | Kimchi | *Pseudomonas* sp. S09G 359 |
| SBP00092 | Kimchi | *Pseudomonas* sp. StFLB209 |
| SBP00092 | Kimchi | *Pseudomonas* sp. StFLB209 |
| SBP00092 | Kimchi | *Pseudomonas* sp. TMW 2.1634 |
| SBP00092 | Kimchi | *Pseudomonas* sp. TMW 2.1634 |
| SBP00092 | Kimchi | *Pseudomonas* sp. URMO17WK12:I11 |
| SBP00092 | Kimchi | *Pseudomonas* sp. URMO17WK12:I11 |
| SBP00092 | Kimchi | *Pseudomonas stutzeri* |
| SBP00092 | Kimchi | *Pseudomonas stutzeri* |
| SBP00092 | Kimchi | *Pseudomonas synxantha* |
| SBP00092 | Kimchi | *Pseudomonas synxantha* |
| SBP00092 | Kimchi | *Pseudomonas syringae* |
| SBP00092 | Kimchi | *Pseudomonas syringae* |
| SBP00092 | Kimchi | *Pseudomonas taetrolens* |
| SBP00092 | Kimchi | *Pseudomonas taetrolens* |
| SBP00092 | Kimchi | *Pseudomonas thivervalensis* |
| SBP00092 | Kimchi | *Pseudomonas thivervalensis* |
| SBP00092 | Kimchi | *Pseudomonas tolaasii* |
| SBP00092 | Kimchi | *Pseudomonas tolaasij* |
| SBP00092 | Kimchi | *Pseudomonas trivialis* |
| SBP00092 | Kimchi | *Pseudomonas trivialis* |
| SBP00092 | Kimchi | *Pseudomonas umsongensis* |
| SBP00092 | Kimchi | *Pseudomonas umsongensis* |
| SBP00092 | Kimchi | *Pseudomonas vancouverensis* |
| SBP00092 | Kimchi | *Pseudomonas vancouverensis* |
| SBP00092 | Kimchi | *Pseudomonas veronii* |
| SBP00092 | Kimchi | *Pseudomonas veronii* |
| SBP00092 | Kimchi | *Pseudomonas versuta* |
| SBP00092 | Kimchi | *Pseudomonas versuta* |
| SBP00092 | Kimchi | *Pseudomonas viridiflava* |
| SBP00092 | Kimchi | *Pseudomonas viridiflava* |
| SBP00092 | Kimchi | *Pseudomonas xinjiangensis* |
| SBP00092 | Kimchi | *Pseudomonas xinjiangensis* |
| SBP00092 | Kimchi | *Pseudomonas yamanorum* |
| SBP00092 | Kimchi | *Pseudomonas yamanorum* |
| SBP00092 | Kimchi | *Pseudonocardia autotrophica* |
| SBP00092 | Kimchi | *Pseudonocardia autotrophica* |
| SBP00092 | Kimchi | *Pseudonocardia dioxanivorans* |
| SBP00092 | Kimchi | *Pseudonocardia dioxanivorans* |
| SBP00092 | Kimchi | *Pseudonocardia* sp. AL041005-10 |
| SBP00092 | Kimchi | *Pseudonocardia* sp. AL041005-10 |
| SBP00092 | Kimchi | *Pseudonocardia* sp. HH130629-09 |
| SBP00092 | Kimchi | *Pseudonocardia* sp. HH130629-09 |
| SBP00092 | Kimchi | *Pseudonocardia* sp. HH130630-07 |
| SBP00092 | Kimchi | *Pseudonocardia* sp. HH130630-07 |
| SBP00092 | Kimchi | *Pseudopedobacter saltans* |
| SBP00092 | Kimchi | *Pseudopedobacter saltans* |
| SBP00092 | Kimchi | *Pseudopropionibacterium propionicum* |
| SBP00092 | Kimchi | *Pseudopropionibacterium propionicum* |
| SBP00092 | Kimchi | *Pseudorhodoplanes sinuspersici* |
| SBP00092 | Kimchi | *Pseudorhodoplanes sinuspersici* |
| SBP00092 | Kimchi | *Pseudoxanthomonas spadix* |
| SBP00092 | Kimchi | *Pseudoxanthomonas spadix* |
| SBP00092 | Kimchi | *Pseudoxanthomonas suwonensis* |
| SBP00092 | Kimchi | *Pseudoxanthomonas suwonensis* |
| SBP00092 | Kimchi | *Psychrobacter alimentarius* |
| SBP00092 | Kimchi | *Psychrobacter alimentarius* |
| SBP00092 | Kimchi | *Qipengyuania sediminis* |
| SBP00092 | Kimchi | *Qipengyuania sediminis* |

TABLE 3-continued

List of species identified in each metagenomic sample of each SBP Sample

| SBP ID | SBP Host Common Name | Genus sp. |
|---|---|---|
| SBP00092 | Kimchi | *Rahnella aquatilis* |
| SBP00092 | Kimchi | *Rahnella aquatilis* |
| SBP00092 | Kimchi | *Rahnella* sp. ERMR1:05 |
| SBP00092 | Kimchi | *Rahnella* sp. ERMR1:05 |
| SBP00092 | Kimchi | *Rahnella* sp. Y9602 |
| SBP00092 | Kimchi | *Rahnella* sp. Y9602 |
| SBP00092 | Kimchi | *Ralstonia insidiosa* |
| SBP00092 | Kimchi | *Ralstonia insidiosa* |
| SBP00092 | Kimchi | *Ralstonia mannitolilytica* |
| SBP00092 | Kimchi | *Ralstonia mannitolilytica* |
| SBP00092 | Kimchi | *Ralstonia pickettii* |
| SBP00092 | Kimchi | *Ralstonia pickettii* |
| SBP00092 | Kimchi | *Ralstonia solanacearum* |
| SBP00092 | Kimchi | *Ralstonia solanacearum* |
| SBP00092 | Kimchi | *Ramlibacter tataouinensis* |
| SBP00092 | Kimchi | *Ramlibacter tataouinensis* |
| SBP00092 | Kimchi | *Raoultella ornithinolytica* |
| SBP00092 | Kimchi | *Raoultella ornithinolytica* |
| SBP00092 | Kimchi | *Raoultella planticola* |
| SBP00092 | Kimchi | *Raoultella planticola* |
| SBP00092 | Kimchi | *Raoultella terrigena* |
| SBP00092 | Kimchi | *Raoultella terrigena* |
| SBP00092 | Kimchi | *Rathayibacter festucae* |
| SBP00092 | Kimchi | *Rathayibacter festucae* |
| SBP00092 | Kimchi | *Rathayibacter iranicus* |
| SBP00092 | Kimchi | *Rathayibacter iranicus* |
| SBP00092 | Kimchi | *Rathayibacter rathayi* |
| SBP00092 | Kimchi | *Rathayibacter rathayi* |
| SBP00092 | Kimchi | *Rathayibacter tritici* |
| SBP00092 | Kimchi | *Rathayibacter tritici* |
| SBP00092 | Kimchi | *Rhizobacter gummiphilus* |
| SBP00092 | Kimchi | *Rhizobacter gummiphilus* |
| SBP00092 | Kimchi | *Rhizobium acidisoli* |
| SBP00092 | Kimchi | *Rhizobium acidisoli* |
| SBP00092 | Kimchi | *Rhizobium etli* |
| SBP00092 | Kimchi | *Rhizobium etli* |
| SBP00092 | Kimchi | *Rhizobium favelukesii* |
| SBP00092 | Kimchi | *Rhizobium favelukesii* |
| SBP00092 | Kimchi | *Rhizobium gallicum* |
| SBP00092 | Kimchi | *Rhizobium gallicum* |
| SBP00092 | Kimchi | *Rhizobium jaguaris* |
| SBP00092 | Kimchi | *Rhizobium jaguaris* |
| SBP00092 | Kimchi | *Rhizobium leguminosarum* |
| SBP00092 | Kimchi | *Rhizobium leguminosarum* |
| SBP00092 | Kimchi | *Rhizobium phaseoli* |
| SBP00092 | Kimchi | *Rhizobium phaseoli* |
| SBP00092 | Kimchi | *Rhizobium* sp. 11515TR |
| SBP00092 | Kimchi | *Rhizobium* sp. 11515TR |
| SBP00092 | Kimchi | *Rhizobium* sp. ACO-34A |
| SBP00092 | Kimchi | *Rhizobium* sp. ACO-34A |
| SBP00092 | Kimchi | *Rhizobium* sp. CIAT894 |
| SBP00092 | Kimchi | *Rhizobium* sp. CIAT894 |
| SBP00092 | Kimchi | *Rhizobium* sp. IE4771 |
| SBP00092 | Kimchi | *Rhizobium* sp. IE4771 |
| SBP00092 | Kimchi | *Rhizobium* sp. Kim5 |
| SBP00092 | Kimchi | *Rhizobium* sp. Kim5 |
| SBP00092 | Kimchi | *Rhizobium* sp. NT-26 |
| SBP00092 | Kimchi | *Rhizobium* sp. NT-26 |
| SBP00092 | Kimchi | *Rhizobium* sp. NXC14 |
| SBP00092 | Kimchi | *Rhizobium* sp. NXC14 |
| SBP00092 | Kimchi | *Rhizobium* sp. NXC24 |
| SBP00092 | Kimchi | *Rhizobium* sp. NXC24 |
| SBP00092 | Kimchi | *Rhizobium* sp. S41 |
| SBP00092 | Kimchi | *Rhizobium* sp. S41 |
| SBP00092 | Kimchi | *Rhizobium* sp. TAL182 |
| SBP00092 | Kimchi | *Rhizobium* sp. TAL182 |
| SBP00092 | Kimchi | *Rhizobium* sp. Y9 |
| SBP00092 | Kimchi | *Rhizobium* sp. Y9 |
| SBP00092 | Kimchi | *Rhizobium tropici* |
| SBP00092 | Kimchi | *Rhizobium tropici* |
| SBP00092 | Kimchi | *Rhizorhabdus dicambivorans* |
| SBP00092 | Kimchi | *Rhizorhabdus dicambivorans* |
| SBP00092 | Kimchi | *Rhodanobacter denitrificans* |
| SBP00092 | Kimchi | *Rhodanobacter denitrificans* |
| SBP00092 | Kimchi | *Rhodanobacteraceae bacterium* Dysh456 |
| SBP00092 | Kimchi | *Rhodanobacteraceae bacterium* Dysh456 |

TABLE 3-continued

List of species identified in each metagenomic sample of each SBP Sample

| SBP ID | SBP Host Common Name | Genus sp. |
|---|---|---|
| SBP00092 | Kimchi | *Rhodobacter blasticus* |
| SBP00092 | Kimchi | *Rhodobacter blasticus* |
| SBP00092 | Kimchi | *Rhodobacter capsulatus* |
| SBP00092 | Kimchi | *Rhodobacter capsulatus* |
| SBP00092 | Kimchi | *Rhodobacter* sp. CZR27 |
| SBP00092 | Kimchi | *Rhodobacter* sp. CZR27 |
| SBP00092 | Kimchi | *Rhodobacter* sp. LPB0142 |
| SBP00092 | Kimchi | *Rhodobacter* sp. LPB0142 |
| SBP00092 | Kimchi | *Rhodobacter sphaeroides* |
| SBP00092 | Kimchi | *Rhodobacter sphaeroides* |
| SBP00092 | Kimchi | *Rhodobacteraceae bacterium* QY30 |
| SBP00092 | Kimchi | *Rhodobacteraceae bacterium* QY30 |
| SBP00092 | Kimchi | *Rhodobiaceae bacterium* |
| SBP00092 | Kimchi | *Rhodobiaceae bacterium* |
| SBP00092 | Kimchi | *Rhodococcus erythropolis* |
| SBP00092 | Kimchi | *Rhodococcus erythropolis* |
| SBP00092 | Kimchi | *Rhodococcus fascians* |
| SBP00092 | Kimchi | *Rhodococcus fascians* |
| SBP00092 | Kimchi | *Rhodococcus hoagii* |
| SBP00092 | Kimchi | *Rhodococcus hoagii* |
| SBP00092 | Kimchi | *Rhodococcus opacus* |
| SBP00092 | Kimchi | *Rhodococcus opacus* |
| SBP00092 | Kimchi | *Rhodococcus qingshengii* |
| SBP00092 | Kimchi | *Rhodococcus qingshengii* |
| SBP00092 | Kimchi | *Rhodococcus rhodochrous* |
| SBP00092 | Kimchi | *Rhodococcus rhodochrous* |
| SBP00092 | Kimchi | *Rhodococcus ruber* |
| SBP00092 | Kimchi | *Rhodococcus ruber* |
| SBP00092 | Kimchi | *Rhodococcus* sp. 008 |
| SBP00092 | Kimchi | *Rhodococcus* sp. 008 |
| SBP00092 | Kimchi | *Rhodococcus* sp. B7740 |
| SBP00092 | Kimchi | *Rhodococcus* sp. B7740 |
| SBP00092 | Kimchi | *Rhodococcus* sp. BH4 |
| SBP00092 | Kimchi | *Rhodococcus* sp. BH4 |
| SBP00092 | Kimchi | *Rhodococcus* sp. NJ-530 |
| SBP00092 | Kimchi | *Rhodococcus* sp. NJ-530 |
| SBP00092 | Kimchi | *Rhodococcus* sp. P1Y |
| SBP00092 | Kimchi | *Rhodococcus* sp. P1Y |
| SBP00092 | Kimchi | *Rhodococcus* sp. PBTS 1 |
| SBP00092 | Kimchi | *Rhodococcus* sp. PBTS 1 |
| SBP00092 | Kimchi | *Rhodococcus* sp. PBTS 2 |
| SBP00092 | Kimchi | *Rhodococcus* sp. PBTS 2 |
| SBP00092 | Kimchi | *Rhodococcus* sp. S2-17 |
| SBP00092 | Kimchi | *Rhodococcus* sp. S2-17 |
| SBP00092 | Kimchi | *Rhodococcus* sp. YL-1 |
| SBP00092 | Kimchi | *Rhodococcus* sp. YL-1 |
| SBP00092 | Kimchi | *Rhodoferax antarcticus* |
| SBP00092 | Kimchi | *Rhodoferax antarcticus* |
| SBP00092 | Kimchi | *Rhodoferax ferrireducens* |
| SBP00092 | Kimchi | *Rhodoferax ferrireducens* |
| SBP00092 | Kimchi | *Rhodoferax koreense* |
| SBP00092 | Kimchi | *Rhodoferax koreense* |
| SBP00092 | Kimchi | *Rhodoferax saidenbachensis* |
| SBP00092 | Kimchi | *Rhodoferax saidenbachensis* |
| SBP00092 | Kimchi | *Rhodomicrobium vannielii* |
| SBP00092 | Kimchi | *Rhodomicrobium vannielii* |
| SBP00092 | Kimchi | *Rhodopirellula baltica* |
| SBP00092 | Kimchi | *Rhodopirellula baltica* |
| SBP00092 | Kimchi | *Rhodoplanes* sp. Z2-YC6860 |
| SBP00092 | Kimchi | *Rhodoplanes* sp. Z2-YC6860 |
| SBP00092 | Kimchi | *Rhodopseudomonas palustris* |
| SBP00092 | Kimchi | *Rhodopseudomonas palustris* |
| SBP00092 | Kimchi | *Rhodospirillum centenum* |
| SBP00092 | Kimchi | *Rhodospirillum centenum* |
| SBP00092 | Kimchi | *Rhodothermus marinus* |
| SBP00092 | Kimchi | *Rhodothermus marinus* |
| SBP00092 | Kimchi | *Rhodovulum* sp. MB263 |
| SBP00092 | Kimchi | *Rhodovulum* sp. MB263 |
| SBP00092 | Kimchi | *Rhodovulum sulfidophilum* |
| SBP00092 | Kimchi | *Rhodovulum sulfidophilum* |
| SBP00092 | Kimchi | *Roseateles depolymerans* |
| SBP00092 | Kimchi | *Roseateles depolymerans* |
| SBP00092 | Kimchi | *Roseibacterium elongatum* |
| SBP00092 | Kimchi | *Roseibacterium elongatum* |
| SBP00092 | Kimchi | *Roseitalea porphyridii* |
| SBP00092 | Kimchi | *Roseitalea porphyridii* |

TABLE 3-continued

List of species identified in each metagenomic sample of each SBP Sample

| SBP ID | SBP Host Common Name | Genus sp. |
| --- | --- | --- |
| SBP00092 | Kimchi | *Roseomonas gilardii* |
| SBP00092 | Kimchi | *Roseomonas gilardii* |
| SBP00092 | Kimchi | *Roseomonas* sp. FDAARGOS_362 |
| SBP00092 | Kimchi | *Roseomonas* sp. FDAARGOS_362 |
| SBP00092 | Kimchi | *Rubinisphaera brasiliensis* |
| SBP00092 | Kimchi | *Rubinisphaera brasiliensis* |
| SBP00092 | Kimchi | *Rubrivivax gelatinosus* |
| SBP00092 | Kimchi | *Rubrivivax gelatinosus* |
| SBP00092 | Kimchi | *Ruegeria pomeroyi* |
| SBP00092 | Kimchi | *Ruegeria pomeroyi* |
| SBP00092 | Kimchi | *Saccharophagus degradans* |
| SBP00092 | Kimchi | *Saccharophagus degradans* |
| SBP00092 | Kimchi | *Saccharopolyspora erythraea* |
| SBP00092 | Kimchi | *Saccharopolyspora erythraea* |
| SBP00092 | Kimchi | *Saccharothrix espanaensis* |
| SBP00092 | Kimchi | *Saccharothrix espanaensis* |
| SBP00092 | Kimchi | *Sagittula* sp. P11 |
| SBP00092 | Kimchi | *Sagittula* sp. P11 |
| SBP00092 | Kimchi | *Salinibacter ruber* |
| SBP00092 | Kimchi | *Salinibacter ruber* |
| SBP00092 | Kimchi | *Salinicola tamaricis* |
| SBP00092 | Kimchi | *Salinicola tamaricis* |
| SBP00092 | Kimchi | *Salipiger profundus* |
| SBP00092 | Kimchi | *Salipiger profundus* |
| SBP00092 | Kimchi | *Salmonella bongori* |
| SBP00092 | Kimchi | *Salmonella bongori* |
| SBP00092 | Kimchi | *Salmonella enterica* |
| SBP00092 | Kimchi | *Salmonella enterica* |
| SBP00092 | Kimchi | *Sandaracinus amylolyticus* |
| SBP00092 | Kimchi | *Sandaracinus amylolyticus* |
| SBP00092 | Kimchi | *Sanguibacter keddieii* |
| SBP00092 | Kimchi | *Sanguibacter keddieii* |
| SBP00092 | Kimchi | *Serinicoccus* sp. JLT9 |
| SBP00092 | Kimchi | *Serinicoccus* sp. JLT9 |
| SBP00092 | Kimchi | *Serpentinomonas mccroryi* |
| SBP00092 | Kimchi | *Serpentinomonas mccroryi* |
| SBP00092 | Kimchi | *Serpentinomonas raichei* |
| SBP00092 | Kimchi | *Serpentinomonas raichei* |
| SBP00092 | Kimchi | *Serratia fonticola* |
| SBP00092 | Kimchi | *Serratia fonticola* |
| SBP00092 | Kimchi | *Serratia liquefaciens* |
| SBP00092 | Kimchi | *Serratia liquefaciens* |
| SBP00092 | Kimchi | *Serratia marcescens* |
| SBP00092 | Kimchi | *Serratia marcescens* |
| SBP00092 | Kimchi | *Serratia odorifera* |
| SBP00092 | Kimchi | *Serratia odorifera* |
| SBP00092 | Kimchi | *Serratia plymuthica* |
| SBP00092 | Kimchi | *Serratia plymuthica* |
| SBP00092 | Kimchi | *Serratia proteamaculans* |
| SBP00092 | Kimchi | *Serratia proteamaculans* |
| SBP00092 | Kimchi | *Serratia quinivorans* |
| SBP00092 | Kimchi | *Serratia quinivorans* |
| SBP00092 | Kimchi | *Serratia rubidaea* |
| SBP00092 | Kimchi | *Serratia rubidaea* |
| SBP00092 | Kimchi | *Serratia* sp. |
| SBP00092 | Kimchi | *Serratia* sp. |
| SBP00092 | Kimchi | *Serratia* sp. 3ACOL1 |
| SBP00092 | Kimchi | *Serratia* sp. 3ACOL1 |
| SBP00092 | Kimchi | *Serratia* sp. ATCC 39006 |
| SBP00092 | Kimchi | *Serratia* sp. ATCC 39006 |
| SBP00092 | Kimchi | *Serratia* sp. P2ACOL2 |
| SBP00092 | Kimchi | *Serratia* sp. P2ACOL2 |
| SBP00092 | Kimchi | *Shewanella baltica* |
| SBP00092 | Kimchi | *Shewanella baltica* |
| SBP00092 | Kimchi | *Shewanella putrefaciens* |
| SBP00092 | Kimchi | *Shewanella putrefaciens* |
| SBP00092 | Kimchi | *Shimwellia blattae* |
| SBP00092 | Kimchi | *Shimwellia blattae* |
| SBP00092 | Kimchi | *Shinella* sp. HZN7 |
| SBP00092 | Kimchi | *Shinella* sp. HZN7 |
| SBP00092 | Kimchi | *Siansivirga zeaxanthinifaciens* |
| SBP00092 | Kimchi | *Siansivirga zeaxanthinifaciens* |
| SBP00092 | Kimchi | *Silicimonas algicola* |
| SBP00092 | Kimchi | *Silicimonas algicola* |
| SBP00092 | Kimchi | *Simplicispira suum* |
| SBP00092 | Kimchi | *Simplicispira suum* |

TABLE 3-continued

List of species identified in each metagenomic sample of each SBP Sample

| SBP ID | SBP Host Common Name | Genus sp. |
| --- | --- | --- |
| SBP00092 | Kimchi | *Singulisphaera acidiphila* |
| SBP00092 | Kimchi | *Singulisphaera acidiphila* |
| SBP00092 | Kimchi | *Sinomonas atrocyanea* |
| SBP00092 | Kimchi | *Sinomonas atrocyanea* |
| SBP00092 | Kimchi | *Sinorhizobium americanum* |
| SBP00092 | Kimchi | *Sinorhizobium americanum* |
| SBP00092 | Kimchi | *Sinorhizobium fredii* |
| SBP00092 | Kimchi | *Sinorhizobium fredii* |
| SBP00092 | Kimchi | *Sinorhizobium medicae* |
| SBP00092 | Kimchi | *Sinorhizobium medicae* |
| SBP00092 | Kimchi | *Sinorhizobium meliloti* |
| SBP00092 | Kimchi | *Sinorhizobium meliloti* |
| SBP00092 | Kimchi | *Sinorhizobium* sp. RAC02 |
| SBP00092 | Kimchi | *Sinorhizobium* sp. RAC02 |
| SBP00092 | Kimchi | *Sodalis praecaptivus* |
| SBP00092 | Kimchi | *Sodalis praecaptivus* |
| SBP00092 | Kimchi | *Solimonas* sp. K1W22B-7 |
| SBP00092 | Kimchi | *Solimonas* sp. K1W22B-7 |
| SBP00092 | Kimchi | *Sorangium cellulosum* |
| SBP00092 | Kimchi | *Sorangium cellulosum* |
| SBP00092 | Kimchi | *Sphingobacteriaceae bacterium* GW460-11-11-14-LB5 |
| SBP00092 | Kimchi | *Sphingobacteriaceae bacterium* GW460-11-11-14-LB5 |
| SBP00092 | Kimchi | *Sphingobacterium* sp. 21 |
| SBP00092 | Kimchi | *Sphingobacterium* sp. 21 |
| SBP00092 | Kimchi | *Sphingobacterium* sp. ML3W |
| SBP00092 | Kimchi | *Sphingobacterium* sp. ML3W |
| SBP00092 | Kimchi | *Sphingobium amiense* |
| SBP00092 | Kimchi | *Sphingobium amiense* |
| SBP00092 | Kimchi | *Sphingobium baderi* |
| SBP00092 | Kimchi | *Sphingobium baderi* |
| SBP00092 | Kimchi | *Sphingobium chlorophenolicum* |
| SBP00092 | Kimchi | *Sphingobium chlorophenolicum* |
| SBP00092 | Kimchi | *Sphingobium cloacae* |
| SBP00092 | Kimchi | *Sphingobium cloacae* |
| SBP00092 | Kimchi | *Sphingobium herbicidovorans* |
| SBP00092 | Kimchi | *Sphingobium herbicidovorans* |
| SBP00092 | Kimchi | *Sphingobium hydrophobicum* |
| SBP00092 | Kimchi | *Sphingobium hydrophobicum* |
| SBP00092 | Kimchi | *Sphingobium* sp. EP60837 |
| SBP00092 | Kimchi | *Sphingobium* sp. EP60837 |
| SBP00092 | Kimchi | *Sphingobium* sp. RAC03 |
| SBP00092 | Kimchi | *Sphingobium* sp. RAC03 |
| SBP00092 | Kimchi | *Sphingobium* sp. SYK-6 |
| SBP00092 | Kimchi | *Sphingobium* sp. SYK-6 |
| SBP00092 | Kimchi | *Sphingobium* sp. TK5 |
| SBP00092 | Kimchi | *Sphingobium* sp. TK5 |
| SBP00092 | Kimchi | *Sphingobium* sp. YBL2 |
| SBP00092 | Kimchi | *Sphingobium* sp. YBL2 |
| SBP00092 | Kimchi | *Sphingobium* sp. YG1 |
| SBP00092 | Kimchi | *Sphingobium* sp. YG1 |
| SBP00092 | Kimchi | *Sphingobium yanoikuyae* |
| SBP00092 | Kimchi | *Sphingobium yanoikuyae* |
| SBP00092 | Kimchi | *Sphingomonas indica* |
| SBP00092 | Kimchi | *Sphingomonas indica* |
| SBP00092 | Kimchi | *Sphingomonas koreensis* |
| SBP00092 | Kimchi | *Sphingomonas koreensis* |
| SBP00092 | Kimchi | *Sphingomonas melonis* |
| SBP00092 | Kimchi | *Sphingomonas melonis* |
| SBP00092 | Kimchi | *Sphingomonas panacis* |
| SBP00092 | Kimchi | *Sphingomonas panacis* |
| SBP00092 | Kimchi | *Sphingomonas paucimobilis* |
| SBP00092 | Kimchi | *Sphingomonas paucimobilis* |
| SBP00092 | Kimchi | *Sphingomonas sanxanigenens* |
| SBP00092 | Kimchi | *Sphingomonas sanxanigenens* |
| SBP00092 | Kimchi | *Sphingomonas* sp. AAP5 |
| SBP00092 | Kimchi | *Sphingomonas* sp. AAP5 |
| SBP00092 | Kimchi | *Sphingomonas* sp. C8-2 |
| SBP00092 | Kimchi | *Sphingomonas* sp. C8-2 |
| SBP00092 | Kimchi | *Sphingomonas* sp. Cra20 |
| SBP00092 | Kimchi | *Sphingomonas* sp. Cra20 |
| SBP00092 | Kimchi | *Sphingomonas* sp. FARSPH |
| SBP00092 | Kimchi | *Sphingomonas* sp. FARSPH |
| SBP00092 | Kimchi | *Sphingomonas* sp. JJ-A5 |
| SBP00092 | Kimchi | *Sphingomonas* sp. JJ-A5 |
| SBP00092 | Kimchi | *Sphingomonas* sp. KC8 |
| SBP00092 | Kimchi | *Sphingomonas* sp. KC8 |

TABLE 3-continued

List of species identified in each metagenomic sample of each SBP Sample

| SBP ID | SBP Host Common Name | Genus sp. |
|---|---|---|
| SBP00092 | Kimchi | Sphingomonas sp. LK11 |
| SBP00092 | Kimchi | Sphingomonas sp. LK11 |
| SBP00092 | Kimchi | Sphingomonas sp. LM7 |
| SBP00092 | Kimchi | Sphingomonas sp. LM7 |
| SBP00092 | Kimchi | Sphingomonas sp. MM-1 |
| SBP00092 | Kimchi | Sphingomonas sp. MM-1 |
| SBP00092 | Kimchi | Sphingomonas sp. NIC1 |
| SBP00092 | Kimchi | Sphingomonas sp. NIC1 |
| SBP00092 | Kimchi | Sphingomonas sp. YZ-8 |
| SBP00092 | Kimchi | Sphingomonas sp. YZ-8 |
| SBP00092 | Kimchi | Sphingomonas taxi |
| SBP00092 | Kimchi | Sphingomonas taxi |
| SBP00092 | Kimchi | Sphingomonas wittichii |
| SBP00092 | Kimchi | Sphingomonas wittichii |
| SBP00092 | Kimchi | Sphingopyxis alaskensis |
| SBP00092 | Kimchi | Sphingopyxis alaskensis |
| SBP00092 | Kimchi | Sphingopyxis fribergensis |
| SBP00092 | Kimchi | Sphingopyxis fribergensis |
| SBP00092 | Kimchi | Sphingopyxis granuli |
| SBP00092 | Kimchi | Sphingopyxis granuli |
| SBP00092 | Kimchi | Sphingopyxis macrogoltabida |
| SBP00092 | Kimchi | Sphingopyxis macrogoltabida |
| SBP00092 | Kimchi | Sphingopyxis sp. 113P3 |
| SBP00092 | Kimchi | Sphingopyxis sp. 113P3 |
| SBP00092 | Kimchi | Sphingopyxis sp. EG6 |
| SBP00092 | Kimchi | Sphingopyxis sp. EG6 |
| SBP00092 | Kimchi | Sphingopyxis sp. FD7 |
| SBP00092 | Kimchi | Sphingopyxis sp. FD7 |
| SBP00092 | Kimchi | Sphingopyxis sp. QXT-31 |
| SBP00092 | Kimchi | Sphingopyxis sp. QXT-31 |
| SBP00092 | Kimchi | Sphingopyxis sp. WS5A3p |
| SBP00092 | Kimchi | Sphingopyxis sp. WS5A3p |
| SBP00092 | Kimchi | Sphingorhabdus sp. YGSMI21 |
| SBP00092 | Kimchi | Sphingorhabdus sp. YGSMI21 |
| SBP00092 | Kimchi | Sphingosinicella microcystinivorans |
| SBP00092 | Kimchi | Sphingosinicella microcystinivorans |
| SBP00092 | Kimchi | Sphingosinicella sp. BN140058 |
| SBP00092 | Kimchi | Sphingosinicella sp. BN140058 |
| SBP00092 | Kimchi | Stackebrandtia nassauensis |
| SBP00092 | Kimchi | Stackebrandtia nassauensis |
| SBP00092 | Kimchi | Staphylococcus aureus |
| SBP00092 | Kimchi | Staphylococcus aureus |
| SBP00092 | Kimchi | Staphylococcus epidermidis |
| SBP00092 | Kimchi | Staphylococcus epidermidis |
| SBP00092 | Kimchi | Staphylococcus pasteuri |
| SBP00092 | Kimchi | Staphylococcus pasteuri |
| SBP00092 | Kimchi | Staphylococcus sciuri |
| SBP00092 | Kimchi | Staphylococcus sciuri |
| SBP00092 | Kimchi | Staphylococcus simulans |
| SBP00092 | Kimchi | Staphylococcus simulans |
| SBP00092 | Kimchi | Stappia sp. ES.058 |
| SBP00092 | Kimchi | Stappia sp. ES.058 |
| SBP00092 | Kimchi | Starkeya novella |
| SBP00092 | Kimchi | Starkeya novella |
| SBP00092 | Kimchi | Stella humosa |
| SBP00092 | Kimchi | Stella humosa |
| SBP00092 | Kimchi | Stella vacuolata |
| SBP00092 | Kimchi | Stella vacuolata |
| SBP00092 | Kimchi | Stenotrophomonas acidaminiphila |
| SBP00092 | Kimchi | Stenotrophomonas acidaminiphila |
| SBP00092 | Kimchi | Stenotrophomonas maltophilia |
| SBP00092 | Kimchi | Stenotrophomonas maltophilia |
| SBP00092 | Kimchi | Stenotrophomonas rhizophila |
| SBP00092 | Kimchi | Stenotrophomonas rhizophila |
| SBP00092 | Kimchi | Stenotrophomonas sp. |
| SBP00092 | Kimchi | Stenotrophomonas sp. |
| SBP00092 | Kimchi | Stenotrophomonas sp. ESTM1D_MKCIP4_1 |
| SBP00092 | Kimchi | Stenotrophomonas sp. ESTMID_MKCIP4_1 |
| SBP00092 | Kimchi | Stenotrophomonas sp. G4 |
| SBP00092 | Kimchi | Stenotrophomonas sp. G4 |
| SBP00092 | Kimchi | Stenotrophomonas sp. LM091 |
| SBP00092 | Kimchi | Stenotrophomonas sp. LM091 |
| SBP00092 | Kimchi | Stenotrophomonas sp. MYb57 |
| SBP00092 | Kimchi | Stenotrophomonas sp. MYb57 |
| SBP00092 | Kimchi | Stenotrophomonas sp. Pemsol |
| SBP00092 | Kimchi | Stenotrophomonas sp. Pemsol |

TABLE 3-continued

List of species identified in each metagenomic sample of each SBP Sample

| SBP ID | SBP Host Common Name | Genus sp. |
|---|---|---|
| SBP00092 | Kimchi | *Stenotrophomonas* sp. SAU14A_NAIMI4_5 |
| SBP00092 | Kimchi | *Stenotrophomonas* sp. SAU14A_NAIMI4_5 |
| SBP00092 | Kimchi | *Stenotrophomonas* sp. SAU14A_NAIMI4_8 |
| SBP00092 | Kimchi | *Stenotrophomonas* sp. SAU14A_NAIMI4_8 |
| SBP00092 | Kimchi | *Stenotrophomonas* sp. YAU14A_MKIMI4_1 |
| SBP00092 | Kimchi | *Stenotrophomonas* sp. YAU14A_MKIMI4_1 |
| SBP00092 | Kimchi | *Stenotrophomonas* sp. YAU14D1_LEIMI4_1 |
| SBP00092 | Kimchi | *Stenotrophomonas* sp. YAU14D1_LEIMI4_1 |
| SBP00092 | Kimchi | *Stenotrophomonas* sp. ZAC14A_NAIMI4_1 |
| SBP00092 | Kimchi | *Stenotrophomonas* sp. ZAC14A_NAIMI4_1 |
| SBP00092 | Kimchi | *Stenotrophomonas* sp. ZAC14D2_NAIMI4_6 |
| SBP00092 | Kimchi | *Stenotrophomonas* sp. ZAC14D2_NAIMI4_6 |
| SBP00092 | Kimchi | *Stenotrophomonas* sp. ZAC14D2_NAIMI4_7 |
| SBP00092 | Kimchi | *Stenotrophomonas* sp. ZAC14D2_NAIMI4_7 |
| SBP00092 | Kimchi | *Stigmatella aurantiaca* |
| SBP00092 | Kimchi | *Stigmatella aurantiaca* |
| SBP00092 | Kimchi | *Streptococcus canis* |
| SBP00092 | Kimchi | *Streptococcus canis* |
| SBP00092 | Kimchi | *Streptococcus gordonii* |
| SBP00092 | Kimchi | *Streptococcus gordonii* |
| SBP00092 | Kimchi | *Streptococcus infantarius* |
| SBP00092 | Kimchi | *Streptococcus infantarius* |
| SBP00092 | Kimchi | *Streptococcus macedonicus* |
| SBP00092 | Kimchi | *Streptococcus macedonicus* |
| SBP00092 | Kimchi | *Streptococcus parauberis* |
| SBP00092 | Kimchi | *Streptococcus parauberis* |
| SBP00092 | Kimchi | *Streptococcus* sp. FDAARGOS_521 |
| SBP00092 | Kimchi | *Streptococcus* sp. FDAARGOS_521 |
| SBP00092 | Kimchi | *Streptococcus thermophilus* |
| SBP00092 | Kimchi | *Streptococcus thermophilus* |
| SBP00092 | Kimchi | *Streptococcus troglodytae* |
| SBP00092 | Kimchi | *Streptococcus troglodytae* |
| SBP00092 | Kimchi | *Streptomyces albireticuli* |
| SBP00092 | Kimchi | *Streptomyces albireticuli* |
| SBP00092 | Kimchi | *Streptomyces alboflavus* |
| SBP00092 | Kimchi | *Streptomyces alboflavus* |
| SBP00092 | Kimchi | *Streptomyces albulus* |
| SBP00092 | Kimchi | *Streptomyces albulus* |
| SBP00092 | Kimchi | *Streptomyces albus* |
| SBP00092 | Kimchi | *Streptomyces albus* |
| SBP00092 | Kimchi | *Streptomyces asterosporus* |
| SBP00092 | Kimchi | *Streptomyces asterosporus* |
| SBP00092 | Kimchi | *Streptomyces chartreusis* |
| SBP00092 | Kimchi | *Streptomyces chartreusis* |
| SBP00092 | Kimchi | *Streptomyces davaonensis* |
| SBP00092 | Kimchi | *Streptomyces davaonensis* |
| SBP00092 | Kimchi | *Streptomyces globosus* |
| SBP00092 | Kimchi | *Streptomyces globosus* |
| SBP00092 | Kimchi | *Streptomyces griseochromogenes* |
| SBP00092 | Kimchi | *Streptomyces griseochromogenes* |
| SBP00092 | Kimchi | *Streptomyces griseoviridis* |
| SBP00092 | Kimchi | *Streptomyces griseoviridis* |
| SBP00092 | Kimchi | *Streptomyces hygroscopicus* |
| SBP00092 | Kimchi | *Streptomyces hygroscopicus* |
| SBP00092 | Kimchi | *Streptomyces lavendulae* |
| SBP00092 | Kimchi | *Streptomyces lavendulae* |
| SBP00092 | Kimchi | *Streptomyces luteoverticillatus* |
| SBP00092 | Kimchi | *Streptomyces luteoverticillatus* |
| SBP00092 | Kimchi | *Streptomyces lydicus* |
| SBP00092 | Kimchi | *Streptomyces lydicus* |
| SBP00092 | Kimchi | *Streptomyces nigra* |
| SBP00092 | Kimchi | *Streptomyces nigra* |
| SBP00092 | Kimchi | *Streptomyces niveus* |
| SBP00092 | Kimchi | *Streptomyces niveus* |
| SBP00092 | Kimchi | *Streptomyces puniciscabiei* |
| SBP00092 | Kimchi | *Streptomyces puniciscabiei* |
| SBP00092 | Kimchi | *Streptomyces reticuli* |
| SBP00092 | Kimchi | *Streptomyces reticuli* |
| SBP00092 | Kimchi | *Streptomyces rimosus* |
| SBP00092 | Kimchi | *Streptomyces rimosus* |
| SBP00092 | Kimchi | *Streptomyces* sp. 769 |
| SBP00092 | Kimchi | *Streptomyces* sp. 769 |
| SBP00092 | Kimchi | *Streptomyces* sp. CMB-StM0423 |
| SBP00092 | Kimchi | *Streptomyces* sp. CMB-StM0423 |
| SBP00092 | Kimchi | *Streptomyces* sp. Go-475 |
| SBP00092 | Kimchi | *Streptomyces* sp. Go-475 |

TABLE 3-continued

List of species identified in each metagenomic sample of each SBP Sample

| SBP ID | SBP Host Common Name | Genus sp. |
|---|---|---|
| SBP00092 | Kimchi | *Streptomyces* sp. GSSD-12 |
| SBP00092 | Kimchi | *Streptomyces* sp. GSSD-12 |
| SBP00092 | Kimchi | *Streptomyces* sp. MOE7 |
| SBP00092 | Kimchi | *Streptomyces* sp. MOE7 |
| SBP00092 | Kimchi | *Streptomyces* sp. P3 |
| SBP00092 | Kimchi | *Streptomyces* sp. P3 |
| SBP00092 | Kimchi | *Streptomyces* sp. S063 |
| SBP00092 | Kimchi | *Streptomyces* sp. S063 |
| SBP00092 | Kimchi | *Streptomyces* sp. SCSIO 03032 |
| SBP00092 | Kimchi | *Streptomyces* sp. SCSIO 03032 |
| SBP00092 | Kimchi | *Streptomyces* sp. TLI_053 |
| SBP00092 | Kimchi | *Streptomyces* sp. TLI_053 |
| SBP00092 | Kimchi | *Streptomyces* sp. W15F4 |
| SBP00092 | Kimchi | *Streptomyces* sp. W15F4 |
| SBP00092 | Kimchi | *Streptomyces* sp. WAC00288 |
| SBP00092 | Kimchi | *Streptomyces* sp. WAC00288 |
| SBP00092 | Kimchi | *Streptomyces* sp. YIM 121038 |
| SBP00092 | Kimchi | *Streptomyces* sp. YIM 121038 |
| SBP00092 | Kimchi | *Streptomyces* sp. Z022 |
| SBP00092 | Kimchi | *Streptomyces* sp. Z022 |
| SBP00092 | Kimchi | *Streptomyces* sp. ZFG47 |
| SBP00092 | Kimchi | *Streptomyces* sp. ZFG47 |
| SBP00092 | Kimchi | *Streptomyces venezuelae* |
| SBP00092 | Kimchi | *Streptomyces venezuelae* |
| SBP00092 | Kimchi | *Streptomyces violaceusniger* |
| SBP00092 | Kimchi | *Streptomyces violaceusniger* |
| SBP00092 | Kimchi | *Streptomyces xinghaiensis* |
| SBP00092 | Kimchi | *Streptomyces xinghaiensis* |
| SBP00092 | Kimchi | *Streptosporangium roseum* |
| SBP00092 | Kimchi | *Streptosporangium roseum* |
| SBP00092 | Kimchi | *Streptosporangium* sp. 'caverna' |
| SBP00092 | Kimchi | *Streptosporangium* sp. 'caverna' |
| SBP00092 | Kimchi | *Sulfitobacter* sp. AM1-D1 |
| SBP00092 | Kimchi | *Sulfitobacter* sp. AM1-D1 |
| SBP00092 | Kimchi | *Sulfuricella denitrificans* |
| SBP00092 | Kimchi | *Sulfuricella denitrificans* |
| SBP00092 | Kimchi | *Sulfurifustis variabilis* |
| SBP00092 | Kimchi | *Sulfurifustis variabilis* |
| SBP00092 | Kimchi | *Sulfuritalea hydrogenivorans* |
| SBP00092 | Kimchi | *Sulfuritalea hydrogenivorans* |
| SBP00092 | Kimchi | *Synechococcus* sp. SynAce01 |
| SBP00092 | Kimchi | *Synechococcus* sp. SynAce01 |
| SBP00092 | Kimchi | *Tabrizicola* sp. K13M18 |
| SBP00092 | Kimchi | *Tabrizicola* sp. K13M18 |
| SBP00092 | Kimchi | *Tamlana* sp. UJ94 |
| SBP00092 | Kimchi | *Tamlana* sp. UJ94 |
| SBP00092 | Kimchi | *Tannerella* sp. oral taxon HOT-286 |
| SBP00092 | Kimchi | *Tannerella* sp. oral taxon HOT-286 |
| SBP00092 | Kimchi | *Tateyamaria omphalii* |
| SBP00092 | Kimchi | *Tateyamaria omphalii* |
| SBP00092 | Kimchi | *Tatumella citrea* |
| SBP00092 | Kimchi | *Tatumella citrea* |
| SBP00092 | Kimchi | *Terribacillus goriensis* |
| SBP00092 | Kimchi | *Terribacillus goriensis* |
| SBP00092 | Kimchi | *Tessaracoccus aquimaris* |
| SBP00092 | Kimchi | *Tessaracoccus aquimaris* |
| SBP00092 | Kimchi | *Tessaracoccus flavus* |
| SBP00092 | Kimchi | *Tessaracoccus flavus* |
| SBP00092 | Kimchi | *Tetragenococcus halophilus* |
| SBP00092 | Kimchi | *Tetragenococcus halophilus* |
| SBP00092 | Kimchi | *Tetragenococcus koreensis* |
| SBP00092 | Kimchi | *Tetragenococcus koreensis* |
| SBP00092 | Kimchi | *Tetragenococcus osmophilus* |
| SBP00092 | Kimchi | *Tetragenococcus osmophilus* |
| SBP00092 | Kimchi | *Thalassococcus* sp. S3 |
| SBP00092 | Kimchi | *Thalassococcus* sp. S3 |
| SBP00092 | Kimchi | *Thalassococcus* sp. SH-1 |
| SBP00092 | Kimchi | *Thalassococcus* sp. SH-1 |
| SBP00092 | Kimchi | *Thauera aromatica* |
| SBP00092 | Kimchi | *Thauera aromatica* |
| SBP00092 | Kimchi | *Thauera humireducens* |
| SBP00092 | Kimchi | *Thauera humireducens* |
| SBP00092 | Kimchi | *Thauera* sp. K11 |
| SBP00092 | Kimchi | *Thauera* sp. K11 |
| SBP00092 | Kimchi | *Thauera* sp. MZ1T |
| SBP00092 | Kimchi | *Thauera* sp. MZ1T |

TABLE 3-continued

List of species identified in each metagenomic sample of each SBP Sample

| SBP ID | SBP Host Common Name | Genus sp. |
|---|---|---|
| SBP00092 | Kimchi | Thermaerobacter marianensis |
| SBP00092 | Kimchi | Thermaerobacter marianensis |
| SBP00092 | Kimchi | Thermobacillus composti |
| SBP00092 | Kimchi | Thermobacillus composti |
| SBP00092 | Kimchi | Thermogutta terrifontis |
| SBP00092 | Kimchi | Thermogutta terrifontis |
| SBP00092 | Kimchi | Thermomonas sp. SY21 |
| SBP00092 | Kimchi | Thermomonas sp. SY21 |
| SBP00092 | Kimchi | Thermomonospora curvata |
| SBP00092 | Kimchi | Thermomonospora curvata |
| SBP00092 | Kimchi | Thioalkalivibrio sulfidiphilus |
| SBP00092 | Kimchi | Thioalkalivibrio sulfidiphilus |
| SBP00092 | Kimchi | Thioalkalivibrio versutus |
| SBP00092 | Kimchi | Thioalkalivibrio versutus |
| SBP00092 | Kimchi | Thiobacillus denitrificans |
| SBP00092 | Kimchi | Thiobacillus denitrificans |
| SBP00092 | Kimchi | Thioclava nitratireducens |
| SBP00092 | Kimchi | Thioclava nitratireducens |
| SBP00092 | Kimchi | Thiocystis violascens |
| SBP00092 | Kimchi | Thiocystis violascens |
| SBP00092 | Kimchi | Thiomonas arsenitoxydans |
| SBP00092 | Kimchi | Thiomonas arsenitoxydans |
| SBP00092 | Kimchi | Thiomonas intermedia |
| SBP00092 | Kimchi | Thiomonas intermedia |
| SBP00092 | Kimchi | Thiomonas sp. X19 |
| SBP00092 | Kimchi | Thiomonas sp. X19 |
| SBP00092 | Kimchi | Tistrella mobilis |
| SBP00092 | Kimchi | Tistrella mobilis |
| SBP00092 | Kimchi | Tsukamurella paurometabola |
| SBP00092 | Kimchi | Tsukamurella paurometabola |
| SBP00092 | Kimchi | Tsukamurella tyrosinosolvens |
| SBP00092 | Kimchi | Tsukamurella tyrosinosolvens |
| SBP00092 | Kimchi | Variibacter gotjawalensis |
| SBP00092 | Kimchi | Variibacter gotjawalensis |
| SBP00092 | Kimchi | Variovorax boronicumulans |
| SBP00092 | Kimchi | Variovorax boronicumulans |
| SBP00092 | Kimchi | Variovorax paradoxus |
| SBP00092 | Kimchi | Variovorax paradoxus |
| SBP00092 | Kimchi | Variovorax sp. HW608 |
| SBP00092 | Kimchi | Variovorax sp. HW608 |
| SBP00092 | Kimchi | Variovorax sp. PAMC 28711 |
| SBP00092 | Kimchi | Variovorax sp. PAMC 28711 |
| SBP00092 | Kimchi | Variovorax sp. PMC12 |
| SBP00092 | Kimchi | Variovorax sp. PMC12 |
| SBP00092 | Kimchi | Verminephrobacter eiseniae |
| SBP00092 | Kimchi | Verminephrobacter eiseniae |
| SBP00092 | Kimchi | Verrucomicrobium spinosum |
| SBP00092 | Kimchi | Verrucomicrobium spinosum |
| SBP00092 | Kimchi | Verrucosispora maris |
| SBP00092 | Kimchi | Verrucosispora maris |
| SBP00092 | Kimchi | Vibrio cholerae |
| SBP00092 | Kimchi | Vibrio cholerae |
| SBP00092 | Kimchi | Vibrio coralliilyticus |
| SBP00092 | Kimchi | Vibrio coralliilyticus |
| SBP00092 | Kimchi | Vibrio parahaemolyticus |
| SBP00092 | Kimchi | Vibrio parahaemolyticus |
| SBP00092 | Kimchi | Vibrio phage qdvp001 |
| SBP00092 | Kimchi | Vibrio phage qdvp001 |
| SBP00092 | Kimchi | Vitreoscilla filiformis |
| SBP00092 | Kimchi | Vitreoscilla filiformis |
| SBP00092 | Kimchi | Vogesella sp. LIG4 |
| SBP00092 | Kimchi | Vogesella sp. LIG4 |
| SBP00092 | Kimchi | Weissella cibaria |
| SBP00092 | Kimchi | Weissella cibaria |
| SBP00092 | Kimchi | Weissella confusa |
| SBP00092 | Kimchi | Weissella confusa |
| SBP00092 | Kimchi | Weissella hellenica |
| SBP00092 | Kimchi | Weissella hellenica |
| SBP00092 | Kimchi | Weissella jogaejeotgali |
| SBP00092 | Kimchi | Weissella jogaejeotgali |
| SBP00092 | Kimchi | Weissella koreensis |
| SBP00092 | Kimchi | Weissella koreensis |
| SBP00092 | Kimchi | Weissella paramesenteroides |
| SBP00092 | Kimchi | Weissella paramesenteroides |
| SBP00092 | Kimchi | Weissella viridescens |
| SBP00092 | Kimchi | Weissella viridescens |

TABLE 3-continued

List of species identified in each metagenomic sample of each SBP Sample

| SBP ID | SBP Host Common Name | Genus sp. |
|---|---|---|
| SBP00092 | Kimchi | Xanthobacter autotrophicus |
| SBP00092 | Kimchi | Xanthobacter autotrophicus |
| SBP00092 | Kimchi | Xanthomonas albilineans |
| SBP00092 | Kimchi | Xanthomonas albilineans |
| SBP00092 | Kimchi | Xanthomonas arboricola |
| SBP00092 | Kimchi | Xanthomonas arboricola |
| SBP00092 | Kimchi | Xanthomonas campestris |
| SBP00092 | Kimchi | Xanthomonas campestris |
| SBP00092 | Kimchi | Xanthomonas cassavae |
| SBP00092 | Kimchi | Xanthomonas cassavae |
| SBP00092 | Kimchi | Xanthomonas citri |
| SBP00092 | Kimchi | Xanthomonas citri |
| SBP00092 | Kimchi | Xanthomonas euvesicatoria |
| SBP00092 | Kimchi | Xanthomonas euvesicatoria |
| SBP00092 | Kimchi | Xanthomonas fragariae |
| SBP00092 | Kimchi | Xanthomonas fragariae |
| SBP00092 | Kimchi | Xanthomonas gardneri |
| SBP00092 | Kimchi | Xanthomonas gardneri |
| SBP00092 | Kimchi | Xanthomonas hortorum |
| SBP00092 | Kimchi | Xanthomonas hortorum |
| SBP00092 | Kimchi | Xanthomonas oryzae |
| SBP00092 | Kimchi | Xanthomonas oryzae |
| SBP00092 | Kimchi | Xanthomonas phaseoli |
| SBP00092 | Kimchi | Xanthomonas phaseoli |
| SBP00092 | Kimchi | Xanthomonas sacchari |
| SBP00092 | Kimchi | Xanthomonas sacchari |
| SBP00092 | Kimchi | Xanthomonas translucens |
| SBP00092 | Kimchi | Xanthomonas translucens |
| SBP00092 | Kimchi | Xanthomonas vesicatoria |
| SBP00092 | Kimchi | Xanthomonas vesicatoria |
| SBP00092 | Kimchi | Xenorhabdus bovienii |
| SBP00092 | Kimchi | Xenorhabdus bovienii |
| SBP00092 | Kimchi | Xylanimonas cellulosilytica |
| SBP00092 | Kimchi | Xylanimonas cellulosilytica |
| SBP00092 | Kimchi | Yangia pacifica |
| SBP00092 | Kimchi | Yangia pacifica |
| SBP00092 | Kimchi | Yangia sp. CCB-MM3 |
| SBP00092 | Kimchi | Yangia sp. CCB-MM3 |
| SBP00092 | Kimchi | Yersinia enterocolitica |
| SBP00092 | Kimchi | Yersinia enterocolitica |
| SBP00092 | Kimchi | Yersinia frederiksenii |
| SBP00092 | Kimchi | Yersinia frederiksenii |
| SBP00092 | Kimchi | Yersinia kristensenii |
| SBP00092 | Kimchi | Yersinia kristensenii |
| SBP00092 | Kimchi | Yersinia massiliensis |
| SBP00092 | Kimchi | Yersinia massiliensis |
| SBP00092 | Kimchi | Yersinia pestis |
| SBP00092 | Kimchi | Yersinia pestis |
| SBP00092 | Kimchi | Yersinia pseudotuberculosis |
| SBP00092 | Kimchi | Yersinia pseudotuberculosis |
| SBP00092 | Kimchi | Yersinia ruckeri |
| SBP00092 | Kimchi | Yersinia ruckeri |
| SBP00092 | Kimchi | Zhihengliuella sp. ISTPL4 |
| SBP00092 | Kimchi | Zhihengliuella sp. ISTPL4 |
| SBP00092 | Kimchi | Zobellella denitrificans |
| SBP00092 | Kimchi | Zobellella denitrificans |
| SBP00095 | Kimchi - Sinto Gourmet | [Bacillus] selenitireducens |
| SBP00095 | Kimchi - Sinto Gourmet | [Brevibacterium] frigoritolerans |
| SBP00095 | Kimchi - Sinto Gourmet | [Clostridium] bolteae |
| SBP00095 | Kimchi - Sinto Gourmet | [Clostridium] scindens |
| SBP00095 | Kimchi - Sinto Gourmet | [Clostridium] sphenoides |
| SBP00095 | Kimchi - Sinto Gourmet | [Clostridium] ultunense |
| SBP00095 | Kimchi - Sinto Gourmet | [Enterobacter] lignolyticus |
| SBP00095 | Kimchi - Sinto Gourmet | [Eubacterium] cellulosolvens |
| SBP00095 | Kimchi - Sinto Gourmet | [Eubacterium] eligens |
| SBP00095 | Kimchi - Sinto Gourmet | [Eubacterium] sulci |
| SBP00095 | Kimchi - Sinto Gourmet | [Haemophilus] ducreyi |
| SBP00095 | Kimchi - Sinto Gourmet | [Pasteurella] aerogenes |
| SBP00095 | Kimchi - Sinto Gourmet | [Polyangium] brachysporum |
| SBP00095 | Kimchi - Sinto Gourmet | Acaryochloris marina |
| SBP00095 | Kimchi - Sinto Gourmet | Acetoanaerobium sticklandii |
| SBP00095 | Kimchi - Sinto Gourmet | Acetobacter ghanensis |
| SBP00095 | Kimchi - Sinto Gourmet | Acetobacter senegalensis |
| SBP00095 | Kimchi - Sinto Gourmet | Acetobacterium woodii |
| SBP00095 | Kimchi - Sinto Gourmet | Acholeplasma axanthum |
| SBP00095 | Kimchi - Sinto Gourmet | Acholeplasma brassicae |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Acholeplasma hippikon* |
| SBP00095 | Kimchi - Sinto Gourmet | *Acholeplasma palmae* |
| SBP00095 | Kimchi - Sinto Gourmet | *Achromobacter denitrificans* |
| SBP00095 | Kimchi - Sinto Gourmet | *Achromobacter insolitus* |
| SBP00095 | Kimchi - Sinto Gourmet | *Achromobacter* sp. AONIH1 |
| SBP00095 | Kimchi - Sinto Gourmet | *Achromobacter* sp. B7 |
| SBP00095 | Kimchi - Sinto Gourmet | *Achromobacter* sp. MFA1 R4 |
| SBP00095 | Kimchi - Sinto Gourmet | *Achromobacter spanius* |
| SBP00095 | Kimchi - Sinto Gourmet | *Achromobacter xylosoxidans* |
| SBP00095 | Kimchi - Sinto Gourmet | *Acidaminococcus fermentans* |
| SBP00095 | Kimchi - Sinto Gourmet | *Acidipropionibacterium jensenii* |
| SBP00095 | Kimchi - Sinto Gourmet | *Acidithiobacillus ferridurans* |
| SBP00095 | Kimchi - Sinto Gourmet | *Acidobacteriaceae bacterium* SBC82 |
| SBP00095 | Kimchi - Sinto Gourmet | *Acidovorax avenae* |
| SBP00095 | Kimchi - Sinto Gourmet | *Acidovorax carolinensis* |
| SBP00095 | Kimchi - Sinto Gourmet | *Acidovorax cattleyae* |
| SBP00095 | Kimchi - Sinto Gourmet | *Acidovorax citrulli* |
| SBP00095 | Kimchi - Sinto Gourmet | *Acidovorax ebreus* |
| SBP00095 | Kimchi - Sinto Gourmet | *Acidovorax* sp. 1608163 |
| SBP00095 | Kimchi - Sinto Gourmet | *Acidovorax* sp. JS42 |
| SBP00095 | Kimchi - Sinto Gourmet | *Acidovorax* sp. KKS102 |
| SBP00095 | Kimchi - Sinto Gourmet | *Acidovorax* sp. RAC01 |
| SBP00095 | Kimchi - Sinto Gourmet | *Acidovorax* sp. T1 |
| SBP00095 | Kimchi - Sinto Gourmet | *Acinetobacter baumannii* |
| SBP00095 | Kimchi - Sinto Gourmet | *Acinetobacter bereziniae* |
| SBP00095 | Kimchi - Sinto Gourmet | *Acinetobacter calcoaceticus* |
| SBP00095 | Kimchi - Sinto Gourmet | *Acinetobacter defluvii* |
| SBP00095 | Kimchi - Sinto Gourmet | *Acinetobacter equi* |
| SBP00095 | Kimchi - Sinto Gourmet | *Acinetobacter guillouiae* |
| SBP00095 | Kimchi - Sinto Gourmet | *Acinetobacter haemolyticus* |
| SBP00095 | Kimchi - Sinto Gourmet | *Acinetobacter johnsonii* |
| SBP00095 | Kimchi - Sinto Gourmet | *Acinetobacter junii* |
| SBP00095 | Kimchi - Sinto Gourmet | *Acinetobacter larvae* |
| SBP00095 | Kimchi - Sinto Gourmet | *Acinetobacter lwoffii* |
| SBP00095 | Kimchi - Sinto Gourmet | *Acinetobacter nosocomialis* |
| SBP00095 | Kimchi - Sinto Gourmet | *Acinetobacter pittii* |
| SBP00095 | Kimchi - Sinto Gourmet | *Acinetobacter radioresistens* |
| SBP00095 | Kimchi - Sinto Gourmet | *Acinetobacter schindleri* |
| SBP00095 | Kimchi - Sinto Gourmet | *Acinetobacter* sp. ACNIH1 |
| SBP00095 | Kimchi - Sinto Gourmet | *Acinetobacter* sp. ACNIH2 |
| SBP00095 | Kimchi - Sinto Gourmet | *Acinetobacter* sp. ADP1 |
| SBP00095 | Kimchi - Sinto Gourmet | *Acinetobacter* sp. LoGeW2-3 |
| SBP00095 | Kimchi - Sinto Gourmet | *Acinetobacter* sp. NCu2D-2 |
| SBP00095 | Kimchi - Sinto Gourmet | *Acinetobacter* sp. SWBY1 |
| SBP00095 | Kimchi - Sinto Gourmet | *Acinetobacter* sp. TTHO-4 |
| SBP00095 | Kimchi - Sinto Gourmet | *Acinetobacter* sp. WCHA45 |
| SBP00095 | Kimchi - Sinto Gourmet | *Acinetobacter* sp. WCHA55 |
| SBP00095 | Kimchi - Sinto Gourmet | *Acinetobacter* sp. WCHAc010005 |
| SBP00095 | Kimchi - Sinto Gourmet | *Acinetobacter* sp. WCHAc010052 |
| SBP00095 | Kimchi - Sinto Gourmet | *Acinetobacter ursingii* |
| SBP00095 | Kimchi - Sinto Gourmet | *Acinetobacter venetianus* |
| SBP00095 | Kimchi - Sinto Gourmet | *Acinetobacter wuhouensis* |
| SBP00095 | Kimchi - Sinto Gourmet | *Actinobacillus lignieresii* |
| SBP00095 | Kimchi - Sinto Gourmet | *Actinobacillus porcitonsillarum* |
| SBP00095 | Kimchi - Sinto Gourmet | *Actinobacillus succinogenes* |
| SBP00095 | Kimchi - Sinto Gourmet | *Actinobacteria bacterium* IMCC19121 |
| SBP00095 | Kimchi - Sinto Gourmet | *Actinobacteria bacterium* IMCC26103 |
| SBP00095 | Kimchi - Sinto Gourmet | *Actinobacteria bacterium* YIM 96077 |
| SBP00095 | Kimchi - Sinto Gourmet | *Actinomyces gaoshouyii* |
| SBP00095 | Kimchi - Sinto Gourmet | *Actinomyces israelii* |
| SBP00095 | Kimchi - Sinto Gourmet | *Actinomyces radingae* |
| SBP00095 | Kimchi - Sinto Gourmet | *Actinomyces slackii* |
| SBP00095 | Kimchi - Sinto Gourmet | *Actinomyces* sp. 299 |
| SBP00095 | Kimchi - Sinto Gourmet | *Actinomyces* sp. oral taxon 897 |
| SBP00095 | Kimchi - Sinto Gourmet | *Actinomyces* sp. VUL4_3 |
| SBP00095 | Kimchi - Sinto Gourmet | *Actinomyces* sp. Z16 |
| SBP00095 | Kimchi - Sinto Gourmet | *Actinoplanes friuliensis* |
| SBP00095 | Kimchi - Sinto Gourmet | *Actinoplanes missouriensis* |
| SBP00095 | Kimchi - Sinto Gourmet | *Actinoplanes* sp. ATCC 31351 |
| SBP00095 | Kimchi - Sinto Gourmet | *Actinoplanes teichomyceticus* |
| SBP00095 | Kimchi - Sinto Gourmet | *Actinopolyspora erythraea* |
| SBP00095 | Kimchi - Sinto Gourmet | *Actinosynnema pretiosum* |
| SBP00095 | Kimchi - Sinto Gourmet | *Adlercreutzia equolifaciens* |
| SBP00095 | Kimchi - Sinto Gourmet | *Advenella kashmirensis* |
| SBP00095 | Kimchi - Sinto Gourmet | *Aequorivita sublithincola* |
| SBP00095 | Kimchi - Sinto Gourmet | *Aeribacillus pallidus* |

TABLE 3-continued

List of species identified in each metagenomic sample of each SBP Sample

| SBP ID | SBP Host Common Name | Genus sp. |
| --- | --- | --- |
| SBP00095 | Kimchi - Sinto Gourmet | *Aerococcaceae bacterium* ZY16052 |
| SBP00095 | Kimchi - Sinto Gourmet | *Aerococcus christensenii* |
| SBP00095 | Kimchi - Sinto Gourmet | *Aerococcus sanguinicola* |
| SBP00095 | Kimchi - Sinto Gourmet | *Aerococcus urinae* |
| SBP00095 | Kimchi - Sinto Gourmet | *Aerococcus urinaeequi* |
| SBP00095 | Kimchi - Sinto Gourmet | *Aerococcus urinaehominis* |
| SBP00095 | Kimchi - Sinto Gourmet | *Aerococcus viridans* |
| SBP00095 | Kimchi - Sinto Gourmet | *Aeromicrobium choanae* |
| SBP00095 | Kimchi - Sinto Gourmet | *Aeromicrobium erythreum* |
| SBP00095 | Kimchi - Sinto Gourmet | *Aeromicrobium* sp. A1-2 |
| SBP00095 | Kimchi - Sinto Gourmet | *Aeromonas encheleia* |
| SBP00095 | Kimchi - Sinto Gourmet | *Aeromonas hydrophila* |
| SBP00095 | Kimchi - Sinto Gourmet | *Aeromonas media* |
| SBP00095 | Kimchi - Sinto Gourmet | *Aeromonas rivipollensis* |
| SBP00095 | Kimchi - Sinto Gourmet | *Aeromonas salmonicida* |
| SBP00095 | Kimchi - Sinto Gourmet | *Aeromonas schubertii* |
| SBP00095 | Kimchi - Sinto Gourmet | *Aeromonas* sp. |
| SBP00095 | Kimchi - Sinto Gourmet | *Aeromonas* sp. ASNIH3 |
| SBP00095 | Kimchi - Sinto Gourmet | *Aeromonas veronii* |
| SBP00095 | Kimchi - Sinto Gourmet | *Afipia* sp. GAS231 |
| SBP00095 | Kimchi - Sinto Gourmet | *Agarilytica rhodophyticola* |
| SBP00095 | Kimchi - Sinto Gourmet | *Agrobacterium fabrum* |
| SBP00095 | Kimchi - Sinto Gourmet | *Agrobacterium larrymoorei* |
| SBP00095 | Kimchi - Sinto Gourmet | *Agrobacterium rhizogenes* |
| SBP00095 | Kimchi - Sinto Gourmet | *Agrobacterium* sp. |
| SBP00095 | Kimchi - Sinto Gourmet | *Agrobacterium* sp. H13-3 |
| SBP00095 | Kimchi - Sinto Gourmet | *Agrobacterium* sp. RAC06 |
| SBP00095 | Kimchi - Sinto Gourmet | *Agrobacterium tumefaciens* |
| SBP00095 | Kimchi - Sinto Gourmet | *Agrobacterium vitis* |
| SBP00095 | Kimchi - Sinto Gourmet | *Agromyces aureus* |
| SBP00095 | Kimchi - Sinto Gourmet | *Agromyces flavus* |
| SBP00095 | Kimchi - Sinto Gourmet | *Agromyces* sp. LHK192 |
| SBP00095 | Kimchi - Sinto Gourmet | *Alcaligenes aquatilis* |
| SBP00095 | Kimchi - Sinto Gourmet | *Alcaligenes faecalis* |
| SBP00095 | Kimchi - Sinto Gourmet | *Alcanivorax dieselolei* |
| SBP00095 | Kimchi - Sinto Gourmet | *Alcanivorax xenomutans* |
| SBP00095 | Kimchi - Sinto Gourmet | *Algoriphagus machipongonensis* |
| SBP00095 | Kimchi - Sinto Gourmet | *Alicycliphilus denitrificans* |
| SBP00095 | Kimchi - Sinto Gourmet | *Alicyclobacillus acidocaldarius* |
| SBP00095 | Kimchi - Sinto Gourmet | *Alistipes shahii* |
| SBP00095 | Kimchi - Sinto Gourmet | *Alkaliphilus metalliredigens* |
| SBP00095 | Kimchi - Sinto Gourmet | *Alkaliphilus oremlandii* |
| SBP00095 | Kimchi - Sinto Gourmet | *Allofrancisella guangzhouensis* |
| SBP00095 | Kimchi - Sinto Gourmet | *Allokutzneria albata* |
| SBP00095 | Kimchi - Sinto Gourmet | *Alphaproteobacteria bacterium* WS11 |
| SBP00095 | Kimchi - Sinto Gourmet | *Altererythrobacter atlanticus* |
| SBP00095 | Kimchi - Sinto Gourmet | *Altererythrobacter dongtanensis* |
| SBP00095 | Kimchi - Sinto Gourmet | *Altererythrobacter epoxidivorans* |
| SBP00095 | Kimchi - Sinto Gourmet | *Altererythrobacter ishigakiensis* |
| SBP00095 | Kimchi - Sinto Gourmet | *Altererythrobacter marensis* |
| SBP00095 | Kimchi - Sinto Gourmet | *Altererythrobacter namhicola* |
| SBP00095 | Kimchi - Sinto Gourmet | *Altererythrobacter* sp. B11 |
| SBP00095 | Kimchi - Sinto Gourmet | *Altererythrobacter* sp. NS1 |
| SBP00095 | Kimchi - Sinto Gourmet | *Altererythrobacter* sp. ZODW24 |
| SBP00095 | Kimchi - Sinto Gourmet | *Alteromonas* sp. BL110 |
| SBP00095 | Kimchi - Sinto Gourmet | *Aminobacter aminovorans* |
| SBP00095 | Kimchi - Sinto Gourmet | *Aminobacter* sp. MSH1 |
| SBP00095 | Kimchi - Sinto Gourmet | *Aminobacterium colombiense* |
| SBP00095 | Kimchi - Sinto Gourmet | *Amphibacillus xylanus* |
| SBP00095 | Kimchi - Sinto Gourmet | *Amycolatopsis albispora* |
| SBP00095 | Kimchi - Sinto Gourmet | *Anabaenopsis circularis* |
| SBP00095 | Kimchi - Sinto Gourmet | *Anaerococcus mediterraneensis* |
| SBP00095 | Kimchi - Sinto Gourmet | *Anaerolineaceae bacterium* oral taxon 439 |
| SBP00095 | Kimchi - Sinto Gourmet | *Anaeromyxobacter dehalogenans* |
| SBP00095 | Kimchi - Sinto Gourmet | *Anaerostipes rhamnosivorans* |
| SBP00095 | Kimchi - Sinto Gourmet | *Anaerotignum propionicum* |
| SBP00095 | Kimchi - Sinto Gourmet | *Aneurinibacillus soli* |
| SBP00095 | Kimchi - Sinto Gourmet | *Aneurinibacillus* sp. XH2 |
| SBP00095 | Kimchi - Sinto Gourmet | *Anoxybacillus amylolyticus* |
| SBP00095 | Kimchi - Sinto Gourmet | *Anoxybacillus flavithermus* |
| SBP00095 | Kimchi - Sinto Gourmet | *Anoxybacillus gonensis* |
| SBP00095 | Kimchi - Sinto Gourmet | *Anoxybacter fermentans* |
| SBP00095 | Kimchi - Sinto Gourmet | *Aquabacterium olei* |
| SBP00095 | Kimchi - Sinto Gourmet | *Aquimarina* sp. AD10 |
| SBP00095 | Kimchi - Sinto Gourmet | *Aquitalea magnusonii* |
| SBP00095 | Kimchi - Sinto Gourmet | *Arcanobacterium phocae* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Archangium gephyra* |
| SBP00095 | Kimchi - Sinto Gourmet | *Arcobacter bivalviorum* |
| SBP00095 | Kimchi - Sinto Gourmet | *Arcobacter butzleri* |
| SBP00095 | Kimchi - Sinto Gourmet | *Arcobacter cryaerophilus* |
| SBP00095 | Kimchi - Sinto Gourmet | *Arcobacter marinus* |
| SBP00095 | Kimchi - Sinto Gourmet | *Arcobacter molluscorum* |
| SBP00095 | Kimchi - Sinto Gourmet | *Arcobacter skirrowii* |
| SBP00095 | Kimchi - Sinto Gourmet | *Arcobacter* sp. LPB0137 |
| SBP00095 | Kimchi - Sinto Gourmet | *Aromatoleum aromaticum* |
| SBP00095 | Kimchi - Sinto Gourmet | *Arsenicicoccus* sp. oral taxon 190 |
| SBP00095 | Kimchi - Sinto Gourmet | *Arsenophonus nasoniae* |
| SBP00095 | Kimchi - Sinto Gourmet | *Arthrobacter alpinus* |
| SBP00095 | Kimchi - Sinto Gourmet | *Arthrobacter crystallopoietes* |
| SBP00095 | Kimchi - Sinto Gourmet | *Arthrobacter* sp. ERGS1:01 |
| SBP00095 | Kimchi - Sinto Gourmet | *Arthrobacter* sp. FB24 |
| SBP00095 | Kimchi - Sinto Gourmet | *Arthrobacter* sp. PGP41 |
| SBP00095 | Kimchi - Sinto Gourmet | *Arthrobacter* sp. QXT-31 |
| SBP00095 | Kimchi - Sinto Gourmet | *Arthrobacter* sp. U41 |
| SBP00095 | Kimchi - Sinto Gourmet | *Arthrobacter* sp. YN |
| SBP00095 | Kimchi - Sinto Gourmet | *Asticcacaulis excentricus* |
| SBP00095 | Kimchi - Sinto Gourmet | *Atlantibacter hermannii* |
| SBP00095 | Kimchi - Sinto Gourmet | *Aurantimicrobium* sp. MWH-Uga1 |
| SBP00095 | Kimchi - Sinto Gourmet | *Aureimonas* sp. AU20 |
| SBP00095 | Kimchi - Sinto Gourmet | *Auricoccus indicus* |
| SBP00095 | Kimchi - Sinto Gourmet | *Auritidibacter* sp. NML130574 |
| SBP00095 | Kimchi - Sinto Gourmet | *Avibacterium volantium* |
| SBP00095 | Kimchi - Sinto Gourmet | *Azoarcus communis* |
| SBP00095 | Kimchi - Sinto Gourmet | *Azoarcus* sp. CIB |
| SBP00095 | Kimchi - Sinto Gourmet | *Azoarcus* sp. DN11 |
| SBP00095 | Kimchi - Sinto Gourmet | *Azoarcus* sp. KH32C |
| SBP00095 | Kimchi - Sinto Gourmet | *Azorhizobium caulinodans* |
| SBP00095 | Kimchi - Sinto Gourmet | *Azospira oryzae* |
| SBP00095 | Kimchi - Sinto Gourmet | *Azospirillum brasilense* |
| SBP00095 | Kimchi - Sinto Gourmet | *Azospirillum lipoferum* |
| SBP00095 | Kimchi - Sinto Gourmet | *Azospirillum* sp. CFH 70021 |
| SBP00095 | Kimchi - Sinto Gourmet | *Azospirillum* sp. TSA2s |
| SBP00095 | Kimchi - Sinto Gourmet | *Azospirillum* sp. TSH100 |
| SBP00095 | Kimchi - Sinto Gourmet | *Azospirillum thiophilum* |
| SBP00095 | Kimchi - Sinto Gourmet | *Azotobacter chroococcum* |
| SBP00095 | Kimchi - Sinto Gourmet | *Bacillus altitudinis* |
| SBP00095 | Kimchi - Sinto Gourmet | *Bacillus amyloliquefaciens* |
| SBP00095 | Kimchi - Sinto Gourmet | *Bacillus asahii* |
| SBP00095 | Kimchi - Sinto Gourmet | *Bacillus beveridgei* |
| SBP00095 | Kimchi - Sinto Gourmet | *Bacillus butanolivorans* |
| SBP00095 | Kimchi - Sinto Gourmet | *Bacillus cellulosilyticus* |
| SBP00095 | Kimchi - Sinto Gourmet | *Bacillus cereus* |
| SBP00095 | Kimchi - Sinto Gourmet | *Bacillus ciccensis* |
| SBP00095 | Kimchi - Sinto Gourmet | *Bacillus circulans* |
| SBP00095 | Kimchi - Sinto Gourmet | *Bacillus clausii* |
| SBP00095 | Kimchi - Sinto Gourmet | *Bacillus coagulans* |
| SBP00095 | Kimchi - Sinto Gourmet | *Bacillus cohnii* |
| SBP00095 | Kimchi - Sinto Gourmet | *Bacillus cytotoxicus* |
| SBP00095 | Kimchi - Sinto Gourmet | *Bacillus flexus* |
| SBP00095 | Kimchi - Sinto Gourmet | *Bacillus foraminis* |
| SBP00095 | Kimchi - Sinto Gourmet | *Bacillus freudenreichii* |
| SBP00095 | Kimchi - Sinto Gourmet | *Bacillus glycinifermentans* |
| SBP00095 | Kimchi - Sinto Gourmet | *Bacillus gobiensis* |
| SBP00095 | Kimchi - Sinto Gourmet | *Bacillus halodurans* |
| SBP00095 | Kimchi - Sinto Gourmet | *Bacillus halotolerans* |
| SBP00095 | Kimchi - Sinto Gourmet | *Bacillus horikoshii* |
| SBP00095 | Kimchi - Sinto Gourmet | *Bacillus infantis* |
| SBP00095 | Kimchi - Sinto Gourmet | *Bacillus jeotgali* |
| SBP00095 | Kimchi - Sinto Gourmet | *Bacillus krulwichiae* |
| SBP00095 | Kimchi - Sinto Gourmet | *Bacillus lehensis* |
| SBP00095 | Kimchi - Sinto Gourmet | *Bacillus lentus* |
| SBP00095 | Kimchi - Sinto Gourmet | *Bacillus licheniformis* |
| SBP00095 | Kimchi - Sinto Gourmet | *Bacillus litoralis* |
| SBP00095 | Kimchi - Sinto Gourmet | *Bacillus marisflavi* |
| SBP00095 | Kimchi - Sinto Gourmet | *Bacillus megaterium* |
| SBP00095 | Kimchi - Sinto Gourmet | *Bacillus mesonae* |
| SBP00095 | Kimchi - Sinto Gourmet | *Bacillus methanolicus* |
| SBP00095 | Kimchi - Sinto Gourmet | *Bacillus muralis* |
| SBP00095 | Kimchi - Sinto Gourmet | *Bacillus oceanisediminis* |
| SBP00095 | Kimchi - Sinto Gourmet | *Bacillus paralicheniformis* |
| SBP00095 | Kimchi - Sinto Gourmet | *Bacillus pseudomycoides* |
| SBP00095 | Kimchi - Sinto Gourmet | *Bacillus pumilus* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Bacillus safensis* |
| SBP00095 | Kimchi - Sinto Gourmet | *Bacillus simplex* |
| SBP00095 | Kimchi - Sinto Gourmet | *Bacillus smithii* |
| SBP00095 | Kimchi - Sinto Gourmet | *Bacillus sonorensis* |
| SBP00095 | Kimchi - Sinto Gourmet | *Bacillus* sp. (in: Bacteria) |
| SBP00095 | Kimchi - Sinto Gourmet | *Bacillus* sp. 1NLA3E |
| SBP00095 | Kimchi - Sinto Gourmet | *Bacillus* sp. FJAT-18017 |
| SBP00095 | Kimchi - Sinto Gourmet | *Bacillus* sp. FJAT-22090 |
| SBP00095 | Kimchi - Sinto Gourmet | *Bacillus* sp. FJAT-42376 |
| SBP00095 | Kimchi - Sinto Gourmet | *Bacillus* sp. FJAT-45348 |
| SBP00095 | Kimchi - Sinto Gourmet | *Bacillus* sp. OxB-1 |
| SBP00095 | Kimchi - Sinto Gourmet | *Bacillus* sp. X1(2014) |
| SBP00095 | Kimchi - Sinto Gourmet | *Bacillus* sp. Y1 |
| SBP00095 | Kimchi - Sinto Gourmet | *Bacillus subtilis* |
| SBP00095 | Kimchi - Sinto Gourmet | *Bacillus thermoamylovorans* |
| SBP00095 | Kimchi - Sinto Gourmet | *Bacillus thermocopriae* |
| SBP00095 | Kimchi - Sinto Gourmet | *Bacillus thuringiensis* |
| SBP00095 | Kimchi - Sinto Gourmet | *Bacillus velezensis* |
| SBP00095 | Kimchi - Sinto Gourmet | *Bacillus weihaiensis* |
| SBP00095 | Kimchi - Sinto Gourmet | *Bacillus wiedmannii* |
| SBP00095 | Kimchi - Sinto Gourmet | *Bacteriovorax stolpii* |
| SBP00095 | Kimchi - Sinto Gourmet | *Bacteroides coprosuis* |
| SBP00095 | Kimchi - Sinto Gourmet | *Bacteroides fragilis* |
| SBP00095 | Kimchi - Sinto Gourmet | *Bacteroides heparinolyticus* |
| SBP00095 | Kimchi - Sinto Gourmet | *Bacteroides thetaiotaomicron* |
| SBP00095 | Kimchi - Sinto Gourmet | *Bacteroides xylanisolvens* |
| SBP00095 | Kimchi - Sinto Gourmet | *Bartonella apis* |
| SBP00095 | Kimchi - Sinto Gourmet | *Bartonella vinsonii* |
| SBP00095 | Kimchi - Sinto Gourmet | *Bathymodiolus septemdierum thioautotrophic gill* symbiont |
| SBP00095 | Kimchi - Sinto Gourmet | *Bathymodiolus thermophilus thioautotrophic gill* symbiont |
| SBP00095 | Kimchi - Sinto Gourmet | *Bdellovibrio bacteriovorus* |
| SBP00095 | Kimchi - Sinto Gourmet | *Bdellovibrio exovorus* |
| SBP00095 | Kimchi - Sinto Gourmet | BeAn 58058 virus |
| SBP00095 | Kimchi - Sinto Gourmet | *Belliella baltica* |
| SBP00095 | Kimchi - Sinto Gourmet | *Bernardetia litoralis* |
| SBP00095 | Kimchi - Sinto Gourmet | *Betaproteobacteria bacterium* GR16-43 |
| SBP00095 | Kimchi - Sinto Gourmet | *Bifidobacterium adolescentis* |
| SBP00095 | Kimchi - Sinto Gourmet | *Bifidobacterium asteroides* |
| SBP00095 | Kimchi - Sinto Gourmet | *Bifidobacterium breve* |
| SBP00095 | Kimchi - Sinto Gourmet | *Bifidobacterium choerinum* |
| SBP00095 | Kimchi - Sinto Gourmet | *Bifidobacterium dentium* |
| SBP00095 | Kimchi - Sinto Gourmet | *Bifidobacterium gallinarum* |
| SBP00095 | Kimchi - Sinto Gourmet | *Bifidobacterium indicum* |
| SBP00095 | Kimchi - Sinto Gourmet | *Bifidobacterium kashiwanohense* |
| SBP00095 | Kimchi - Sinto Gourmet | *Bifidobacterium longum* |
| SBP00095 | Kimchi - Sinto Gourmet | *Bifidobacterium pseudolongum* |
| SBP00095 | Kimchi - Sinto Gourmet | *Blastococcus saxobsidens* |
| SBP00095 | Kimchi - Sinto Gourmet | *Blastomonas fulva* |
| SBP00095 | Kimchi - Sinto Gourmet | *Blautia producta* |
| SBP00095 | Kimchi - Sinto Gourmet | *Blautia* sp. SCOSB48 |
| SBP00095 | Kimchi - Sinto Gourmet | *Bordetella bronchialis* |
| SBP00095 | Kimchi - Sinto Gourmet | *Bordetella bronchiseptica* |
| SBP00095 | Kimchi - Sinto Gourmet | *Bordetella flabilis* |
| SBP00095 | Kimchi - Sinto Gourmet | *Bordetella* genomosp. 13 |
| SBP00095 | Kimchi - Sinto Gourmet | *Bordetella* genomosp. 8 |
| SBP00095 | Kimchi - Sinto Gourmet | *Bordetella* genomosp. 9 |
| SBP00095 | Kimchi - Sinto Gourmet | *Bordetella hinzii* |
| SBP00095 | Kimchi - Sinto Gourmet | *Bordetella petrii* |
| SBP00095 | Kimchi - Sinto Gourmet | *Bordetella* sp. H567 |
| SBP00095 | Kimchi - Sinto Gourmet | *Bordetella* sp. N |
| SBP00095 | Kimchi - Sinto Gourmet | *Bordetella trematum* |
| SBP00095 | Kimchi - Sinto Gourmet | *Borrelia hermsii* |
| SBP00095 | Kimchi - Sinto Gourmet | *Borrelia turcica* |
| SBP00095 | Kimchi - Sinto Gourmet | *Bosea* sp. AS-1 |
| SBP00095 | Kimchi - Sinto Gourmet | *Bosea* sp. PAMC 26642 |
| SBP00095 | Kimchi - Sinto Gourmet | *Bosea* sp. RAC05 |
| SBP00095 | Kimchi - Sinto Gourmet | *Bosea* sp. Tri-49 |
| SBP00095 | Kimchi - Sinto Gourmet | *Bosea vaviloviae* |
| SBP00095 | Kimchi - Sinto Gourmet | *Bradyrhizobiaceae bacterium* SG-6C |
| SBP00095 | Kimchi - Sinto Gourmet | *Bradyrhizobium diazoefficiens* |
| SBP00095 | Kimchi - Sinto Gourmet | *Bradyrhizobium erythrophlei* |
| SBP00095 | Kimchi - Sinto Gourmet | *Bradyrhizobium guangdongense* |
| SBP00095 | Kimchi - Sinto Gourmet | *Bradyrhizobium icense* |
| SBP00095 | Kimchi - Sinto Gourmet | *Bradyrhizobium lablabi* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Bradyrhizobium oligotrophicum* |
| SBP00095 | Kimchi - Sinto Gourmet | *Bradyrhizobium ottawaense* |
| SBP00095 | Kimchi - Sinto Gourmet | *Bradyrhizobium* sp. BTAi1 |
| SBP00095 | Kimchi - Sinto Gourmet | *Bradyrhizobium* sp. CCBAU 51670 |
| SBP00095 | Kimchi - Sinto Gourmet | *Bradyrhizobium* sp. CCBAU 51778 |
| SBP00095 | Kimchi - Sinto Gourmet | *Bradyrhizobium* sp. CCGE-LA001 |
| SBP00095 | Kimchi - Sinto Gourmet | *Bradyrhizobium* sp. ORS 278 |
| SBP00095 | Kimchi - Sinto Gourmet | *Bradyrhizobium* sp. ORS 285 |
| SBP00095 | Kimchi - Sinto Gourmet | *Bradyrhizobium* sp. ORS 3257 |
| SBP00095 | Kimchi - Sinto Gourmet | *Brenneria goodwinii* |
| SBP00095 | Kimchi + Sinto Gourmet | *Brenneria rubrifaciens* |
| SBP00095 | Kimchi - Sinto Gourmet | *Breoghania* sp. L-A4 |
| SBP00095 | Kimchi - Sinto Gourmet | *Brevibacillus agri* |
| SBP00095 | Kimchi - Sinto Gourmet | *Brevibacillus brevis* |
| SBP00095 | Kimchi - Sinto Gourmet | *Brevibacillus formosus* |
| SBP00095 | Kimchi - Sinto Gourmet | *Brevibacillus laterosporus* |
| SBP00095 | Kimchi - Sinto Gourmet | *Brevibacillus* sp. SCSIO 07484 |
| SBP00095 | Kimchi - Sinto Gourmet | *Brevibacterium linens* |
| SBP00095 | Kimchi - Sinto Gourmet | *Brevibacterium sandarakinum* |
| SBP00095 | Kimchi - Sinto Gourmet | *Brevundimonas diminuta* |
| SBP00095 | Kimchi - Sinto Gourmet | *Brevundimonas naejangsanensis* |
| SBP00095 | Kimchi - Sinto Gourmet | *Brevundimonas* sp. DS20 |
| SBP00095 | Kimchi - Sinto Gourmet | *Brevundimonas* sp. GW460-12-10-14-LB2 |
| SBP00095 | Kimchi - Sinto Gourmet | *Brevundimonas* sp. LM2 |
| SBP00095 | Kimchi - Sinto Gourmet | *Brevundimonas subvibrioides* |
| SBP00095 | Kimchi - Sinto Gourmet | *Brevundimonas vancanneytii* |
| SBP00095 | Kimchi - Sinto Gourmet | *Brevundimonas vesicularis* |
| SBP00095 | Kimchi - Sinto Gourmet | *Brochothrix thermosphacta* |
| SBP00095 | Kimchi - Sinto Gourmet | *Buchnera aphidicola* |
| SBP00095 | Kimchi - Sinto Gourmet | *Burkholderia ambifaria* |
| SBP00095 | Kimchi - Sinto Gourmet | *Burkholderia cenocepacia* |
| SBP00095 | Kimchi - Sinto Gourmet | *Burkholderia cepacia* |
| SBP00095 | Kimchi - Sinto Gourmet | *Burkholderia contaminans* |
| SBP00095 | Kimchi - Sinto Gourmet | *Burkholderia gladioli* |
| SBP00095 | Kimchi - Sinto Gourmet | *Burkholderia glumae* |
| SBP00095 | Kimchi - Sinto Gourmet | *Burkholderia insecticola* |
| SBP00095 | Kimchi - Sinto Gourmet | *Burkholderia lata* |
| SBP00095 | Kimchi - Sinto Gourmet | *Burkholderia multivorans* |
| SBP00095 | Kimchi - Sinto Gourmet | *Burkholderia plantarii* |
| SBP00095 | Kimchi - Sinto Gourmet | *Burkholderia pseudomallei* |
| SBP00095 | Kimchi - Sinto Gourmet | *Burkholderia pyrrocinia* |
| SBP00095 | Kimchi - Sinto Gourmet | *Burkholderia* sp. BDU6 |
| SBP00095 | Kimchi - Sinto Gourmet | *Burkholderia* sp. Bp7605 |
| SBP00095 | Kimchi - Sinto Gourmet | *Burkholderia* sp. CCGE1002 |
| SBP00095 | Kimchi - Sinto Gourmet | *Burkholderia* sp. MSMB0856 |
| SBP00095 | Kimchi - Sinto Gourmet | *Burkholderia stabilis* |
| SBP00095 | Kimchi - Sinto Gourmet | *Burkholderia stagnalis* |
| SBP00095 | Kimchi - Sinto Gourmet | *Burkholderia thailandensis* |
| SBP00095 | Kimchi - Sinto Gourmet | *Burkholderia ubonensis* |
| SBP00095 | Kimchi - Sinto Gourmet | *Burkholderiales bacterium* GJ-E10 |
| SBP00095 | Kimchi - Sinto Gourmet | *Burkholderiales bacterium* JOSHI_001 |
| SBP00095 | Kimchi - Sinto Gourmet | *Burkholderiales bacterium* YL45 |
| SBP00095 | Kimchi - Sinto Gourmet | *Buttiauxella* sp. 3AFRM03 |
| SBP00095 | Kimchi - Sinto Gourmet | Cacao swollen shoot Ghana K virus |
| SBP00095 | Kimchi - Sinto Gourmet | *Caldanaerobacter subterraneus* |
| SBP00095 | Kimchi - Sinto Gourmet | *Caldicellulosiruptor obsidiansis* |
| SBP00095 | Kimchi - Sinto Gourmet | *Calothrix parasitica* |
| SBP00095 | Kimchi - Sinto Gourmet | *Calothrix parietina* |
| SBP00095 | Kimchi - Sinto Gourmet | *Calothrix* sp. 336/3 |
| SBP00095 | Kimchi - Sinto Gourmet | *Calothrix* sp. NIES-2098 |
| SBP00095 | Kimchi - Sinto Gourmet | *Calyptogena okutanii thioautotrophic gill* symbiont |
| SBP00095 | Kimchi - Sinto Gourmet | *Campylobacter cuniculorum* |
| SBP00095 | Kimchi - Sinto Gourmet | *Campylobacter fetus* |
| SBP00095 | Kimchi - Sinto Gourmet | *Campylobacter jejuni* |
| SBP00095 | Kimchi - Sinto Gourmet | *Campylobacter lari* |
| SBP00095 | Kimchi - Sinto Gourmet | *Campylobacter pinnipediorum* |
| SBP00095 | Kimchi - Sinto Gourmet | *Campylobacter sputorum* |
| SBP00095 | Kimchi - Sinto Gourmet | *Candidatus Aquiluna* sp. UB-MaderosW2red |
| SBP00095 | Kimchi - Sinto Gourmet | *Candidatus Arthromitus* sp. SFB-rat-Yit |
| SBP00095 | Kimchi - Sinto Gourmet | *Candidatus Babela massiliensis* |
| SBP00095 | Kimchi - Sinto Gourmet | *Candidatus Blochmannia vafer* |
| SBP00095 | Kimchi - Sinto Gourmet | *Candidatus Desulforudis audaxviator* |
| SBP00095 | Kimchi - Sinto Gourmet | *Candidatus Gullanella endobia* |
| SBP00095 | Kimchi - Sinto Gourmet | *Candidatus Hamiltonella defensa* |
| SBP00095 | Kimchi - Sinto Gourmet | *Candidatus Hepatoplasma crinochetorum* |
| SBP00095 | Kimchi - Sinto Gourmet | *Candidatus Ishikawaella capsulata* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Candidatus Kinetoplastibacterium sorsogonicusi* |
| SBP00095 | Kimchi - Sinto Gourmet | *Candidatus Methanoplasma termitum* |
| SBP00095 | Kimchi - Sinto Gourmet | *Candidatus Methylopumilus planktonicus* |
| SBP00095 | Kimchi - Sinto Gourmet | *Candidatus Nanopelagicus limnes* |
| SBP00095 | Kimchi - Sinto Gourmet | *Candidatus Nitrosopumilus sediminis* |
| SBP00095 | Kimchi - Sinto Gourmet | *Candidatus Nucleicultrix amoebiphila* |
| SBP00095 | Kimchi - Sinto Gourmet | *Candidatus Phytoplasma australiense* |
| SBP00095 | Kimchi - Sinto Gourmet | *Candidatus Planktophila lacus* |
| SBP00095 | Kimchi - Sinto Gourmet | *Candidatus Promineofilum breve* |
| SBP00095 | Kimchi - Sinto Gourmet | *Candidatus Pseudomonas adelgestsugas* |
| SBP00095 | Kimchi - Sinto Gourmet | *Candidatus Puniceispirillum marinum* |
| SBP00095 | Kimchi - Sinto Gourmet | *Candidatus Purcelliella pentastirinorum* |
| SBP00095 | Kimchi - Sinto Gourmet | *Candidatus Rhodoluna planktonica* |
| SBP00095 | Kimchi - Sinto Gourmet | *Candidatus Saccharimonas aalborgensis* |
| SBP00095 | Kimchi - Sinto Gourmet | *Candidatus Solibacter usitatus* |
| SBP00095 | Kimchi - Sinto Gourmet | *Candidatus Symbiobacter mobilis* |
| SBP00095 | Kimchi - Sinto Gourmet | *Capnocytophaga canimorsus* |
| SBP00095 | Kimchi - Sinto Gourmet | *Capnocytophaga sp. ChDC OS43* |
| SBP00095 | Kimchi - Sinto Gourmet | *Capnocytophaga sp. oral taxon 878* |
| SBP00095 | Kimchi - Sinto Gourmet | *Capnocytophaga sputigena* |
| SBP00095 | Kimchi - Sinto Gourmet | *Carboxydothermus hydrogenoformans* |
| SBP00095 | Kimchi - Sinto Gourmet | *Carnobacterium divergens* |
| SBP00095 | Kimchi - Sinto Gourmet | *Carnobacterium inhibens* |
| SBP00095 | Kimchi - Sinto Gourmet | *Carnobacterium maltaromaticum* |
| SBP00095 | Kimchi - Sinto Gourmet | *Carnobacterium sp. 17-4* |
| SBP00095 | Kimchi - Sinto Gourmet | *Carnobacterium sp. CP1* |
| SBP00095 | Kimchi - Sinto Gourmet | *Castellaniella defragrans* |
| SBP00095 | Kimchi - Sinto Gourmet | *Catenulispora acidiphila* |
| SBP00095 | Kimchi - Sinto Gourmet | *Caulobacter flavus* |
| SBP00095 | Kimchi - Sinto Gourmet | *Caulobacter henricii* |
| SBP00095 | Kimchi - Sinto Gourmet | *Caulobacter mirabilis* |
| SBP00095 | Kimchi - Sinto Gourmet | *Caulobacter segnis* |
| SBP00095 | Kimchi - Sinto Gourmet | *Caulobacter sp. FWC26* |
| SBP00095 | Kimchi - Sinto Gourmet | *Caulobacter sp. K31* |
| SBP00095 | Kimchi - Sinto Gourmet | *Caulobacter vibrioides* |
| SBP00095 | Kimchi - Sinto Gourmet | *Cedecea lapagei* |
| SBP00095 | Kimchi - Sinto Gourmet | *Cedecea neteri* |
| SBP00095 | Kimchi - Sinto Gourmet | *Celeribacter ethanolicus* |
| SBP00095 | Kimchi . Sinto Gourmet | *Celeribacter indicus* |
| SBP00095 | Kimchi - Sinto Gourmet | *Cellulophaga algicola* |
| SBP00095 | Kimchi - Sinto Gourmet | *Cellulophaga lytica* |
| SBP00095 | Kimchi - Sinto Gourmet | *Cellulosilyticum lentocellum* |
| SBP00095 | Kimchi - Sinto Gourmet | *Cellvibrio japonicus* |
| SBP00095 | Kimchi - Sinto Gourmet | *Cellvibrio sp. PSBB006* |
| SBP00095 | Kimchi - Sinto Gourmet | *Cellvibrio sp. PSBB023* |
| SBP00095 | Kimchi - Sinto Gourmet | *Chania multitudinisentens* |
| SBP00095 | Kimchi - Sinto Gourmet | *Chelativorans sp. BNC1* |
| SBP00095 | Kimchi - Sinto Gourmet | *Chelatococcus daeguensis* |
| SBP00095 | Kimchi - Sinto Gourmet | *Chelatococcus sp. CO-6* |
| SBP00095 | Kimchi - Sinto Gourmet | *Chitinophaga caeni* |
| SBP00095 | Kimchi - Sinto Gourmet | *Chlamydia gallinacea* |
| SBP00095 | Kimchi - Sinto Gourmet | *Chlamydia sp. 2742-308* |
| SBP00095 | Kimchi - Sinto Gourmet | *Chlorobium phaeobacteroides* |
| SBP00095 | Kimchi - Sinto Gourmet | *Chloroflexus aggregans* |
| SBP00095 | Kimchi - Sinto Gourmet | *Chondrocystis sp. NIES-4102* |
| SBP00095 | Kimchi - Sinto Gourmet | *Chondromyces crocatus* |
| SBP00095 | Kimchi - Sinto Gourmet | *Chromobacterium sp. ATCC 53434* |
| SBP00095 | Kimchi - Sinto Gourmet | *Chromobacterium vaccinii* |
| SBP00095 | Kimchi - Sinto Gourmet | *Chromobacterium violaceum* |
| SBP00095 | Kimchi - Sinto Gourmet | *Chroococcidiopsis thermalis* |
| SBP00095 | Kimchi - Sinto Gourmet | *Chryseobacterium antarcticum* |
| SBP00095 | Kimchi - Sinto Gourmet | *Chryseobacterium arthrosphaerae* |
| SBP00095 | Kimchi - Sinto Gourmet | *Chryseobacterium balustinum* |
| SBP00095 | Kimchi - Sinto Gourmet | *Chryseobacterium bernardetil* |
| SBP00095 | Kimchi - Sinto Gourmet | *Chryseobacterium camelliae* |
| SBP00095 | Kimchi - Sinto Gourmet | *Chryseobacterium carnipullorum* |
| SBP00095 | Kimchi - Sinto Gourmet | *Chryseobacterium carnis* |
| SBP00095 | Kimchi - Sinto Gourmet | *Chryseobacterium gallinarum* |
| SBP00095 | Kimchi - Sinto Gourmet | *Chryseobacterium glaciei* |
| SBP00095 | Kimchi - Sinto Gourmet | *Chryseobacterium gleum* |
| SBP00095 | Kimchi - Sinto Gourmet | *Chryseobacterium indologenes* |
| SBP00095 | Kimchi - Sinto Gourmet | *Chryseobacterium indoltheticum* |
| SBP00095 | Kimchi - Sinto Gourmet | *Chryseobacterium jeonii* |
| SBP00095 | Kimchi - Sinto Gourmet | *Chryseobacterium joostei* |
| SBP00095 | Kimchi - Sinto Gourmet | *Chryseobacterium lactis* |
| SBP00095 | Kimchi - Sinto Gourmet | *Chryseobacterium piperi* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Chryseobacterium shandongense* |
| SBP00095 | Kimchi - Sinto Gourmet | *Chryseobacterium* sp. 1751E7 |
| SBP00095 | Kimchi - Sinto Gourmet | *Chryseobacterium* sp. 3008163 |
| SBP00095 | Kimchi - Sinto Gourmet | *Chryseobacterium* sp. F5649 |
| SBP00095 | Kimchi - Sinto Gourmet | *Chryseobacterium* sp. G0186 |
| SBP00095 | Kimchi - Sinto Gourmet | *Chryseobacterium* sp. G0201 |
| SBP00095 | Kimchi - Sinto Gourmet | *Chryseobacterium* sp. H6466 |
| SBP00095 | Kimchi - Sinto Gourmet | *Chryseobacterium* sp. IHB B 17019 |
| SBP00095 | Kimchi - Sinto Gourmet | *Chryseobacterium* sp. StRB126 |
| SBP00095 | Kimchi - Sinto Gourmet | *Chryseobacterium* sp. T16E-39 |
| SBP00095 | Kimchi - Sinto Gourmet | *Chryseobacterium taklimakanense* |
| SBP00095 | Kimchi - Sinto Gourmet | *Citrobacter amalonaticus* |
| SBP00095 | Kimchi - Sinto Gourmet | *Citrobacter braakii* |
| SBP00095 | Kimchi - Sinto Gourmet | *Citrobacter farmeri* |
| SBP00095 | Kimchi . Sinto Gourmet | *Citrobacter freundii* |
| SBP00095 | Kimchi - Sinto Gourmet | *Citrobacter freundii* complex sp. CFNIH2 |
| SBP00095 | Kimchi - Sinto Gourmet | *Citrobacter freundii* complex sp. CFNIH3 |
| SBP00095 | Kimchi - Sinto Gourmet | *Citrobacter freundii* complex sp. CFNIH4 |
| SBP00095 | Kimchi - Sinto Gourmet | *Citrobacter freundii* complex sp. CFNIH9 |
| SBP00095 | Kimchi - Sinto Gourmet | *Citrobacter koseri* |
| SBP00095 | Kimchi - Sinto Gourmet | *Citrobacter pasteurii* |
| SBP00095 | Kimchi - Sinto Gourmet | *Citrobacter portucalensis* |
| SBP00095 | Kimchi - Sinto Gourmet | *Citrobacter rodentium* |
| SBP00095 | Kimchi - Sinto Gourmet | *Citrobacter* sp. CFNIH10 |
| SBP00095 | Kimchi - Sinto Gourmet | *Citrobacter werkmanii* |
| SBP00095 | Kimchi - Sinto Gourmet | *Citrobacter youngae* |
| SBP00095 | Kimchi - Sinto Gourmet | *Citromicrobium* sp. JL477 |
| SBP00095 | Kimchi - Sinto Gourmet | *Clavibacter michiganensis* |
| SBP00095 | Kimchi - Sinto Gourmet | *Cloacibacterium normanense* |
| SBP00095 | Kimchi - Sinto Gourmet | *Clostridiales bacterium* CCNA10 |
| SBP00095 | Kimchi - Sinto Gourmet | *Clostridioides difficile* |
| SBP00095 | Kimchi - Sinto Gourmet | *Clostridium aceticum* |
| SBP00095 | Kimchi - Sinto Gourmet | *Clostridium argentinense* |
| SBP00095 | Kimchi - Sinto Gourmet | *Clostridium baratii* |
| SBP00095 | Kimchi - Sinto Gourmet | *Clostridium beijerinckii* |
| SBP00095 | Kimchi - Sinto Gourmet | *Clostridium bornimense* |
| SBP00095 | Kimchi - Sinto Gourmet | *Clostridium botulinum* |
| SBP00095 | Kimchi - Sinto Gourmet | *Clostridium carboxidivorans* |
| SBP00095 | Kimchi - Sinto Gourmet | *Clostridium cellulovorans* |
| SBP00095 | Kimchi - Sinto Gourmet | *Clostridium chauvoei* |
| SBP00095 | Kimchi - Sinto Gourmet | *Clostridium estertheticum* |
| SBP00095 | Kimchi - Sinto Gourmet | *Clostridium kluyveri* |
| SBP00095 | Kimchi - Sinto Gourmet | *Clostridium novyi* |
| SBP00095 | Kimchi - Sinto Gourmet | *Clostridium perfringens* |
| SBP00095 | Kimchi - Sinto Gourmet | *Clostridium saccharoperbutylacetonicum* |
| SBP00095 | Kimchi - Sinto Gourmet | *Clostridium scatologenes* |
| SBP00095 | Kimchi - Sinto Gourmet | *Clostridium* sp. AWRP |
| SBP00095 | Kimchi - Sinto Gourmet | *Clostridium* sp. DL-VIII |
| SBP00095 | Kimchi - Sinto Gourmet | *Clostridium* sp. MF28 |
| SBP00095 | Kimchi - Sinto Gourmet | *Clostridium sporogenes* |
| SBP00095 | Kimchi - Sinto Gourmet | *Clostridium taeniosporum* |
| SBP00095 | Kimchi - Sinto Gourmet | *Clostridium tetani* |
| SBP00095 | Kimchi - Sinto Gourmet | *Clostridium tyrobutyricum* |
| SBP00095 | Kimchi - Sinto Gourmet | *Cnuibacter physcomitrellae* |
| SBP00095 | Kimchi - Sinto Gourmet | *Cohaesibacter* sp. ES.047 |
| SBP00095 | Kimchi - Sinto Gourmet | *Cohnella* sp. 18JY8-7 |
| SBP00095 | Kimchi - Sinto Gourmet | *Collimonas arenae* |
| SBP00095 | Kimchi - Sinto Gourmet | *Collimonas fungivorans* |
| SBP00095 | Kimchi - Sinto Gourmet | *Collimonas pratensis* |
| SBP00095 | Kimchi - Sinto Gourmet | *Collinsella aerofaciens* |
| SBP00095 | Kimchi - Sinto Gourmet | *Colwellia* sp. Arc7-635 |
| SBP00095 | Kimchi - Sinto Gourmet | *Colwellia* sp. PAMC 21821 |
| SBP00095 | Kimchi - Sinto Gourmet | *Comamonas aquatica* |
| SBP00095 | Kimchi - Sinto Gourmet | *Comamonas kerstersii* |
| SBP00095 | Kimchi - Sinto Gourmet | *Comamonas serinivorans* |
| SBP00095 | Kimchi - Sinto Gourmet | *Comamonas terrigena* |
| SBP00095 | Kimchi - Sinto Gourmet | *Comamonas testosteroni* |
| SBP00095 | Kimchi - Sinto Gourmet | *Comamonas thiooxydans* |
| SBP00095 | Kimchi - Sinto Gourmet | *Commensalibacter* sp. AMU001 |
| SBP00095 | Kimchi - Sinto Gourmet | *Coprothermobacter proteolyticus* |
| SBP00095 | Kimchi - Sinto Gourmet | *Coraliomargarita akajimensis* |
| SBP00095 | Kimchi - Sinto Gourmet | *Corallococcus coralloides* |
| SBP00095 | Kimchi - Sinto Gourmet | *Corynebacterium aquilae* |
| SBP00095 | Kimchi - Sinto Gourmet | *Corynebacterium casei* |
| SBP00095 | Kimchi - Sinto Gourmet | *Corynebacterium crudilactis* |
| SBP00095 | Kimchi - Sinto Gourmet | *Corynebacterium diphtheriae* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Corynebacterium efficiens* |
| SBP00095 | Kimchi - Sinto Gourmet | *Corynebacterium geronticis* |
| SBP00095 | Kimchi - Sinto Gourmet | *Corynebacterium glaucum* |
| SBP00095 | Kimchi - Sinto Gourmet | *Corynebacterium glutamicum* |
| SBP00095 | Kimchi - Sinto Gourmet | *Corynebacterium glyciniphilum* |
| SBP00095 | Kimchi - Sinto Gourmet | *Corynebacterium jeikeium* |
| SBP00095 | Kimchi - Sinto Gourmet | *Corynebacterium lactis* |
| SBP00095 | Kimchi - Sinto Gourmet | *Corynebacterium phocae* |
| SBP00095 | Kimchi - Sinto Gourmet | *Corynebacterium riegelii* |
| SBP00095 | Kimchi - Sinto Gourmet | *Corynebacterium segmentosum* |
| SBP00095 | Kimchi - Sinto Gourmet | *Corynebacterium simulans* |
| SBP00095 | Kimchi - Sinto Gourmet | *Corynebacterium terpenotabidum* |
| SBP00095 | Kimchi - Sinto Gourmet | *Corynebacterium ulcerans* |
| SBP00095 | Kimchi - Sinto Gourmet | *Corynebacterium urealyticum* |
| SBP00095 | Kimchi - Sinto Gourmet | *Corynebacterium uterequi* |
| SBP00095 | Kimchi - Sinto Gourmet | *Corynebacterium variabile* |
| SBP00095 | Kimchi - Sinto Gourmet | *Coxiella burnetii* |
| SBP00095 | Kimchi - Sinto Gourmet | *Croceibacter atlanticus* |
| SBP00095 | Kimchi - Sinto Gourmet | *Croceicoccus marinus* |
| SBP00095 | Kimchi - Sinto Gourmet | *Croceicoccus naphthovorans* |
| SBP00095 | Kimchi - Sinto Gourmet | *Cronobacter condimenti* |
| SBP00095 | Kimchi - Sinto Gourmet | *Cronobacter dublinensis* |
| SBP00095 | Kimchi - Sinto Gourmet | *Cronobacter malonaticus* |
| SBP00095 | Kimchi - Sinto Gourmet | *Cronobacter muytjensii* |
| SBP00095 | Kimchi - Sinto Gourmet | *Cronobacter sakazakii* |
| SBP00095 | Kimchi - Sinto Gourmet | *Cronobacter turicensis* |
| SBP00095 | Kimchi - Sinto Gourmet | *Cronobacter universalis* |
| SBP00095 | Kimchi - Sinto Gourmet | *Cryobacterium* sp. LW097 |
| SBP00095 | Kimchi - Sinto Gourmet | *Cupriavidus basilensis* |
| SBP00095 | Kimchi - Sinto Gourmet | *Cupriavidus gilardii* |
| SBP00095 | Kimchi - Sinto Gourmet | *Cupriavidus metallidurans* |
| SBP00095 | Kimchi - Sinto Gourmet | *Cupriavidus necator* |
| SBP00095 | Kimchi - Sinto Gourmet | *Cupriavidus oxalaticus* |
| SBP00095 | Kimchi - Sinto Gourmet | *Cupriavidus pauculus* |
| SBP00095 | Kimchi - Sinto Gourmet | *Cupriavidus pinatubonensis* |
| SBP00095 | Kimchi - Sinto Gourmet | *Cupriavidus* sp. USMAA2-4 |
| SBP00095 | Kimchi - Sinto Gourmet | *Cupriavidus taiwanensis* |
| SBP00095 | Kimchi - Sinto Gourmet | *Curtobacterium pusillum* |
| SBP00095 | Kimchi - Sinto Gourmet | *Curtobacterium* sp. SGAir0471 |
| SBP00095 | Kimchi - Sinto Gourmet | *Curvibacter* sp. AEP1-3 |
| SBP00095 | Kimchi - Sinto Gourmet | *Cutibacterium acnes* |
| SBP00095 | Kimchi - Sinto Gourmet | *Cutibacterium granulosum* |
| SBP00095 | Kimchi - Sinto Gourmet | *Cyanothece* sp. ATCC 51142 |
| SBP00095 | Kimchi - Sinto Gourmet | *Cyanothece* sp. PCC 7425 |
| SBP00095 | Kimchi - Sinto Gourmet | *Cyclobacterium amurskyense* |
| SBP00095 | Kimchi - Sinto Gourmet | *Dehalococcoides mccartyi* |
| SBP00095 | Kimchi - Sinto Gourmet | *Dehalogenimonas lykanthroporepellens* |
| SBP00095 | Kimchi - Sinto Gourmet | *Deinococcus actinosclerus* |
| SBP00095 | Kimchi - Sinto Gourmet | *Deinococcus deserti* |
| SBP00095 | Kimchi - Sinto Gourmet | *Deinococcus gobiensis* |
| SBP00095 | Kimchi - Sinto Gourmet | *Deinococcus swuensis* |
| SBP00095 | Kimchi - Sinto Gourmet | *Delftia acidovorans* |
| SBP00095 | Kimchi - Sinto Gourmet | *Delftia* sp. |
| SBP00095 | Kimchi - Sinto Gourmet | *Delftia* sp. Cs1-4 |
| SBP00095 | Kimchi - Sinto Gourmet | *Delftia* sp. HK171 |
| SBP00095 | Kimchi - Sinto Gourmet | *Delftia tsuruhatensis* |
| SBP00095 | Kimchi - Sinto Gourmet | *Denitrobacterium detoxificans* |
| SBP00095 | Kimchi - Sinto Gourmet | *Dermacoccus nishinomiyaensis* |
| SBP00095 | Kimchi - Sinto Gourmet | *Desulfallas gibsoniae* |
| SBP00095 | Kimchi - Sinto Gourmet | *Desulfitobacterium dehalogenans* |
| SBP00095 | Kimchi - Sinto Gourmet | *Desulfitobacterium hafniense* |
| SBP00095 | Kimchi - Sinto Gourmet | *Desulfitobacterium metallireducens* |
| SBP00095 | Kimchi - Sinto Gourmet | *Desulfobacter hydrogenophilus* |
| SBP00095 | Kimchi - Sinto Gourmet | *Desulfobacter postgatei* |
| SBP00095 | Kimchi - Sinto Gourmet | *Desulfobulbus oralis* |
| SBP00095 | Kimchi - Sinto Gourmet | *Desulfococcus multivorans* |
| SBP00095 | Kimchi - Sinto Gourmet | *Desulfoglaeba alkanexedens* |
| SBP00095 | Kimchi - Sinto Gourmet | *Desulfosporosinus youngiae* |
| SBP00095 | Kimchi - Sinto Gourmet | *Desulfotomaculum reducens* |
| SBP00095 | Kimchi - Sinto Gourmet | *Desulfotomaculum ruminis* |
| SBP00095 | Kimchi - Sinto Gourmet | *Desulfovibrio gigas* |
| SBP00095 | Kimchi - Sinto Gourmet | *Desulfovibrio hydrothermalis* |
| SBP00095 | Kimchi - Sinto Gourmet | *Desulfovibrio magneticus* |
| SBP00095 | Kimchi - Sinto Gourmet | *Desulfovibrio piger* |
| SBP00095 | Kimchi - Sinto Gourmet | *Desulfovibrio* sp. FW1012B |
| SBP00095 | Kimchi - Sinto Gourmet | *Desulfurispirillum indicum* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Desulfurivibrio alkaliphilus* |
| SBP00095 | Kimchi - Sinto Gourmet | *Desulfurobacterium thermolithotrophum* |
| SBP00095 | Kimchi - Sinto Gourmet | *Desulfuromonas* sp. DDH964 |
| SBP00095 | Kimchi - Sinto Gourmet | *Devosia* sp. 1566 |
| SBP00095 | Kimchi - Sinto Gourmet | *Devosia* sp. A16 |
| SBP00095 | Kimchi - Sinto Gourmet | *Devosia* sp. 1507 |
| SBP00095 | Kimchi - Sinto Gourmet | *Dialister pneumosintes* |
| SBP00095 | Kimchi - Sinto Gourmet | *Dialister* sp. Marseille-P5638 |
| SBP00095 | Kimchi - Sinto Gourmet | *Dichelobacter nodosus* |
| SBP00095 | Kimchi - Sinto Gourmet | *Dickeya chrysanthemi* |
| SBP00095 | Kimchi - Sinto Gourmet | *Dickeya dadantii* |
| SBP00095 | Kimchi - Sinto Gourmet | *Dickeya dianthicola* |
| SBP00095 | Kimchi - Sinto Gourmet | *Dickeya fangzhongdai* |
| SBP00095 | Kimchi - Sinto Gourmet | *Dickeya paradisiaca* |
| SBP00095 | Kimchi - Sinto Gourmet | *Dickeya* sp. NCPPB 569 |
| SBP00095 | Kimchi - Sinto Gourmet | *Dickeya zeae* |
| SBP00095 | Kimchi - Sinto Gourmet | *Dietzia psychralcaliphita* |
| SBP00095 | Kimchi - Sinto Gourmet | *Diptera* sp. BOLD: AAB3286 |
| SBP00095 | Kimchi - Sinto Gourmet | *Dokdonella koreensis* |
| SBP00095 | Kimchi - Sinto Gourmet | *Dokdonia* sp. Dokd-P16 |
| SBP00095 | Kimchi - Sinto Gourmet | *Draconibacterium orientale* |
| SBP00095 | Kimchi - Sinto Gourmet | *Dyadobacter fermentans* |
| SBP00095 | Kimchi - Sinto Gourmet | *Dyella japonica* |
| SBP00095 | Kimchi - Sinto Gourmet | *Dyella thiooxydans* |
| SBP00095 | Kimchi - Sinto Gourmet | *Echinicola strongylocentroti* |
| SBP00095 | Kimchi - Sinto Gourmet | *Edwardsiella ictaluri* |
| SBP00095 | Kimchi - Sinto Gourmet | *Edwardsiella tarda* |
| SBP00095 | Kimchi - Sinto Gourmet | *Eggerthella lenta* |
| SBP00095 | Kimchi - Sinto Gourmet | *Elizabethkingia anophelis* |
| SBP00095 | Kimchi - Sinto Gourmet | *Elizabethkingia miricola* |
| SBP00095 | Kimchi - Sinto Gourmet | *Elusimicrobium minutum* |
| SBP00095 | Kimchi - Sinto Gourmet | *Ensifer adhaerens* |
| SBP00095 | Kimchi - Sinto Gourmet | *Ensifer sojae* |
| SBP00095 | Kimchi - Sinto Gourmet | *Enterobacter asburiae* |
| SBP00095 | Kimchi - Sinto Gourmet | *Enterobacter bugandensis* |
| SBP00095 | Kimchi - Sinto Gourmet | *Enterobacter cancerogenus* |
| SBP00095 | Kimchi - Sinto Gourmet | *Enterobacter cloacae* |
| SBP00095 | Kimchi - Sinto Gourmet | *Enterobacter cloacae* complex sp. |
| SBP00095 | Kimchi - Sinto Gourmet | *Enterobacter cloacae* complex sp. FDA-CDC-AR_0132 |
| SBP00095 | Kimchi - Sinto Gourmet | *Enterobacter cloacae* complex sp. FDA-CDC-AR_0164 |
| SBP00095 | Kimchi - Sinto Gourmet | *Enterobacter hormaechei* |
| SBP00095 | Kimchi - Sinto Gourmet | *Enterobacter kobei* |
| SBP00095 | Kimchi - Sinto Gourmet | *Enterobacter ludwigii* |
| SBP00095 | Kimchi - Sinto Gourmet | *Enterobacter roggenkampii* |
| SBP00095 | Kimchi - Sinto Gourmet | *Enterobacter soli* |
| SBP00095 | Kimchi - Sinto Gourmet | *Enterobacter* sp. 638 |
| SBP00095 | Kimchi - Sinto Gourmet | *Enterobacter* sp. Crenshaw |
| SBP00095 | Kimchi - Sinto Gourmet | *Enterobacter* sp. E20 |
| SBP00095 | Kimchi - Sinto Gourmet | *Enterobacter* sp. FY-07 |
| SBP00095 | Kimchi - Sinto Gourmet | *Enterobacter* sp. HK169 |
| SBP00095 | Kimchi - Sinto Gourmet | *Enterobacter* sp. N18-03635 |
| SBP00095 | Kimchi - Sinto Gourmet | *Enterobacter* sp. R4-368 |
| SBP00095 | Kimchi - Sinto Gourmet | *Enterobacter* sp. RFL1396 |
| SBP00095 | Kimchi - Sinto Gourmet | *Enterobacter* sp. SA187 |
| SBP00095 | Kimchi - Sinto Gourmet | *Enterobacteriaceae bacterium* ENNIH1 |
| SBP00095 | Kimchi - SInto Gourmet | *Enterobacteriaceae bacterium* SOS |
| SBP00095 | Kimchi - Sinto Gourmet | *Enterobacteriaceae bacterium* strain FGI S7 |
| SBP00095 | Kimchi - Sinto Gourmet | *Enterobacteriaceae bacterium* w17 |
| SBP00095 | Kimchi - Sinto Gourmet | *Enterobacteriaceae bacterium* w6 |
| SBP00095 | Kimchi - Sinto Gourmet | *Enterococcus avium* |
| SBP00095 | Kimchi - Sinto Gourmet | *Enterococcus casseliflavus* |
| SBP00095 | Kimchi - Sinto Gourmet | *Enterococcus cecorum* |
| SBP00095 | Kimchi - Sinto Gourmet | *Enterococcus durans* |
| SBP00095 | Kimchi - Sinto Gourmet | *Enterococcus faecalis* |
| SBP00095 | Kimchi - Sinto Gourmet | *Enterococcus faecium* |
| SBP00095 | Kimchi - Sinto Gourmet | *Enterococcus gallinarum* |
| SBP00095 | Kimchi - Sinto Gourmet | *Enterococcus gilvus* |
| SBP00095 | Kimchi - Sinto Gourmet | *Enterococcus hirae* |
| SBP00095 | Kimchi - Sinto Gourmet | *Enterococcus mundtii* |
| SBP00095 | Kimchi - Sinto Gourmet | *Enterococcus* sp. CR-Ec1 |
| SBP00095 | Kimchi - Sinto Gourmet | *Enterococcus* sp. FDAARGOS_375 |
| SBP00095 | Kimchi - Sinto Gourmet | *Enterococcus* sp. FDAARGOS_553 |
| SBP00095 | Kimchi - Sinto Gourmet | *Enterococcus thailandicus* |
| SBP00095 | Kimchi - Sinto Gourmet | *Enterococcus wangshanyuanii* |
| SBP00095 | Kimchi - Sinto Gourmet | *Entomoplasma luminosum* |
| SBP00095 | Kimchi - Sinto Gourmet | *Erwinia amylovora* |

TABLE 3-continued

List of species identified in each metagenomic sample of each SBP Sample

| SBP ID | SBP Host Common Name | Genus sp. |
| --- | --- | --- |
| SBP00095 | Kimchi - Sinto Gourmet | *Erwinia billingiae* |
| SBP00095 | Kimchi - Sinto Gourmet | *Erwinia gerundensis* |
| SBP00095 | Kimchi - Sinto Gourmet | *Erwinia persicina* |
| SBP00095 | Kimchi - Sinto Gourmet | *Erwinia* phage vB_EamM-Y2 |
| SBP00095 | Kimchi - Sinto Gourmet | *Erwinia pyrifoliae* |
| SBP00095 | Kimchi - Sinto Gourmet | *Erwinia* sp. |
| SBP00095 | Kimchi - Sinto Gourmet | *Erwinia* sp. Ejp617 |
| SBP00095 | Kimchi - Sinto Gourmet | *Erwinia tasmaniensis* |
| SBP00095 | Kimchi - Sinto Gourmet | *Erysipelothrix rhusiopathiae* |
| SBP00095 | Kimchi - Sinto Gourmet | *Erysipelotrichaceae bacterium* GAM147 |
| SBP00095 | Kimchi - Sinto Gourmet | *Erysipelotrichaceae bacterium* SG0102 |
| SBP00095 | Kimchi - Sinto Gourmet | *Erythrobacter flavus* |
| SBP00095 | Kimchi - Sinto Gourmet | *Erythrobacter gangjinensis* |
| SBP00095 | Kimchi - Sinto Gourmet | *Erythrobacter litoralis* |
| SBP00095 | Kimchi - Sinto Gourmet | *Erythrobacter seohaensis* |
| SBP00095 | Kimchi - Sinto Gourmet | *Erythrobacter* sp. Alg231-14 |
| SBP00095 | Kimchi - Sinto Gourmet | *Erythrobacter* sp. HKB08 |
| SBP00095 | Kimchi - Sinto Gourmet | *Erythrobacter* sp. HL-111 |
| SBP00095 | Kimchi - Sinto Gourmet | *Erythrobacter* sp. YH-07 |
| SBP00095 | Kimchi - Sinto Gourmet | *Escherichia albertii* |
| SBP00095 | Kimchi - Sinto Gourmet | *Escherichia coli* |
| SBP00095 | Kimchi - Sinto Gourmet | *Escherichia fergusonii* |
| SBP00095 | Kimchi - Sinto Gourmet | *Escherichia* sp. E4742 |
| SBP00095 | Kimchi - Sinto Gourmet | *Ethanoligenens harbinense* |
| SBP00095 | Kimchi - Sinto Gourmet | *Eubacterium limosum* |
| SBP00095 | Kimchi - Sinto Gourmet | *Eubacterium maltosivorans* |
| SBP00095 | Kimchi - Sinto Gourmet | *Exiguobacterium antarcticum* |
| SBP00095 | Kimchi - Sinto Gourmet | *Exiguobacterium sibiricum* |
| SBP00095 | Kimchi - Sinto Gourmet | *Exiguobacterium* sp. AT1b |
| SBP00095 | Kimchi - Sinto Gourmet | *Exiguobacterium* sp. MH3 |
| SBP00095 | Kimchi - Sinto Gourmet | *Exiguobacterium* sp. N4-1P |
| SBP00095 | Kimchi - Sinto Gourmet | *Exiguobacterium* sp. U13-1 |
| SBP00095 | Kimchi - Sinto Gourmet | *Ezakiella massiliensis* |
| SBP00095 | Kimchi - Sinto Gourmet | *Fabibacter pacificus* |
| SBP00095 | Kimchi - Sinto Gourmet | *Faecalibacterium prausnitzii* |
| SBP00095 | Kimchi - Sinto Gourmet | *Faecalibaculum rodentium* |
| SBP00095 | Kimchi - Sinto Gourmet | *Faecalitalea cylindroides* |
| SBP00095 | Kimchi - Sinto Gourmet | *Ferrimonas balearica* |
| SBP00095 | Kimchi - Sinto Gourmet | *Ferriphaselus amnicola* |
| SBP00095 | Kimchi - Sinto Gourmet | *Fictibacillus arsenicus* |
| SBP00095 | Kimchi - Sinto Gourmet | *Fictibacillus phosphorivorans* |
| SBP00095 | Kimchi - Sinto Gourmet | *Finegoldia magna* |
| SBP00095 | Kimchi - Sinto Gourmet | *Fischerella* sp. NIES-3754 |
| SBP00095 | Kimchi - Sinto Gourmet | *Flammeovirga* sp. MY04 |
| SBP00095 | Kimchi - Sinto Gourmet | *Flavobacteriaceae bacterium* MAR_2010_188 |
| SBP00095 | Kimchi - Sinto Gourmet | *Flavobacterium album* |
| SBP00095 | Kimchi - Sinto Gourmet | *Flavobacterium anhuiense* |
| SBP00095 | Kimchi - Sinto Gourmet | *Flavobacterium branchiophilum* |
| SBP00095 | Kimchi - Sinto Gourmet | *Flavobacterium columnare* |
| SBP00095 | Kimchi - Sinto Gourmet | *Flavobacterium commune* |
| SBP00095 | Kimchi - Sinto Gourmet | *Flavobacterium crassostreae* |
| SBP00095 | Kimchi - Sinto Gourmet | *Flavobacterium crocinum* |
| SBP00095 | Kimchi - Sinto Gourmet | *Flavobacterium faecale* |
| SBP00095 | Kimchi - Sinto Gourmet | *Flavobacterium gilvum* |
| SBP00095 | Kimchi - Sinto Gourmet | *Flavobacterium indicum* |
| SBP00095 | Kimchi - Sinto Gourmet | *Flavobacterium johnsoniae* |
| SBP00095 | Kimchi - Sinto Gourmet | *Flavobacterium psychrophilum* |
| SBP00095 | Kimchi - Sinto Gourmet | *Flavobacterium* sp. 140616W15 |
| SBP00095 | Kimchi - Sinto Gourmet | *Flavobacterium* sp. CJ74 |
| SBP00095 | Kimchi - Sinto Gourmet | *Flavobacterium* sp. HYN0086 |
| SBP00095 | Kimchi - Sinto Gourmet | *Flavonifractor plautii* |
| SBP00095 | Kimchi - Sinto Gourmet | *Formosa* sp. Hel1_31_208 |
| SBP00095 | Kimchi - Sinto Gourmet | *Formosa* sp. Hel3_A1_48 |
| SBP00095 | Kimchi - Sinto Gourmet | *Francisella* sp. CA97-1460 |
| SBP00095 | Kimchi - Sinto Gourmet | *Francisella* sp. FSC1006 |
| SBP00095 | Kimchi - Sinto Gourmet | *Frankia* sp. EAN1pec |
| SBP00095 | Kimchi - Sinto Gourmet | *Frankineae bacterium* MT45 |
| SBP00095 | Kimchi - Sinto Gourmet | *Friedmanniella sagamiharensis* |
| SBP00095 | Kimchi - Sinto Gourmet | *Frischella perrara* |
| SBP00095 | Kimchi - Sinto Gourmet | *Frondihabitans* sp. PAMC 28766 |
| SBP00095 | Kimchi - Sinto Gourmet | *Fusobacterium hwasookii* |
| SBP00095 | Kimchi - Sinto Gourmet | *Fusobacterium mortiferum* |
| SBP00095 | Kimchi - Sinto Gourmet | *Fusobacterium nucleatum* |
| SBP00095 | Kimchi - Sinto Gourmet | *Fusobacterium ulcerans* |
| SBP00095 | Kimchi - Sinto Gourmet | *Gallaecimonas* sp. HK-28 |
| SBP00095 | Kimchi - Sinto Gourmet | *Gammaproteobacteria bacterium* DM2 |

TABLE 3-continued

List of species identified in each metagenomic sample of each SBP Sample

| SBP ID | SBP Host Common Name | Genus sp. |
| --- | --- | --- |
| SBP00095 | Kimchi - Sinto Gourmet | *Gardnerella vaginalis* |
| SBP00095 | Kimchi - Sinto Gourmet | *Gemella haemolysans* |
| SBP00095 | Kimchi - Sinto Gourmet | *Gemmata* sp. SH-PL17 |
| SBP00095 | Kimchi - Sinto Gourmet | *Gemmatimonas aurantiaca* |
| SBP00095 | Kimchi - Sinto Gourmet | *Gemmatirosa kalamazoonesis* |
| SBP00095 | Kimchi - Sinto Gourmet | *Geoalkalibacter subterraneus* |
| SBP00095 | Kimchi - Sinto Gourmet | *Geobacillus* genomosp. 3 |
| SBP00095 | Kimchi - Sinto Gourmet | *Geobacillus lituanicus* |
| SBP00095 | Kimchi - Sinto Gourmet | *Geobacillus* sp. JS12 |
| SBP00095 | Kimchi - Sinto Gourmet | *Geobacillus subterraneus* |
| SBP00095 | Kimchi - Sinto Gourmet | *Geobacillus thermodenitrificans* |
| SBP00095 | Kimchi - Sinto Gourmet | *Geobacter metallireducens* |
| SBP00095 | Kimchi - Sinto Gourmet | *Geobacter* sp. M21 |
| SBP00095 | Kimchi - Sinto Gourmet | *Geodermatophilus obscurus* |
| SBP00095 | Kimchi - Sinto Gourmet | *Geosporobacter ferrireducens* |
| SBP00095 | Kimchi - Sinto Gourmet | *Gibbsiella quercinecans* |
| SBP00095 | Kimchi - Sinto Gourmet | *Gilvibacter* sp. SZ-19 |
| SBP00095 | Kimchi - Sinto Gourmet | *Glaciecola* sp. 4H-3-7 + YE-5 |
| SBP00095 | Kimchi - Sinto Gourmet | *Glaciecola* sp. THG-3.7 |
| SBP00095 | Kimchi - Sinto Gourmet | *Glaesserella parasuis* |
| SBP00095 | Kimchi - Sinto Gourmet | *Gloeobacter kilaueensis* |
| SBP00095 | Kimchi - Sinto Gourmet | *Gloeobacter violaceus* |
| SBP00095 | Kimchi - Sinto Gourmet | *Gloeocapsa* sp. PCC 7428 |
| SBP00095 | Kimchi - Sinto Gourmet | *Gluconacetobacter diazotrophicus* |
| SBP00095 | Kimchi - Sinto Gourmet | *Gluconobacter oxydans* |
| SBP00095 | Kimchi - Sinto Gourmet | *Gordonia* sp. MMS17-SY073 |
| SBP00095 | Kimchi - Sinto Gourmet | *Gordonibacter pamelaeae* |
| SBP00095 | Kimchi - Sinto Gourmet | *Granulibacter bethesdensis* |
| SBP00095 | Kimchi - Sinto Gourmet | *Granulicella mallensis* |
| SBP00095 | Kimchi - Sinto Gourmet | *Granulosicoccus antarcticus* |
| SBP00095 | Kimchi - Sinto Gourmet | *Grimontia hollisae* |
| SBP00095 | Kimchi - Sinto Gourmet | *Gynuella sunshinyii* |
| SBP00095 | Kimchi - Sinto Gourmet | *Haematospirillum jordaniae* |
| SBP00095 | Kimchi - Sinto Gourmet | *Haemophilus influenzae* |
| SBP00095 | Kimchi - Sinto Gourmet | *Haemophilus parainfluenzae* |
| SBP00095 | Kimchi - Sinto Gourmet | *Haemophilus pittmaniae* |
| SBP00095 | Kimchi - Sinto Gourmet | *Hafnia alvei* |
| SBP00095 | Kimchi - Sinto Gourmet | *Hafnia paralvei* |
| SBP00095 | Kimchi - Sinto Gourmet | *Hafnia* sp. CBA7124 |
| SBP00095 | Kimchi - Sinto Gourmet | *Hahella* sp. KA22 |
| SBP00095 | Kimchi - Sinto Gourmet | *Halanaerobium hydrogeniformans* |
| SBP00095 | Kimchi - Sinto Gourmet | *Halanaerobium praevalens* |
| SBP00095 | Kimchi - Sinto Gourmet | *Halapricum salinum* |
| SBP00095 | Kimchi - Sinto Gourmet | *Haliangium ochraceum* |
| SBP00095 | Kimchi - Sinto Gourmet | *Haloarculaceae archaeon* HArcel1 |
| SBP00095 | Kimchi - Sinto Gourmet | *Halobacillus halophilus* |
| SBP00095 | Kimchi - Sinto Gourmet | *Halobacillus litoralis* |
| SBP00095 | Kimchi - Sinto Gourmet | *Halobacillus mangrovi* |
| SBP00095 | Kimchi - Sinto Gourmet | *Halobacteroides halobius* |
| SBP00095 | Kimchi - Sinto Gourmet | *Halobellus limi* |
| SBP00095 | Kimchi - Sinto Gourmet | *Halomonas elongata* |
| SBP00095 | Kimchi - Sinto Gourmet | *Halomonas hydrothermalis* |
| SBP00095 | Kimchi - Sinto Gourmet | *Halomonas* sp. 1513 |
| SBP00095 | Kimchi - Sinto Gourmet | *Halomonas* sp. GT |
| SBP00095 | Kimchi - Sinto Gourmet | *Halomonas* sp. JS92-SW72 |
| SBP00095 | Kimchi - Sinto Gourmet | *Halomonas* sp. SF2003 |
| SBP00095 | Kimchi - Sinto Gourmet | *Halomonas venusta* |
| SBP00095 | Kimchi - Sinto Gourmet | *Haloquadratum walsbyi* |
| SBP00095 | Kimchi - Sinto Gourmet | *Halorhabdus utahensis* |
| SBP00095 | Kimchi - Sinto Gourmet | *Halorientalis* sp. IM1011 |
| SBP00095 | Kimchi - Sinto Gourmet | *Halorubrum lacusprofundi* |
| SBP00095 | Kimchi - Sinto Gourmet | *Halotalea alkalilenta* |
| SBP00095 | Kimchi - Sinto Gourmet | *Halothece* sp. PCC 7418 |
| SBP00095 | Kimchi - Sinto Gourmet | *Halothermothrix orenii* |
| SBP00095 | Kimchi - Sinto Gourmet | *Halothiobacillus neapolitanus* |
| SBP00095 | Kimchi - Sinto Gourmet | *Hartmannibacter diazotrophicus* |
| SBP00095 | Kimchi - Sinto Gourmet | *Hathewaya histolytica* |
| SBP00095 | Kimchi - Sinto Gourmet | *Helicobacter cetorum* |
| SBP00095 | Kimchi - Sinto Gourmet | *Helicobacter felis* |
| SBP00095 | Kimchi - Sinto Gourmet | *Helicobacter pullorum* |
| SBP00095 | Kimchi - Sinto Gourmet | *Helicobacter pylori* |
| SBP00095 | Kimchi - Sinto Gourmet | *Herbaspirillum hiltneri* |
| SBP00095 | Kimchi - Sinto Gourmet | *Herbaspirillum huttiense* |
| SBP00095 | Kimchi - Sinto Gourmet | *Herbaspirillum robiniae* |
| SBP00095 | Kimchi - Sinto Gourmet | *Herbaspirillum rubrisubalbicans* |
| SBP00095 | Kimchi - Sinto Gourmet | *Herbaspirillum seropedicae* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Herbaspirillum* sp. meg3 |
| SBP00095 | Kimchi - Sinto Gourmet | *Herminiimonas arsenitoxidans* |
| SBP00095 | Kimchi - Sinto Gourmet | *Hoeflea phototrophica* |
| SBP00095 | Kimchi - Sinto Gourmet | *Hoeflea* sp. IMCC20628 |
| SBP00095 | Kimchi - Sinto Gourmet | *Hungateiclostridium thermocellum* |
| SBP00095 | Kimchi - Sinto Gourmet | *Hungatella hathewayi* |
| SBP00095 | Kimchi - Sinto Gourmet | *Hydrogenophaga crassostreae* |
| SBP00095 | Kimchi - Sinto Gourmet | *Hydrogenophaga pseudoflava* |
| SBP00095 | Kimchi - Sinto Gourmet | *Hydrogenophaga* sp. NH-16 |
| SBP00095 | Kimchi - Sinto Gourmet | *Hydrogenophaga* sp. PBC |
| SBP00095 | Kimchi - Sinto Gourmet | *Hydrogenophaga* sp. RAC07 |
| SBP00095 | Kimchi - Sinto Gourmet | *Hydrogenophilus thermoluteolus* |
| SBP00095 | Kimchi - Sinto Gourmet | *Hydrogenovibrio crunogenus* |
| SBP00095 | Kimchi - Sinto Gourmet | *Hydromonas* sp. F02 |
| SBP00095 | Kimchi - Sinto Gourmet | *Hylemonella gracilis* |
| SBP00095 | Kimchi - Sinto Gourmet | *Hymenobacter nivis* |
| SBP00095 | Kimchi - Sinto Gourmet | *Hymenobacter sedentarius* |
| SBP00095 | Kimchi - Sinto Gourmet | *Hymenobacter* sp. 17J68-5 |
| SBP00095 | Kimchi - Sinto Gourmet | *Hymenobacter* sp. APR13 |
| SBP00095 | Kimchi - Sinto Gourmet | *Hymenobacter* sp. DG25A |
| SBP00095 | Kimchi - Sinto Gourmet | *Hymenobacter* sp. PAMC 26554 |
| SBP00095 | Kimchi - Sinto Gourmet | *Hymenobacter* sp. PAMC 26628 |
| SBP00095 | Kimchi - Sinto Gourmet | *Hyphomicrobium denitrificans* |
| SBP00095 | Kimchi - Sinto Gourmet | *Hyphomicrobium* sp. MC1 |
| SBP00095 | Kimchi - Sinto Gourmet | *Hyphomonas neptunium* |
| SBP00095 | Kimchi - Sinto Gourmet | *Hyposoter fugitivus ichnovirus* |
| SBP00095 | Kimchi - Sinto Gourmet | *Idiomarina piscisalsi* |
| SBP00095 | Kimchi - Sinto Gourmet | *Idiomarina* sp. OT37-5b |
| SBP00095 | Kimchi - Sinto Gourmet | *Indioceanicola profundi* |
| SBP00095 | Kimchi - Sinto Gourmet | *Inhella inkyongensis* |
| SBP00095 | Kimchi - Sinto Gourmet | *Intestinimonas butyriciproducens* |
| SBP00095 | Kimchi - Sinto Gourmet | *Intrasporangium calvum* |
| SBP00095 | Kimchi - Sinto Gourmet | *Janibacter indicus* |
| SBP00095 | Kimchi - Sinto Gourmet | *Janibacter limosus* |
| SBP00095 | Kimchi - Sinto Gourmet | *Janthinobacterium agaricidamnosum* |
| SBP00095 | Kimchi - Sinto Gourmet | *Janthinobacterium* sp. 1_2014MBL_MicDiv |
| SBP00095 | Kimchi - Sinto Gourmet | *Janthinobacterium* sp. 17180-10 |
| SBP00095 | Kimchi - Sinto Gourmet | *Janthinobacterium* sp. B9-8 |
| SBP00095 | Kimchi - Sinto Gourmet | *Janthinobacterium* sp. LM6 |
| SBP00095 | Kimchi - Sinto Gourmet | *Janthinobacterium* sp. Marseille |
| SBP00095 | Kimchi - Sinto Gourmet | *Janthinobacterium svalbardensis* |
| SBP00095 | Kimchi - Sinto Gourmet | *Jatrophihabitans* sp. GAS493 |
| SBP00095 | Kimchi - Sinto Gourmet | *Jeotgalibaca dankookensis* |
| SBP00095 | Kimchi - Sinto Gourmet | *Jeotgalibaca* sp. H21T32 |
| SBP00095 | Kimchi - Sinto Gourmet | *Jeotgalibaca* sp. PTS2502 |
| SBP00095 | Kimchi - Sinto Gourmet | *Jeotgalibacillus malaysiensis* |
| SBP00095 | Kimchi - Sinto Gourmet | *Jeotgalicoccus saudimassiliensis* |
| SBP00095 | Kimchi - Sinto Gourmet | *Kangiella koreensis* |
| SBP00095 | Kimchi - Sinto Gourmet | *Ketobacter alkanivorans* |
| SBP00095 | Kimchi - Sinto Gourmet | *Kibdelosporangium phytohabitans* |
| SBP00095 | Kimchi - Sinto Gourmet | *Kitasatospora* sp. MMS16-BH015 |
| SBP00095 | Kimchi - Sinto Gourmet | *Klebsiella aerogenes* |
| SBP00095 | Kimchi - Sinto Gourmet | *Klebsiella michiganensis* |
| SBP00095 | Kimchi - Sinto Gourmet | *Klebsiella oxytoca* |
| SBP00095 | Kimchi - Sinto Gourmet | *Klebsiella pneumoniae* |
| SBP00095 | Kimchi - Sinto Gourmet | *Klebsiella quasipneumoniae* |
| SBP00095 | Kimchi - Sinto Gourmet | *Klebsiella quasivariicola* |
| SBP00095 | Kimchi - Sinto Gourmet | *Klebsiella* sp. FDAARGOS_511 |
| SBP00095 | Kimchi - Sinto Gourmet | *Klebsiella* sp. LTGPAF-6F |
| SBP00095 | Kimchi - Sinto Gourmet | *Klebsiella* sp. MSal |
| SBP00095 | Kimchi - Sinto Gourmet | *Klebsiella* sp. P1CD1 |
| SBP00095 | Kimchi - Sinto Gourmet | *Klebsiella* sp. WCHKl090001 |
| SBP00095 | Kimchi - Sinto Gourmet | *Klebsiella variicola* |
| SBP00095 | Kimchi - Sinto Gourmet | *Kluyvera intermedia* |
| SBP00095 | Kimchi - Sinto Gourmet | *Kocuria indica* |
| SBP00095 | Kimchi - Sinto Gourmet | *Kocuria palustris* |
| SBP00095 | Kimchi - Sinto Gourmet | *Kocuria rosea* |
| SBP00095 | Kimchi - Sinto Gourmet | *Kocuria turfanensis* |
| SBP00095 | Kimchi - Sinto Gourmet | *Komagataeibacter hansenii* |
| SBP00095 | Kimchi - Sinto Gourmet | *Komagataeibacter nataicola* |
| SBP00095 | Kimchi - Sinto Gourmet | *Komagataeibacter saccharivorans* |
| SBP00095 | Kimchi - Sinto Gourmet | *Kosakonia cowanii* |
| SBP00095 | Kimchi - Sinto Gourmet | *Kosakonia oryzae* |
| SBP00095 | Kimchi - Sinto Gourmet | *Kosakonia radicincitans* |
| SBP00095 | Kimchi - Sinto Gourmet | *Kosakonia sacchari* |
| SBP00095 | Kimchi - Sinto Gourmet | *Kosakonia* sp. CCTCC M2018092 |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Kurthia* sp. 11kri321 |
| SBP00095 | Kimchi - Sinto Gourmet | *Kurthia zopfii* |
| SBP00095 | Kimchi - Sinto Gourmet | *Kushneria marisflavi* |
| SBP00095 | Kimchi - Sinto Gourmet | *Kyrpidia spormannii* |
| SBP00095 | Kimchi - Sinto Gourmet | *Labrenzia* sp. VG12 |
| SBP00095 | Kimchi - Sinto Gourmet | *Laceyella sacchari* |
| SBP00095 | Kimchi - Sinto Gourmet | *Lachnoclostridium phocaeense* |
| SBP00095 | Kimchi - Sinto Gourmet | *Lachnospiraceae bacterium* Choco86 |
| SBP00095 | Kimchi - Sinto Gourmet | *Lactobacillus acetotolerans* |
| SBP00095 | Kimchi - Sinto Gourmet | *Lactobacillus acidipiscis* |
| SBP00095 | Kimchi - Sinto Gourmet | *Lactobacillus acidophilus* |
| SBP00095 | Kimchi - Sinto Gourmet | *Lactobacillus agilis* |
| SBP00095 | Kimchi - Sinto Gourmet | *Lactobacillus alimentarius* |
| SBP00095 | Kimchi - Sinto Gourmet | *Lactobacillus allii* |
| SBP00095 | Kimchi - Sinto Gourmet | *Lactobacillus amylolyticus* |
| SBP00095 | Kimchi - Sinto Gourmet | *Lactobacillus amylophilus* |
| SBP00095 | Kimchi - Sinto Gourmet | *Lactobacillus amylovorus* |
| SBP00095 | Kimchi - Sinto Gourmet | *Lactobacillus animalis* |
| SBP00095 | Kimchi - Sinto Gourmet | *Lactobacillus apis* |
| SBP00095 | Kimchi - Sinto Gourmet | *Lactobacillus backii* |
| SBP00095 | Kimchi - Sinto Gourmet | *Lactobacillus bombi* |
| SBP00095 | Kimchi - Sinto Gourmet | *Lactobacillus brevis* |
| SBP00095 | Kimchi - Sinto Gourmet | *Lactobacillus buchneri* |
| SBP00095 | Kimchi - Sinto Gourmet | *Lactobacillus casei* |
| SBP00095 | Kimchi - Sinto Gourmet | *Lactobacillus coryniformis* |
| SBP00095 | Kimchi - Sinto Gourmet | *Lactobacillus crispatus* |
| SBP00095 | Kimchi - Sinto Gourmet | *Lactobacillus crustorum* |
| SBP00095 | Kimchi - Sinto Gourmet | *Lactobacillus curieae* |
| SBP00095 | Kimchi - Sinto Gourmet | *Lactobacillus curvatus* |
| SBP00095 | Kimchi - Sinto Gourmet | *Lactobacillus delbrueckii* |
| SBP00095 | Kimchi - Sinto Gourmet | *Lactobacillus farciminis* |
| SBP00095 | Kimchi - Sinto Gourmet | *Lactobacillus fermentum* |
| SBP00095 | Kimchi - Sinto Gourmet | *Lactobacillus fuchuensis* |
| SBP00095 | Kimchi - Sinto Gourmet | *Lactobacillus gallinarum* |
| SBP00095 | Kimchi - Sinto Gourmet | *Lactobacillus gasseri* |
| SBP00095 | Kimchi - Sinto Gourmet | *Lactobacillus ginsenosidimutans* |
| SBP00095 | Kimchi - Sinto Gourmet | *Lactobacillus heilongjiangensis* |
| SBP00095 | Kimchi - Sinto Gourmet | *Lactobacillus helsingborgensis* |
| SBP00095 | Kimchi - Sinto Gourmet | *Lactobacillus helveticus* |
| SBP00095 | Kimchi - Sinto Gourmet | *Lactobacillus hokkaidonensis* |
| SBP00095 | Kimchi - Sinto Gourmet | *Lactobacillus hordei* |
| SBP00095 | Kimchi - Sinto Gourmet | *Lactobacillus jensenii* |
| SBP00095 | Kimchi - Sinto Gourmet | *Lactobacillus johnsonii* |
| SBP00095 | Kimchi - Sinto Gourmet | *Lactobacillus kefiranofaciens* |
| SBP00095 | Kimchi - Sinto Gourmet | *Lactobacillus koreensis* |
| SBP00095 | Kimchi - Sinto Gourmet | *Lactobacillus kullabergensis* |
| SBP00095 | Kimchi - Sinto Gourmet | *Lactobacillus kunkeei* |
| SBP00095 | Kimchi - Sinto Gourmet | *Lactobacillus lindneri* |
| SBP00095 | Kimchi - Sinto Gourmet | *Lactobacillus mucosae* |
| SBP00095 | Kimchi - Sinto Gourmet | *Lactobacillus murinus* |
| SBP00095 | Kimchi - Sinto Gourmet | *Lactobacillus oligofermentans* |
| SBP00095 | Kimchi - Sinto Gourmet | *Lactobacillus parabuchneri* |
| SBP00095 | Kimchi - Sinto Gourmet | *Lactobacillus paracasei* |
| SBP00095 | Kimchi - Sinto Gourmet | *Lactobacillus paracollinoides* |
| SBP00095 | Kimchi - Sinto Gourmet | *Lactobacillus paraplantarum* |
| SBP00095 | Kimchi - Sinto Gourmet | *Lactobacillus pentosus* |
| SBP00095 | Kimchi - Sinto Gourmet | *Lactobacillus phage* LBR48 |
| SBP00095 | Kimchi - Sinto Gourmet | *Lactobacillus phage* Lfelnf |
| SBP00095 | Kimchi - Sinto Gourmet | *Lactobacillus phage* Sha1 |
| SBP00095 | Kimchi - Sinto Gourmet | *Lactobacillus plantarum* |
| SBP00095 | Kimchi - Sinto Gourmet | *Lactobacillus reuteri* |
| SBP00095 | Kimchi - Sinto Gourmet | *Lactobacillus rhamnosus* |
| SBP00095 | Kimchi - Sinto Gourmet | *Lactobacillus ruminis* |
| SBP00095 | Kimchi - Sinto Gourmet | *Lactobacillus sakei* |
| SBP00095 | Kimchi - Sinto Gourmet | *Lactobacillus salivarius* |
| SBP00095 | Kimchi - Sinto Gourmet | *Lactobacillus sanfranciscensis* |
| SBP00095 | Kimchi - Sinto Gourmet | *Lactobacillus* sp. BHWM-4 |
| SBP00095 | Kimchi - Sinto Gourmet | *Lactobacillus* sp. C8A3605 |
| SBP00095 | Kimchi - Sinto Gourmet | *Lactobacillus* sp. CBA3606 |
| SBP00095 | Kimchi - Sinto Gourmet | *Lactobacillus* sp. D1501 |
| SBP00095 | Kimchi - Sinto Gourmet | *Lactobacillus* sp. HBUASS2074 |
| SBP00095 | Kimchi - Sinto Gourmet | *Lactobacillus* sp. HSLZ-75 |
| SBP00095 | Kimchi - Sinto Gourmet | *Lactobacillus* sp. wk88 |
| SBP00095 | Kimchi - Sinto Gourmet | *Lactobacillus terrae* |
| SBP00095 | Kimchi - Sinto Gourmet | *Lactobacillus* virus LP65 |
| SBP00095 | Kimchi - Sinto Gourmet | *Lactobacillus* virus phill1 |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Lactobacillus zymae* |
| SBP00095 | Kimchi - Sinto Gourmet | *Lactococcus garvieae* |
| SBP00095 | Kimchi - Sinto Gourmet | *Lactococcus lactis* |
| SBP00095 | Kimchi - Sinto Gourmet | *Lactococcus piscium* |
| SBP00095 | Kimchi - Sinto Gourmet | *Lactococcus raffinolactis* |
| SBP00095 | Kimchi - Sinto Gourmet | *Lactococcus* sp. 1JSPR-7 |
| SBP00095 | Kimchi - Sinto Gourmet | *Lactococcus* virus KSY1 |
| SBP00095 | Kimchi - Sinto Gourmet | *Lawsonella clevelandensis* |
| SBP00095 | Kimchi - Sinto Gourmet | *Leadbetterella byssophila* |
| SBP00095 | Kimchi - Sinto Gourmet | *Leclercia adecarboxylata* |
| SBP00095 | Kimchi - Sinto Gourmet | *Leclercia* sp. LSNIH1 |
| SBP00095 | Kimchi - Sinto Gourmet | *Leclercia* sp. LSNIH3 |
| SBP00095 | Kimchi - Sinto Gourmet | *Legionella anisa* |
| SBP00095 | Kimchi - Sinto Gourmet | *Legionella clemsonensis* |
| SBP00095 | Kimchi - Sinto Gourmet | *Legionella lansingensis* |
| SBP00095 | Kimchi - Sinto Gourmet | *Legionella pneumophila* |
| SBP00095 | Kimchi - Sinto Gourmet | *Legionella sainthelensi* |
| SBP00095 | Kimchi - Sinto Gourmet | *Legionella waltersii* |
| SBP00095 | Kimchi - Sinto Gourmet | *Lelliottia amnigena* |
| SBP00095 | Kimchi - Sinto Gourmet | *Lelliottia jeotgali* |
| SBP00095 | Kimchi - Sinto Gourmet | *Lelliottia* sp. WB101 |
| SBP00095 | Kimchi - Sinto Gourmet | *Leminorella richardii* |
| SBP00095 | Kimchi - Sinto Gourmet | *Lentzea guizhouensis* |
| SBP00095 | Kimchi - Sinto Gourmet | *Leptolyngbya* sp. 0-77 |
| SBP00095 | Kimchi - Sinto Gourmet | *Leptospira biflexa* |
| SBP00095 | Kimchi - Sinto Gourmet | *Leptospira mayottensis* |
| SBP00095 | Kimchi - Sinto Gourmet | *Leptospira santarosai* |
| SBP00095 | Kimchi - Sinto Gourmet | *Leptothrix cholodnii* |
| SBP00095 | Kimchi - Sinto Gourmet | *Leptotrichia* sp. oral taxon 847 |
| SBP00095 | Kimchi - Sinto Gourmet | *Leuconostoc carnosum* |
| SBP00095 | Kimchi - Sinto Gourmet | *Leuconostoc citreum* |
| SBP00095 | Kimchi - Sinto Gourmet | *Leuconostoc garlicum* |
| SBP00095 | Kimchi - Sinto Gourmet | *Leuconostoc gelidum* |
| SBP00095 | Kimchi - Sinto Gourmet | *Leuconostoc kimchii* |
| SBP00095 | Kimchi - Sinto Gourmet | *Leuconostoc lactis* |
| SBP00095 | Kimchi - Sinto Gourmet | *Leuconostoc mesenteroides* |
| SBP00095 | Kimchi - Sinto Gourmet | *Leuconostoc* sp. C2 |
| SBP00095 | Kimchi - Sinto Gourmet | *Leuconostoc suionicum* |
| SBP00095 | Kimchi - Sinto Gourmet | *Leuconostoc* virus 1A4 |
| SBP00095 | Kimchi - Sinto Gourmet | *Leuconostoc* virus LN25 |
| SBP00095 | Kimchi - Sinto Gourmet | *Leuconostoc* virus LN34 |
| SBP00095 | Kimchi - Sinto Gourmet | *Leuconostoc* virus Ln8 |
| SBP00095 | Kimchi - Sinto Gourmet | *Leuconostoc* virus Ln9 |
| SBP00095 | Kimchi - Sinto Gourmet | *Leuconostoc* virus LNTR3 |
| SBP00095 | Kimchi - Sinto Gourmet | *Limnobaculum parvum* |
| SBP00095 | Kimchi - Sinto Gourmet | *Limnohabitans* sp. 63ED37-2 |
| SBP00095 | Kimchi - Sinto Gourmet | *Listeria grayi* |
| SBP00095 | Kimchi - Sinto Gourmet | *Listeria innocua* |
| SBP00095 | Kimchi - Sinto Gourmet | *Listeria ivanovii* |
| SBP00095 | Kimchi - Sinto Gourmet | *Listeria monocytogenes* |
| SBP00095 | Kimchi - Sinto Gourmet | *Listeria seeligeri* |
| SBP00095 | Kimchi - Sinto Gourmet | *Listeria welshimeri* |
| SBP00095 | Kimchi - Sinto Gourmet | *Lonsdalea britannica* |
| SBP00095 | Kimchi - Sinto Gourmet | *Luteibacter rhizovicinus* |
| SBP00095 | Kimchi - Sinto Gourmet | *Luteimonas* sp. JM171 |
| SBP00095 | Kimchi - Sinto Gourmet | *Lutibacter profundi* |
| SBP00095 | Kimchi - Sinto Gourmet | *Lysinibacillus fusiformis* |
| SBP00095 | Kimchi - Sinto Gourmet | *Lysinibacillus* sp. 2017 |
| SBP00095 | Kimchi - Sinto Gourmet | *Lysinibacillus* sp. Marseille-P5727 |
| SBP00095 | Kimchi - Sinto Gourmet | *Lysinibacillus* sp. SGAir0095 |
| SBP00095 | Kimchi - Sinto Gourmet | *Lysinibacillus* sp. YS11 |
| SBP00095 | Kimchi - Sinto Gourmet | *Lysinibacillus sphaericus* |
| SBP00095 | Kimchi - Sinto Gourmet | *Lysobacter antibioticus* |
| SBP00095 | Kimchi - Sinto Gourmet | *Lysobacter enzymogenes* |
| SBP00095 | Kimchi - Sinto Gourmet | *Lysobacter gummosus* |
| SBP00095 | Kimchi - Sinto Gourmet | *Lysobacter* sp. TY2-98 |
| SBP00095 | Kimchi - Sinto Gourmet | *Macrococcus canis* |
| SBP00095 | Kimchi - Sinto Gourmet | *Macrococcus caseolyticus* |
| SBP00095 | Kimchi - Sinto Gourmet | *Macrococcus* sp. IME1552 |
| SBP00095 | Kimchi - Sinto Gourmet | *Mageeibacillus indolicus* |
| SBP00095 | Kimchi - Sinto Gourmet | *Magnetococcus marinus* |
| SBP00095 | Kimchi - Sinto Gourmet | *Magnetospira* sp. QH-2 |
| SBP00095 | Kimchi - Sinto Gourmet | *Magnetospirillum gryphiswaldense* |
| SBP00095 | Kimchi - Sinto Gourmet | *Magnetospirillum* sp. ME-1 |
| SBP00095 | Kimchi - Sinto Gourmet | *Mannheimia haemolytica* |
| SBP00095 | Kimchi - Sinto Gourmet | *Mannheimia varigena* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Maribacter cobaltidurans* |
| SBP00095 | Kimchi - Sinto Gourmet | *Maribacter* sp. 1_2014MBL_MicDiv |
| SBP00095 | Kimchi - Sinto Gourmet | *Maribacter* sp. HTCC2170 |
| SBP00095 | Kimchi - Sinto Gourmet | *Marinifilaceae bacterium* SPP2 |
| SBP00095 | Kimchi - Sinto Gourmet | *Mariniflexile* sp. TRM1-10 |
| SBP00095 | Kimchi - Sinto Gourmet | *Marinilactibacillus* sp. 15R |
| SBP00095 | Kimchi - Sinto Gourmet | *Marinobacter salarius* |
| SBP00095 | Kimchi - Sinto Gourmet | *Marinobacter* sp. LV10R510-11A |
| SBP00095 | Kimchi - Sinto Gourmet | *Marinomonas mediterranea* |
| SBP00095 | Kimchi - Sinto Gourmet | *Marinomonas posidonica* |
| SBP00095 | Kimchi - Sinto Gourmet | *Marinomonas primoryensis* |
| SBP00095 | Kimchi - Sinto Gourmet | *Marinovum algicola* |
| SBP00095 | Kimchi - Sinto Gourmet | *Mariprofundus aestuarium* |
| SBP00095 | Kimchi - Sinto Gourmet | *Maritalea myrionectae* |
| SBP00095 | Kimchi - Sinto Gourmet | *Marivirga tractuosa* |
| SBP00095 | Kimchi - Sinto Gourmet | *Marmoricola scoriae* |
| SBP00095 | Kimchi - Sinto Gourmet | *Martelella endophytica* |
| SBP00095 | Kimchi - Sinto Gourmet | *Martelella mediterranea* |
| SBP00095 | Kimchi - Sinto Gourmet | *Martelella* sp. AD-3 |
| SBP00095 | Kimchi - Sinto Gourmet | *Massilia albidiflava* |
| SBP00095 | Kimchi - Sinto Gourmet | *Massilia armeniaca* |
| SBP00095 | Kimchi - Sinto Gourmet | *Massilia lutea* |
| SBP00095 | Kimchi - Sinto Gourmet | *Massilia oculi* |
| SBP00095 | Kimchi - Sinto Gourmet | *Massilia plicata* |
| SBP00095 | Kimchi - Sinto Gourmet | *Massilia putida* |
| SBP00095 | Kimchi - Sinto Gourmet | *Massilia* sp. NR 4-1 |
| SBP00095 | Kimchi - Sinto Gourmet | *Massilia* sp. WG5 |
| SBP00095 | Kimchi - Sinto Gourmet | *Massilia* sp. YMA4 |
| SBP00095 | Kimchi - Sinto Gourmet | *Massilia umbonata* |
| SBP00095 | Kimchi - Sinto Gourmet | *Massilia violaceinigra* |
| SBP00095 | Kimchi - Sinto Gourmet | *Megamonas hypermegale* |
| SBP00095 | Kimchi - Sinto Gourmet | *Megasphaera elsdenii* |
| SBP00095 | Kimchi - Sinto Gourmet | *Megasphaera hexanoica* |
| SBP00095 | Kimchi - Sinto Gourmet | *Megasphaera stantonii* |
| SBP00095 | Kimchi - Sinto Gourmet | *Melaminivora* sp. SC2-7 |
| SBP00095 | Kimchi - Sinto Gourmet | *Melaminivora* sp. SC2-9 |
| SBP00095 | Kimchi - Sinto Gourmet | *Melissococcus plutonius* |
| SBP00095 | Kimchi - Sinto Gourmet | *Melittangium boletus* |
| SBP00095 | Kimchi - Sinto Gourmet | *Mesoplasma chauliocola* |
| SBP00095 | Kimchi - Sinto Gourmet | *Mesoplasma syrphidae* |
| SBP00095 | Kimchi - Sinto Gourmet | *Mesorhizobium amorphae* |
| SBP00095 | Kimchi - Sinto Gourmet | *Mesorhizobium australicum* |
| SBP00095 | Kimchi - Sinto Gourmet | *Mesorhizobium ciceri* |
| SBP00095 | Kimchi - Sinto Gourmet | *Mesorhizobium japonicum* |
| SBP00095 | Kimchi - Sinto Gourmet | *Mesorhizobium loti* |
| SBP00095 | Kimchi - Sinto Gourmet | *Mesorhizobium oceanicum* |
| SBP00095 | Kimchi - Sinto Gourmet | *Mesorhizobium opportunistum* |
| SBP00095 | Kimchi - Sinto Gourmet | *Mesorhizobium* sp. DCY119 |
| SBP00095 | Kimchi - Sinto Gourmet | *Mesorhizobium* sp. M1B.F.Ca.ET.045.04.1.1 |
| SBP00095 | Kimchi - Sinto Gourmet | *Mesorhizobium* sp. M1D.F.Ca.ET.043.01.1.1 |
| SBP00095 | Kimchi - Sinto Gourmet | *Mesorhizobium* sp. M1E.F.Ca.ET.045.02.1.1 |
| SBP00095 | Kimchi - Sinto Gourmet | *Mesorhizobium* sp. M2A.F.Ca.ET.043.05.1.1 |
| SBP00095 | Kimchi - Sinto Gourmet | *Mesorhizobium* sp. M3A.F.Ca.ET.080.04.2.1 |
| SBP00095 | Kimchi - Sinto Gourmet | *Mesorhizobium* sp. M4B.F.Ca.ET.058.02.1.1 |
| SBP00095 | Kimchi - Sinto Gourmet | *Mesorhizobium* sp. M6A.T.Cr.TU.016.01.1.1 |
| SBP00095 | Kimchi - Sinto Gourmet | *Mesorhizobium* sp. M7A.F.Ce.TU.012.03.2.1 |
| SBP00095 | Kimchi - Sinto Gourmet | *Methanobrevibacter millerae* |
| SBP00095 | Kimchi - Sinto Gourmet | *Methanobrevibacter* sp. AbM4 |
| SBP00095 | Kimchi - Sinto Gourmet | *Methanocorpusculum labreanum* |
| SBP00095 | Kimchi - Sinto Gourmet | *Methanoregula boonei* |
| SBP00095 | Kimchi - Sinto Gourmet | *Methanosaeta harundinacea* |
| SBP00095 | Kimchi - Sinto Gourmet | *Methanosarcina barkeri* |
| SBP00095 | Kimchi - Sinto Gourmet | *Methanosarcina siciliae* |
| SBP00095 | Kimchi - Sinto Gourmet | *Methanosphaera* sp. BMS |
| SBP00095 | Kimchi - Sinto Gourmet | *Methanosphaerula palustris* |
| SBP00095 | Kimchi - Sinto Gourmet | *Methylacidiphilum fumariolicum* |
| SBP00095 | Kimchi - Sinto Gourmet | *Methylibium petroleiphilum* |
| SBP00095 | Kimchi - Sinto Gourmet | *Methylobacterium aquaticum* |
| SBP00095 | Kimchi - Sinto Gourmet | *Methylobacterium brachiatum* |
| SBP00095 | Kimchi - Sinto Gourmet | *Methylobacterium nodulans* |
| SBP00095 | Kimchi - Sinto Gourmet | *Methylobacterium* sp. 17SD2-17 |
| SBP00095 | Kimchi - Sinto Gourmet | *Methylobacterium* sp. 175r1-1 |
| SBP00095 | Kimchi - Sinto Gourmet | *Methylobacterium* sp. 17Sr1-28 |
| SBP00095 | Kimchi - Sinto Gourmet | *Methylobacterium* sp. 175r1-43 |
| SBP00095 | Kimchi - Sinto Gourmet | *Methylobacterium* sp. 4-46 |
| SBP00095 | Kimchi - Sinto Gourmet | *Methylobacterium* sp. AMS5 |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Methylobacterium* sp. DM1 |
| SBP00095 | Kimchi - Sinto Gourmet | *Methylocaldum marinum* |
| SBP00095 | Kimchi - Sinto Gourmet | *Methylomicrobium* sp. wino1 |
| SBP00095 | Kimchi - Sinto Gourmet | *Methylomonas clara* |
| SBP00095 | Kimchi - Sinto Gourmet | *Methylomonas denitrificans* |
| SBP00095 | Kimchi - Sinto Gourmet | *Methylomonas koyamae* |
| SBP00095 | Kimchi - Sinto Gourmet | *Methylomonas methanica* |
| SBP00095 | Kimchi - Sinto Gourmet | *Methylomonas* sp. LW13 |
| SBP00095 | Kimchi - Sinto Gourmet | *Methylomusa anaerophila* |
| SBP00095 | Kimchi - Sinto Gourmet | *Methylophaga nitratireducenticrescens* |
| SBP00095 | Kimchi - Sinto Gourmet | *Methylophilus* sp. TWE2 |
| SBP00095 | Kimchi - Sinto Gourmet | *Methylorubrum extorquens* |
| SBP00095 | Kimchi - Sinto Gourmet | *Methylorubrum populi* |
| SBP00095 | Kimchi - Sinto Gourmet | *Methylotenera mobilis* |
| SBP00095 | Kimchi - Sinto Gourmet | *Methylotenera versatilis* |
| SBP00095 | Kimchi - Sinto Gourmet | *Methylovirgula ligni* |
| SBP00095 | Kimchi - Sinto Gourmet | *Methylovulum psychrotolerans* |
| SBP00095 | Kimchi - Sinto Gourmet | *Micavibrio aeruginosavorus* |
| SBP00095 | Kimchi - Sinto Gourmet | *Microbacterium aurum* |
| SBP00095 | Kimchi - Sinto Gourmet | *Microbacterium chocolatum* |
| SBP00095 | Kimchi - Sinto Gourmet | *Microbacterium foliorum* |
| SBP00095 | Kimchi - Sinto Gourmet | *Microbacterium hominis* |
| SBP00095 | Kimchi - Sinto Gourmet | *Microbacterium lemovicicum* |
| SBP00095 | Kimchi - Sinto Gourmet | *Microbacterium pygmaeum* |
| SBP00095 | Kimchi - Sinto Gourmet | *Microbacterium sediminis* |
| SBP00095 | Kimchi - Sinto Gourmet | *Microbacterium* sp. 1.5R |
| SBP00095 | Kimchi - Sinto Gourmet | *Microbacterium* sp. 10M-3C3 |
| SBP00095 | Kimchi - Sinto Gourmet | *Microbacterium* sp. ABRD_28 |
| SBP00095 | Kimchi - Sinto Gourmet | *Microbacterium* sp. BH-3-3-3 |
| SBP00095 | Kimchi - Sinto Gourmet | *Microbacterium* sp. CGR1 |
| SBP00095 | Kimchi - Sinto Gourmet | *Microbacterium* sp. LKL04 |
| SBP00095 | Kimchi - Sinto Gourmet | *Microbacterium* sp. No. 7 |
| SBP00095 | Kimchi - Sinto Gourmet | *Microbacterium* sp. PAMC 28756 |
| SBP00095 | Kimchi - Sinto Gourmet | *Microbacterium* sp. PM5 |
| SBP00095 | Kimchi - Sinto Gourmet | *Microbacterium* sp. TPU 3598 |
| SBP00095 | Kimchi - Sinto Gourmet | *Microbacterium* sp. Y-01 |
| SBP00095 | Kimchi - Sinto Gourmet | *Microbacterium testaceum* |
| SBP00095 | Kimchi - Sinto Gourmet | *Microbulbifer aggregans* |
| SBP00095 | Kimchi - Sinto Gourmet | *Micrococcus luteus* |
| SBP00095 | Kimchi - Sinto Gourmet | *Microcoleus* sp. PCC 7113 |
| SBP00095 | Kimchi - Sinto Gourmet | *Microcystis panniformis* |
| SBP00095 | Kimchi - Sinto Gourmet | *Microlunatus soli* |
| SBP00095 | Kimchi - Sinto Gourmet | *Micromonospora coriariae* |
| SBP00095 | Kimchi - Sinto Gourmet | *Micromonospora coxensis* |
| SBP00095 | Kimchi - Sinto Gourmet | *Micromonospora echinofusca* |
| SBP00095 | Kimchi - Sinto Gourmet | *Micromonospora rifamycinica* |
| SBP00095 | Kimchi - Sinto Gourmet | *Micropruina glycogenica* |
| SBP00095 | Kimchi - Sinto Gourmet | *Microvirga ossetica* |
| SBP00095 | Kimchi - Sinto Gourmet | Mimivirus terra2 |
| SBP00095 | Kimchi - Sinto Gourmet | *Mitsuaria* sp. 7 |
| SBP00095 | Kimchi - Sinto Gourmet | *Mixta gaviniae* |
| SBP00095 | Kimchi - Sinto Gourmet | *Monoglobus pectinilyticus* |
| SBP00095 | Kimchi - Sinto Gourmet | *Moraxella bovoculi* |
| SBP00095 | Kimchi - Sinto Gourmet | *Moraxella catarrhalis* |
| SBP00095 | Kimchi - Sinto Gourmet | *Moraxella osloensis* |
| SBP00095 | Kimchi - Sinto Gourmet | *Moraxellaceae bacterium* HYN0046 |
| SBP00095 | Kimchi - Sinto Gourmet | *Morganella morganii* |
| SBP00095 | Kimchi - Sinto Gourmet | *Mucilaginibacter gotjawali* |
| SBP00095 | Kimchi - Sinto Gourmet | *Mucilaginibacter mallensis* |
| SBP00095 | Kimchi - Sinto Gourmet | *Mucilaginibacter paludis* |
| SBP00095 | Kimchi - Sinto Gourmet | *Muribaculum intestinale* |
| SBP00095 | Kimchi - Sinto Gourmet | *Muricauda lutaonensis* |
| SBP00095 | Kimchi - Sinto Gourmet | *Mycetocola* sp. 449 |
| SBP00095 | Kimchi - Sinto Gourmet | *Mycobacterium avium* |
| SBP00095 | Kimchi - Sinto Gourmet | *Mycobacterium leprae* |
| SBP00095 | Kimchi - Sinto Gourmet | *Mycobacterium paragordonae* |
| SBP00095 | Kimchi - Sinto Gourmet | *Mycobacterium* sp. djl-10 |
| SBP00095 | Kimchi - Sinto Gourmet | *Mycobacterium* sp. JS623 |
| SBP00095 | Kimchi - Sinto Gourmet | *Mycobacterium* sp. YC-RL4 |
| SBP00095 | Kimchi - Sinto Gourmet | *Mycobacterium* virus Che12 |
| SBP00095 | Kimchi - Sinto Gourmet | *Mycobacteroides abscessus* |
| SBP00095 | Kimchi - Sinto Gourmet | *Mycobacteroides immunogenum* |
| SBP00095 | Kimchi - Sinto Gourmet | *Mycobacteroides salmoniphilum* |
| SBP00095 | Kimchi - Sinto Gourmet | *Mycolicibacterium aurum* |
| SBP00095 | Kimchi - Sinto Gourmet | *Mycolicibacterium chubuense* |
| SBP00095 | Kimchi - Sinto Gourmet | *Mycolicibacterium goodii* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Mycolicibacterium rhodesiae* |
| SBP00095 | Kimchi - Sinto Gourmet | *Mycolicibacterium smegmatis* |
| SBP00095 | Kimchi - Sinto Gourmet | *Mycolicibacterium vaccae* |
| SBP00095 | Kimchi - Sinto Gourmet | *Mycolicibacterium vanbaalenii* |
| SBP00095 | Kimchi - Sinto Gourmet | *Mycoplasma arthritidis* |
| SBP00095 | Kimchi - Sinto Gourmet | *Mycoplasma bovirhinis* |
| SBP00095 | Kimchi - Sinto Gourmet | *Mycoplasma mobile* |
| SBP00095 | Kimchi - Sinto Gourmet | *Mycoplasma mycoides* |
| SBP00095 | Kimchi - Sinto Gourmet | *Mycoplasma neurolyticum* |
| SBP00095 | Kimchi - Sinto Gourmet | *Mycoplasma parvum* |
| SBP00095 | Kimchi - Sinto Gourmet | *Mycoplasma penetrans* |
| SBP00095 | Kimchi - Sinto Gourmet | *Mycoplasma phocicerebrale* |
| SBP00095 | Kimchi - Sinto Gourmet | *Mycoplasma pulmonis* |
| SBP00095 | Kimchi - Sinto Gourmet | *Myroides odoratus* |
| SBP00095 | Kimchi - Sinto Gourmet | *Myroides* sp. ZB35 |
| SBP00095 | Kimchi - Sinto Gourmet | *Myxococcus macrosporus* |
| SBP00095 | Kimchi - Sinto Gourmet | *Natranaerobius thermophilus* |
| SBP00095 | Kimchi - Sinto Gourmet | *Natrialba magadii* |
| SBP00095 | Kimchi - Sinto Gourmet | *Negativicoccus massiliensis* |
| SBP00095 | Kimchi - Sinto Gourmet | *Neisseria animalis* |
| SBP00095 | Kimchi - Sinto Gourmet | *Neisseria cinerea* |
| SBP00095 | Kimchi - Sinto Gourmet | *Neisseria meningitidis* |
| SBP00095 | Kimchi - Sinto Gourmet | *Neisseria polysaccharea* |
| SBP00095 | Kimchi - Sinto Gourmet | *Neisseria sicca* |
| SBP00095 | Kimchi - Sinto Gourmet | *Neisseria* sp. 10022 |
| SBP00095 | Kimchi - Sinto Gourmet | *Neisseria* sp. oral taxon 014 |
| SBP00095 | Kimchi - Sinto Gourmet | *Neoasaia chiangmaiensis* |
| SBP00095 | Kimchi - Sinto Gourmet | *Neomicrococcus aestuarii* |
| SBP00095 | Kimchi - Sinto Gourmet | *Neorhizobium galegae* |
| SBP00095 | Kimchi - Sinto Gourmet | *Neorhizobium* sp. NCHU2750 |
| SBP00095 | Kimchi - Sinto Gourmet | *Neorhizobium* sp. SOG26 |
| SBP00095 | Kimchi - Sinto Gourmet | *Nissabacter* sp. SGAir0207 |
| SBP00095 | Kimchi - Sinto Gourmet | *Nitratireductor basaltis* |
| SBP00095 | Kimchi - Sinto Gourmet | *Nitratireductor* sp. OM-1 |
| SBP00095 | Kimchi - Sinto Gourmet | *Nitrosococcus watsonii* |
| SBP00095 | Kimchi - Sinto Gourmet | *Nitrosomonas communis* |
| SBP00095 | Kimchi - Sinto Gourmet | *Nitrosomonas eutropha* |
| SBP00095 | Kimchi - Sinto Gourmet | *Nitrosomonas* sp. Is79A3 |
| SBP00095 | Kimchi - Sinto Gourmet | *Nitrosospira briensis* |
| SBP00095 | Kimchi - Sinto Gourmet | *Nitrospira defluvii* |
| SBP00095 | Kimchi - Sinto Gourmet | *Niveispirillum cyanobacteriorum* |
| SBP00095 | Kimchi - Sinto Gourmet | *Nocardia asteroides* |
| SBP00095 | Kimchi - Sinto Gourmet | *Nocardia cyriacigeorgica* |
| SBP00095 | Kimchi - Sinto Gourmet | *Nocardia farcinica* |
| SBP00095 | Kimchi - Sinto Gourmet | *Nocardia seriolae* |
| SBP00095 | Kimchi - Sinto Gourmet | *Nocardia* sp. CFHS0054 |
| SBP00095 | Kimchi - Sinto Gourmet | *Nocardia* sp. CS682 |
| SBP00095 | Kimchi - Sinto Gourmet | *Nocardioides baekrokdamisoli* |
| SBP00095 | Kimchi - Sinto Gourmet | *Nocardioides dokdonensis* |
| SBP00095 | Kimchi - Sinto Gourmet | *Nocardioides humi* |
| SBP00095 | Kimchi - Sinto Gourmet | *Nocardioides* sp. 603 |
| SBP00095 | Kimchi - Sinto Gourmet | *Nocardioides* sp. HY056 |
| SBP00095 | Kimchi - Sinto Gourmet | *Nocardioides* sp. JS614 |
| SBP00095 | Kimchi - Sinto Gourmet | *Nodularia spumigena* |
| SBP00095 | Kimchi - Sinto Gourmet | *Nonlabens* sp. MB-3u-79 |
| SBP00095 | Kimchi - Sinto Gourmet | *Nonomuraea* sp. ATCC 55076 |
| SBP00095 | Kimchi - Sinto Gourmet | *Nostoc piscinale* |
| SBP00095 | Kimchi - Sinto Gourmet | *Nostoc punctiforme* |
| SBP00095 | Kimchi - Sinto Gourmet | *Nostoc* sp. NIES-4103 |
| SBP00095 | Kimchi - Sinto Gourmet | *Nostoc* sp. PCC 7524 |
| SBP00095 | Kimchi - Sinto Gourmet | *Novibacillus thermophilus* |
| SBP00095 | Kimchi - Sinto Gourmet | *Novosphingobium aromaticivorans* |
| SBP00095 | Kimchi - Sinto Gourmet | *Novosphingobium pentaromativorans* |
| SBP00095 | Kimchi - Sinto Gourmet | *Novosphingobium resinovorum* |
| SBP00095 | Kimchi - Sinto Gourmet | *Novosphingobium* sp. P6W |
| SBP00095 | Kimchi - Sinto Gourmet | *Novosphingobium* sp. THN1 |
| SBP00095 | Kimchi - Sinto Gourmet | *Obesumbacterium proteus* |
| SBP00095 | Kimchi - Sinto Gourmet | *Oblitimonas alkaliphila* |
| SBP00095 | Kimchi - Sinto Gourmet | *Oceanimonas* sp. GK1 |
| SBP00095 | Kimchi - Sinto Gourmet | *Oceanisphaera profunda* |
| SBP00095 | Kimchi - Sinto Gourmet | *Oceanobacillus iheyensis* |
| SBP00095 | Kimchi - Sinto Gourmet | *Oceanobacillus kimchii* |
| SBP00095 | Kimchi - Sinto Gourmet | *Oceanobacillus* sp. 160 |
| SBP00095 | Kimchi - Sinto Gourmet | *Ochrobactrum anthropi* |
| SBP00095 | Kimchi - Sinto Gourmet | *Ochrobactrum pituitosum* |
| SBP00095 | Kimchi - Sinto Gourmet | *Ochrobactrum pseudogrignonense* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Ochrobactrum* sp. A44 |
| SBP00095 | Kimchi - Sinto Gourmet | *Octadecabacter antarcticus* |
| SBP00095 | Kimchi - Sinto Gourmet | *Octadecabacter arcticus* |
| SBP00095 | Kimchi - Sinto Gourmet | *Octadecabacter temperatus* |
| SBP00095 | Kimchi - Sinto Gourmet | *Odoribacter splanchnicus* |
| SBP00095 | Kimchi - Sinto Gourmet | *Oenococcus kitaharae* |
| SBP00095 | Kimchi - Sinto Gourmet | *Oenococcus oeni* |
| SBP00095 | Kimchi - Sinto Gourmet | *Oenococcus sicerae* |
| SBP00095 | Kimchi - Sinto Gourmet | *Oenococcus* sp. UCMA 16435 |
| SBP00095 | Kimchi - Sinto Gourmet | *Oligotropha carboxidovorans* |
| SBP00095 | Kimchi - Sinto Gourmet | *Olsenella umbonata* |
| SBP00095 | Kimchi - Sinto Gourmet | *Opitutus* sp. GAS368 |
| SBP00095 | Kimchi - Sinto Gourmet | *Opitutus terrae* |
| SBP00095 | Kimchi - Sinto Gourmet | *Orientia tsutsugamushi* |
| SBP00095 | Kimchi - Sinto Gourmet | *Ornithobacterium rhinotracheale* |
| SBP00095 | Kimchi - Sinto Gourmet | *Orpheovirus* IHUMI-LCC2 |
| SBP00095 | Kimchi - Sinto Gourmet | *Orrella dioscoreae* |
| SBP00095 | Kimchi - Sinto Gourmet | *Oscillatoria nigro-viridis* |
| SBP00095 | Kimchi - Sinto Gourmet | *Oscillibacter* sp. PEA192 |
| SBP00095 | Kimchi - Sinto Gourmet | *Ottowia oryzae* |
| SBP00095 | Kimchi - Sinto Gourmet | *Ottowia* sp. oral taxon 894 |
| SBP00095 | Kimchi - Sinto Gourmet | *Paenalcaligenes hominis* |
| SBP00095 | Kimchi - Sinto Gourmet | *Paenarthrobacter aurescens* |
| SBP00095 | Kimchi - Sinto Gourmet | *Paenibacillaceae bacterium* GAS479 |
| SBP00095 | Kimchi - Sinto Gourmet | *Paenibacillus alvei* |
| SBP00095 | Kimchi - Sinto Gourmet | *Paenibacillus baekrokdamisoli* |
| SBP00095 | Kimchi - Sinto Gourmet | *Paenibacillus beijingensis* |
| SBP00095 | Kimchi - Sinto Gourmet | *Paenibacillus borealis* |
| SBP00095 | Kimchi - Sinto Gourmet | *Paenibacillus bovis* |
| SBP00095 | Kimchi - Sinto Gourmet | *Paenibacillus chitinolyticus* |
| SBP00095 | Kimchi - Sinto Gourmet | *Paenibacillus crassostreae* |
| SBP00095 | Kimchi - Sinto Gourmet | *Paenibacillus donghaensis* |
| SBP00095 | Kimchi - Sinto Gourmet | *Paenibacillus durus* |
| SBP00095 | Kimchi - Sinto Gourmet | *Paenibacillus glucanolyticus* |
| SBP00095 | Kimchi - Sinto Gourmet | *Paenibacillus graminis* |
| SBP00095 | Kimchi - Sinto Gourmet | *Paenibacillus kribbensis* |
| SBP00095 | Kimchi - Sinto Gourmet | *Paenibacillus larvae* |
| SBP00095 | Kimchi - Sinto Gourmet | *Paenibacillus lentus* |
| SBP00095 | Kimchi - Sinto Gourmet | *Paenibacillus mucilaginosus* |
| SBP00095 | Kimchi - Sinto Gourmet | *Paenibacillus naphthalenovorans* |
| SBP00095 | Kimchi - Sinto Gourmet | *Paenibacillus odorifer* |
| SBP00095 | Kimchi - Sinto Gourmet | *Paenibacillus physcomitrellae* |
| SBP00095 | Kimchi - Sinto Gourmet | *Paenibacillus polymyxa* |
| SBP00095 | Kimchi - Sinto Gourmet | *Paenibacillus riograndensis* |
| SBP00095 | Kimchi - Sinto Gourmet | *Paenibacillus sabinae* |
| SBP00095 | Kimchi - Sinto Gourmet | *Paenibacillus* sp. 32O-W |
| SBP00095 | Kimchi - Sinto Gourmet | *Paenibacillus* sp. BIHB4019 |
| SBP00095 | Kimchi - Sinto Gourmet | *Paenibacillus* sp. CAA11 |
| SBP00095 | Kimchi - Sinto Gourmet | *Paenibacillus* sp. DCT19 |
| SBP00095 | Kimchi - Sinto Gourmet | *Paenibacillus* sp. FSL H7-0357 |
| SBP00095 | Kimchi - Sinto Gourmet | *Paenibacillus* sp. FSL H7-0737 |
| SBP00095 | Kimchi - Sinto Gourmet | *Paenibacillus* sp. FSL P4-0081 |
| SBP00095 | Kimchi - Sinto Gourmet | *Paenibacillus* sp. FSL R5-0345 |
| SBP00095 | Kimchi - Sinto Gourmet | *Paenibacillus* sp. FSL R5-0912 |
| SBP00095 | Kimchi - Sinto Gourmet | *Paenibacillus* sp. FSL R7-0273 |
| SBP00095 | Kimchi - Sinto Gourmet | *Paenibacillus* sp. FSL R7-0331 |
| SBP00095 | Kimchi - Sinto Gourmet | *Paenibacillus* sp. IHBB 10380 |
| SBP00095 | Kimchi - Sinto Gourmet | *Paenibacillus* sp. JDR-2 |
| SBP00095 | Kimchi - Sinto Gourmet | *Paenibacillus* sp. MBLB1234 |
| SBP00095 | Kimchi - Sinto Gourmet | *Paenibacillus* sp. RUD330 |
| SBP00095 | Kimchi - Sinto Gourmet | *Paenibacillus* sp. Y412MC10 |
| SBP00095 | Kimchi - Sinto Gourmet | *Paenibacillus stellifer* |
| SBP00095 | Kimchi - Sinto Gourmet | *Paenibacillus swuensis* |
| SBP00095 | Kimchi - Sinto Gourmet | *Paenibacillus terrae* |
| SBP00095 | Kimchi - Sinto Gourmet | *Paenibacillus xylanexedens* |
| SBP00095 | Kimchi - Sinto Gourmet | *Paenibacillus yonginensis* |
| SBP00095 | Kimchi - Sinto Gourmet | *Paenisporosarcina antarctica* |
| SBP00095 | Kimchi - Sinto Gourmet | *Paenisporosarcina* sp. K2R23-3 |
| SBP00095 | Kimchi - Sinto Gourmet | *Pajaroellobacter abortibovis* |
| SBP00095 | Kimchi - Sinto Gourmet | *Pandoraea apista* |
| SBP00095 | Kimchi - Sinto Gourmet | *Pandoraea faecigallinarum* |
| SBP00095 | Kimchi - Sinto Gourmet | *Pandoraea norimbergensis* |
| SBP00095 | Kimchi - Sinto Gourmet | *Pandoraea pnomenusa* |
| SBP00095 | Kimchi - Sinto Gourmet | *Pandoraea pulmonicola* |
| SBP00095 | Kimchi - Sinto Gourmet | *Pandoraea sputorum* |
| SBP00095 | Kimchi - Sinto Gourmet | *Pandoraea thiooxydans* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Pannonibacter phragmitetus* |
| SBP00095 | Kimchi - Sinto Gourmet | *Pantoea agglomerans* |
| SBP00095 | Kimchi - Sinto Gourmet | *Pantoea alhagi* |
| SBP00095 | Kimchi - Sinto Gourmet | *Pantoea ananatis* |
| SBP00095 | Kimchi - Sinto Gourmet | *Pantoea rwandensis* |
| SBP00095 | Kimchi - Sinto Gourmet | *Pantoea* sp. At-9b |
| SBP00095 | Kimchi - Sinto Gourmet | *Pantoea* sp. PSNIH1 |
| SBP00095 | Kimchi - Sinto Gourmet | *Pantoea stewartii* |
| SBP00095 | Kimchi - Sinto Gourmet | *Pantoea vagans* |
| SBP00095 | Kimchi - Sinto Gourmet | *Parabacteroides distasonis* |
| SBP00095 | Kimchi - Sinto Gourmet | *Paraburkholderia aromaticivorans* |
| SBP00095 | Kimchi - Sinto Gourmet | *Paraburkholderia caribensis* |
| SBP00095 | Kimchi - Sinto Gourmet | *Paraburkholderia fungorum* |
| SBP00095 | Kimchi - Sinto Gourmet | *Paraburkholderia hospita* |
| SBP00095 | Kimchi - Sinto Gourmet | *Paraburkholderia phenoliruptrix* |
| SBP00095 | Kimchi - Sinto Gourmet | *Paraburkholderia phymatum* |
| SBP00095 | Kimchi - Sinto Gourmet | *Paraburkholderia phytofirmans* |
| SBP00095 | Kimchi - Sinto Gourmet | *Paraburkholderia rhizoxinica* |
| SBP00095 | Kimchi - Sinto Gourmet | *Paraburkholderia* sp. DCR13 |
| SBP00095 | Kimchi - Sinto Gourmet | *Paraburkholderia* sp. SOS3 |
| SBP00095 | Kimchi - Sinto Gourmet | *Paraburkholderia terrae* |
| SBP00095 | Kimchi - Sinto Gourmet | *Paraburkholderia terricola* |
| SBP00095 | Kimchi - Sinto Gourmet | *Paracoccus aminophilus* |
| SBP00095 | Kimchi - Sinto Gourmet | *Paracoccus aminovorans* |
| SBP00095 | Kimchi - Sinto Gourmet | *Paracoccus contaminans* |
| SBP00095 | Kimchi - Sinto Gourmet | *Paracoccus denitrificans* |
| SBP00095 | Kimchi - Sinto Gourmet | *Paracoccus* sp. Arc7-R13 |
| SBP00095 | Kimchi - Sinto Gourmet | *Paracoccus yeei* |
| SBP00095 | Kimchi - Sinto Gourmet | *Paracoccus zhejiangensis* |
| SBP00095 | Kimchi - Sinto Gourmet | *Parageobacillus* genomosp. 1 |
| SBP00095 | Kimchi - Sinto Gourmet | *Paraliobacillus* sp. X-1125 |
| SBP00095 | Kimchi - Sinto Gourmet | *Pararhodospirillum photometricum* |
| SBP00095 | Kimchi - Sinto Gourmet | *Parasaccharibacter apium* |
| SBP00095 | Kimchi - Sinto Gourmet | *Parascardovia denticolens* |
| SBP00095 | Kimchi - Sinto Gourmet | *Parvularcula bermudensis* |
| SBP00095 | Kimchi - Sinto Gourmet | *Pasteurella multocida* |
| SBP00095 | Kimchi - Sinto Gourmet | *Pasteurellaceae bacterium* NI1060 |
| SBP00095 | Kimchi - Sinto Gourmet | *Paucibacter* sp. KCTC 42545 |
| SBP00095 | Kimchi - Sinto Gourmet | *Pectobacterium atrosepticum* |
| SBP00095 | Kimchi - Sinto Gourmet | *Pectobacterium carotovorum* |
| SBP00095 | Kimchi - Sinto Gourmet | *Pectobacterium parmentieri* |
| SBP00095 | Kimchi - Sinto Gourmet | *Pectobacterium polaris* |
| SBP00095 | Kimchi - Sinto Gourmet | *Pectobacterium wasabiae* |
| SBP00095 | Kimchi - Sinto Gourmet | *Pediococcus acidilactici* |
| SBP00095 | Kimchi - Sinto Gourmet | *Pediococcus claussenii* |
| SBP00095 | Kimchi - Sinto Gourmet | *Pediococcus damnosus* |
| SBP00095 | Kimchi - Sinto Gourmet | *Pediococcus inopinatus* |
| SBP00095 | Kimchi - Sinto Gourmet | *Pediococcus pentosaceus* |
| SBP00095 | Kimchi - Sinto Gourmet | *Pedobacter cryoconitis* |
| SBP00095 | Kimchi - Sinto Gourmet | *Pedobacter* sp. G11 |
| SBP00095 | Kimchi - Sinto Gourmet | *Pedobacter steynii* |
| SBP00095 | Kimchi - Sinto Gourmet | *Pelagibaca abyssi* |
| SBP00095 | Kimchi - Sinto Gourmet | *Pelagibacterium halotolerans* |
| SBP00095 | Kimchi - Sinto Gourmet | *Pelobacter carbinolicus* |
| SBP00095 | Kimchi - Sinto Gourmet | *Pelolinea submarina* |
| SBP00095 | Kimchi - Sinto Gourmet | *Pelosinus fermentans* |
| SBP00095 | Kimchi - Sinto Gourmet | *Persicobacter* sp. JZB09 |
| SBP00095 | Kimchi - Sinto Gourmet | *Phaeobacter gallaeciensis* |
| SBP00095 | Kimchi - Sinto Gourmet | *Phaeobacter piscinae* |
| SBP00095 | Kimchi - Sinto Gourmet | *Phenylobacterium zucineum* |
| SBP00095 | Kimchi - Sinto Gourmet | *Photobacterium damselae* |
| SBP00095 | Kimchi - Sinto Gourmet | *Photobacterium gaetbulicola* |
| SBP00095 | Kimchi - Sinto Gourmet | *Photobacterium profundum* |
| SBP00095 | Kimchi - Sinto Gourmet | *Photorhabdus asymbiotica* |
| SBP00095 | Kimchi - Sinto Gourmet | *Photorhabdus laumondii* |
| SBP00095 | Kimchi - Sinto Gourmet | *Photorhabdus thracensis* |
| SBP00095 | Kimchi - Sinto Gourmet | *Phreatobacter cathodiphilus* |
| SBP00095 | Kimchi - Sinto Gourmet | *Phreatobacter stygius* |
| SBP00095 | Kimchi - Sinto Gourmet | *Phycisphaera mikurensis* |
| SBP00095 | Kimchi - Sinto Gourmet | *Phyllobacterium zundukense* |
| SBP00095 | Kimchi - Sinto Gourmet | *Phytobacter* sp. SCO41 |
| SBP00095 | Kimchi - Sinto Gourmet | *Phytobacter ursingii* |
| SBP00095 | Kimchi - Sinto Gourmet | *Pigmentiphaga* sp. H8 |
| SBP00095 | Kimchi - Sinto Gourmet | *Pimelobacter simplex* |
| SBP00095 | Kimchi - Sinto Gourmet | *Planctomyces* sp. SH-PL14 |
| SBP00095 | Kimchi - Sinto Gourmet | *Planococcus antarcticus* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | Planococcus donghaensis |
| SBP00095 | Kimchi - Sinto Gourmet | Planococcus halocryophilus |
| SBP00095 | Kimchi - Sinto Gourmet | Planococcus kocurii |
| SBP00095 | Kimchi - Sinto Gourmet | Planococcus maritimus |
| SBP00095 | Kimchi - Sinto Gourmet | Planococcus plakortidis |
| SBP00095 | Kimchi - Sinto Gourmet | Planococcus rifietoensis |
| SBP00095 | Kimchi - Sinto Gourmet | Planococcus sp. MB-3u-03 |
| SBP00095 | Kimchi - Sinto Gourmet | Planococcus sp. PAMC 21323 |
| SBP00095 | Kimchi - Sinto Gourmet | Planococcus sp. Y42 |
| SBP00095 | Kimchi - Sinto Gourmet | Plantibacter flavus |
| SBP00095 | Kimchi - Sinto Gourmet | Plantibacter sp. |
| SBP00095 | Kimchi - Sinto Gourmet | Plantibacter sp. PA-3-X8 |
| SBP00095 | Kimchi - Sinto Gourmet | Plautia stali |
| SBP00095 | Kimchi - Sinto Gourmet | Plautia stali symbiont |
| SBP00095 | Kimchi - Sinto Gourmet | Pleomorphomonas sp. SM30 |
| SBP00095 | Kimchi - Sinto Gourmet | Plesiomonas shigelloides |
| SBP00095 | Kimchi - Sinto Gourmet | Pluralibacter gergoviae |
| SBP00095 | Kimchi - Sinto Gourmet | Polaribacter vadi |
| SBP00095 | Kimchi - Sinto Gourmet | Polaromonas naphthalenivorans |
| SBP00095 | Kimchi - Sinto Gourmet | Polaromonas sp. JS666 |
| SBP00095 | Kimchi - Sinto Gourmet | Polaromonas sp. SP1 |
| SBP00095 | Kimchi - Sinto Gourmet | Polymorphum gilvum |
| SBP00095 | Kimchi - Sinto Gourmet | Polynucleobacter asymbioticus |
| SBP00095 | Kimchi - Sinto Gourmet | Polynucleobacter duraquae |
| SBP00095 | Kimchi - Sinto Gourmet | Polynucleobacter necessarius |
| SBP00095 | Kimchi - Sinto Gourmet | Polynucleobacter wuianus |
| SBP00095 | Kimchi - Sinto Gourmet | Porphyrobacter neustonensis |
| SBP00095 | Kimchi - Sinto Gourmet | Porphyrobacter sp. CACIAM 03H1 |
| SBP00095 | Kimchi - Sinto Gourmet | Porphyrobacter sp. LM 6 |
| SBP00095 | Kimchi - Sinto Gourmet | Porphyromonas asaccharolytica |
| SBP00095 | Kimchi - Sinto Gourmet | Pragia fontium |
| SBP00095 | Kimchi - Sinto Gourmet | Prevotella jejuni |
| SBP00095 | Kimchi - Sinto Gourmet | Prevotella oris |
| SBP00095 | Kimchi - Sinto Gourmet | Prevotella ruminicola |
| SBP00095 | Kimchi - Sinto Gourmet | Prevotella scopos |
| SBP00095 | Kimchi - Sinto Gourmet | Prochlorococcus marinus |
| SBP00095 | Kimchi - Sinto Gourmet | Propionibacterium australiense |
| SBP00095 | Kimchi - Sinto Gourmet | Propionibacterium freudenreichii |
| SBP00095 | Kimchi - Sinto Gourmet | Proteus hauseri |
| SBP00095 | Kimchi - Sinto Gourmet | Proteus mirabilis |
| SBP00095 | Kimchi - Sinto Gourmet | Proteus vulgaris |
| SBP00095 | Kimchi - Sinto Gourmet | Providencia alcalifaciens |
| SBP00095 | Kimchi - Sinto Gourmet | Providencia heimbachae |
| SBP00095 | Kimchi - Sinto Gourmet | Providencia rettgeri |
| SBP00095 | Kimchi - Sinto Gourmet | Providencia rustigianii |
| SBP00095 | Kimchi - Sinto Gourmet | Providencia sneebia |
| SBP00095 | Kimchi - Sinto Gourmet | Providencia sp. WCHPr000369 |
| SBP00095 | Kimchi - Sinto Gourmet | Providencia stuartii |
| SBP00095 | Kimchi - Sinto Gourmet | Pseudarcicella sp. HME7025 |
| SBP00095 | Kimchi - Sinto Gourmet | Pseudarthrobacter chlorophenolicus |
| SBP00095 | Kimchi - Sinto Gourmet | Pseudarthrobacter equi |
| SBP00095 | Kimchi - Sinto Gourmet | Pseudarthrobacter phenanthrenivorans |
| SBP00095 | Kimchi - Sinto Gourmet | Pseudarthrobacter sulfonivorans |
| SBP00095 | Kimchi - Sinto Gourmet | Pseudoalteromonas donghaensis |
| SBP00095 | Kimchi - Sinto Gourmet | Pseudoalteromonas espejiana |
| SBP00095 | Kimchi - Sinto Gourmet | Pseudoalteromonas haloplanktis |
| SBP00095 | Kimchi - Sinto Gourmet | Pseudoalteromonas luteoviolacea |
| SBP00095 | Kimchi - Sinto Gourmet | Pseudoalteromonas piscicida |
| SBP00095 | Kimchi - Sinto Gourmet | Pseudoalteromonas sp. DL-6 |
| SBP00095 | Kimchi - Sinto Gourmet | Pseudoalteromonas spongiae |
| SBP00095 | Kimchi - Sinto Gourmet | Pseudoalteromonas tunicata |
| SBP00095 | Kimchi - Sinto Gourmet | Pseudoclostridium thermosuccinogenes |
| SBP00095 | Kimchi - Sinto Gourmet | Pseudoflavitalea sp. SGH32-13 |
| SBP00095 | Kimchi - Sinto Gourmet | Pseudolabrys taiwanensis |
| SBP00095 | Kimchi - Sinto Gourmet | Pseudomonas aeruginosa |
| SBP00095 | Kimchi - Sinto Gourmet | Pseudomonas agarici |
| SBP00095 | Kimchi - Sinto Gourmet | Pseudomonas alcaligenes |
| SBP00095 | Kimchi - Sinto Gourmet | Pseudomonas alkylphenolica |
| SBP00095 | Kimchi - Sinto Gourmet | Pseudomonas antarctica |
| SBP00095 | Kimchi - Sinto Gourmet | Pseudomonas arsenicoxydans |
| SBP00095 | Kimchi - Sinto Gourmet | Pseudomonas asplenii |
| SBP00095 | Kimchi - Sinto Gourmet | Pseudomonas azotoformans |
| SBP00095 | Kimchi - Sinto Gourmet | Pseudomonas brassicacearum |
| SBP00095 | Kimchi - Sinto Gourmet | Pseudomonas brenneri |
| SBP00095 | Kimchi - Sinto Gourmet | Pseudomonas cedrina |
| SBP00095 | Kimchi - Sinto Gourmet | Pseudomonas cerasi |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Pseudomonas chlororaphis* |
| SBP00095 | Kimchi - Sinto Gourmet | *Pseudomonas cichorii* |
| SBP00095 | Kimchi - Sinto Gourmet | *Pseudomonas citronellolis* |
| SBP00095 | Kimchi - Sinto Gourmet | *Pseudomonas cremoricolorata* |
| SBP00095 | Kimchi - Sinto Gourmet | *Pseudomonas entomophila* |
| SBP00095 | Kimchi - Sinto Gourmet | *Pseudomonas extremaustralis* |
| SBP00095 | Kimchi - Sinto Gourmet | *Pseudomonas extremorientalis* |
| SBP00095 | Kimchi - Sinto Gourmet | *Pseudomonas fluorescens* |
| SBP00095 | Kimchi - Sinto Gourmet | *Pseudomonas fragi* |
| SBP00095 | Kimchi - Sinto Gourmet | *Pseudomonas frederiksbergensis* |
| SBP00095 | Kimchi - Sinto Gourmet | *Pseudomonas fulva* |
| SBP00095 | Kimchi - Sinto Gourmet | *Pseudomonas furukawaii* |
| SBP00095 | Kimchi - Sinto Gourmet | *Pseudomonas granadensis* |
| SBP00095 | Kimchi - Sinto Gourmet | *Pseudomonas knackmussii* |
| SBP00095 | Kimchi - Sinto Gourmet | *Pseudomonas koreensis* |
| SBP00095 | Kimchi - Sinto Gourmet | *Pseudomonas libanensis* |
| SBP00095 | Kimchi - Sinto Gourmet | *Pseudomonas lini* |
| SBP00095 | Kimchi - Sinto Gourmet | *Pseudomonas litoralis* |
| SBP00095 | Kimchi - Sinto Gourmet | *Pseudomonas lurida* |
| SBP00095 | Kimchi - Sinto Gourmet | *Pseudomonas mandelii* |
| SBP00095 | Kimchi - Sinto Gourmet | *Pseudomonas mediterranea* |
| SBP00095 | Kimchi - Sinto Gourmet | *Pseudomonas mendocina* |
| SBP00095 | Kimchi - Sinto Gourmet | *Pseudomonas monteilii* |
| SBP00095 | Kimchi - Sinto Gourmet | *Pseudomonas moraviensis* |
| SBP00095 | Kimchi - Sinto Gourmet | *Pseudomonas mucidolens* |
| SBP00095 | Kimchi - Sinto Gourmet | *Pseudomonas orientalis* |
| SBP00095 | Kimchi - Sinto Gourmet | *Pseudomonas oryzae* |
| SBP00095 | Kimchi - Sinto Gourmet | *Pseudomonas oryzihabitans* |
| SBP00095 | Kimchi - Sinto Gourmet | *Pseudomonas palleroniana* |
| SBP00095 | Kimchi - Sinto Gourmet | *Pseudomonas parafulva* |
| SBP00095 | Kimchi - Sinto Gourmet | *Pseudomonas phage* OBP |
| SBP00095 | Kimchi - Sinto Gourmet | *Pseudomonas phage* phi15 |
| SBP00095 | Kimchi - Sinto Gourmet | *Pseudomonas phage* tf |
| SBP00095 | Kimchi - Sinto Gourmet | *Pseudomonas phage* VCM |
| SBP00095 | Kimchi - Sinto Gourmet | *Pseudomonas plecoglossicida* |
| SBP00095 | Kimchi - Sinto Gourmet | *Pseudomonas poae* |
| SBP00095 | Kimchi - Sinto Gourmet | *Pseudomonas prosekii* |
| SBP00095 | Kimchi - Sinto Gourmet | *Pseudomonas protegens* |
| SBP00095 | Kimchi - Sinto Gourmet | *Pseudomonas psychrophila* |
| SBP00095 | Kimchi - Sinto Gourmet | *Pseudomonas psychrotolerans* |
| SBP00095 | Kimchi - Sinto Gourmet | *Pseudomonas putida* |
| SBP00095 | Kimchi - Sinto Gourmet | *Pseudomonas reinekei* |
| SBP00095 | Kimchi - Sinto Gourmet | *Pseudomonas rhizosphaerae* |
| SBP00095 | Kimchi - Sinto Gourmet | *Pseudomonas rhodesiae* |
| SBP00095 | Kimchi - Sinto Gourmet | *Pseudomonas sabulinigri* |
| SBP00095 | Kimchi - Sinto Gourmet | *Pseudomonas saudiphocaensis* |
| SBP00095 | Kimchi - Sinto Gourmet | *Pseudomonas simiae* |
| SBP00095 | Kimchi - Sinto Gourmet | *Pseudomonas soli* |
| SBP00095 | Kimchi - Sinto Gourmet | *Pseudomonas* sp. |
| SBP00095 | Kimchi - Sinto Gourmet | *Pseudomonas* sp. 02C 26 |
| SBP00095 | Kimchi - Sinto Gourmet | *Pseudomonas* sp. 31-12 |
| SBP00095 | Kimchi - Sinto Gourmet | *Pseudomonas* sp. 7SR1 |
| SBP00095 | Kimchi - Sinto Gourmet | *Pseudomonas* sp. ATCC 13867 |
| SBP00095 | Kimchi - Sinto Gourmet | *Pseudomonas* sp. B10 |
| SBP00095 | Kimchi - Sinto Gourmet | *Pseudomonas* sp. CC6-YY-74 |
| SBP00095 | Kimchi - Sinto Gourmet | *Pseudomonas* sp. CMR12a |
| SBP00095 | Kimchi - Sinto Gourmet | *Pseudomonas* sp. CMR5c |
| SBP00095 | Kimchi - Sinto Gourmet | *Pseudomonas* sp. DR 5-09 |
| SBP00095 | Kimchi - Sinto Gourmet | *Pseudomonas* sp. DY-1 |
| SBP00095 | Kimchi - Sinto Gourmet | *Pseudomonas* sp, FDAARGOS_380 |
| SBP00095 | Kimchi - Sinto Gourmet | *Pseudomonas* sp. GR 6-02 |
| SBP00095 | Kimchi - Sinto Gourmet | *Pseudomonas* sp. K2W315-8 |
| SBP00095 | Kimchi - Sinto Gourmet | *Pseudomonas* sp. LAB-08 |
| SBP00095 | Kimchi - Sinto Gourmet | *Pseudomonas* sp. LBUM920 |
| SBP00095 | Kimchi - Sinto Gourmet | *Pseudomonas* sp. LG1D9 |
| SBP00095 | Kimchi - Sinto Gourmet | *Pseudomonas* sp. LG1E9 |
| SBP00095 | Kimchi - Sinto Gourmet | *Pseudomonas* sp. LH1G9 |
| SBP00095 | Kimchi - Sinto Gourmet | *Pseudomonas* sp. L24W |
| SBP00095 | Kimchi - Sinto Gourmet | *Pseudomonas* sp. M30-35 |
| SBP00095 | Kimchi - Sinto Gourmet | *Pseudomonas* sp. MYb193 |
| SBP00095 | Kimchi - Sinto Gourmet | *Pseudomonas* sp. NS1(2017) |
| SBP00095 | Kimchi - Sinto Gourmet | *Pseudomonas* sp. R2-7-07 |
| SBP00095 | Kimchi - Sinto Gourmet | *Pseudomonas* sp. R4-35-07 |
| SBP00095 | Kimchi - Sinto Gourmet | *Pseudomonas* sp. R5-89-07 |
| SBP00095 | Kimchi - Sinto Gourmet | *Pseudomonas* sp. S-6-2 |
| SBP00095 | Kimchi - Sinto Gourmet | *Pseudomonas* sp. S09G 359 |

TABLE 3-continued

List of species identified in each metagenomic sample of each SBP Sample

| SBP ID | SBP Host Common Name | Genus sp. |
| --- | --- | --- |
| SBP00095 | Kimchi - Sinto Gourmet | *Pseudomonas* sp. SGAir0191 |
| SBP00095 | Kimchi - Sinto Gourmet | *Pseudomonas* sp. StFLB209 |
| SBP00095 | Kimchi - Sinto Gourmet | *Pseudomonas* sp. SWI36 |
| SBP00095 | Kimchi - Sinto Gourmet | *Pseudomonas* sp. SWI44 |
| SBP00095 | Kimchi - Sinto Gourmet | *Pseudomonas* sp. TCU-HL1 |
| SBP00095 | Kimchi - Sinto Gourmet | *Pseudomonas* sp. TMW 2.1634 |
| SBP00095 | Kimchi - Sinto Gourmet | *Pseudomonas* sp. URMO17WK12:I11 |
| SBP00095 | Kimchi - Sinto Gourmet | *Pseudomonas* sp. UW4 |
| SBP00095 | Kimchi - Sinto Gourmet | *Pseudomonas* sp. XWY-1 |
| SBP00095 | Kimchi - Sinto Gourmet | *Pseudomonas* sp. 2003-0.4C(8344-21) |
| SBP00095 | Kimchi - Sinto Gourmet | *Pseudomonas stutzeri* |
| SBP00095 | Kimchi - Sinto Gourmet | *Pseudomonas synxantha* |
| SBP00095 | Kimchi - Sinto Gourmet | *Pseudomonas syringae* |
| SBP00095 | Kimchi - Sinto Gourmet | *Pseudomonas taetrolens* |
| SBP00095 | Kimchi - Sinto Gourmet | *Pseudomonas thivervalensis* |
| SBP00095 | Kimchi - Sinto Gourmet | *Pseudomonas tolaasii* |
| SBP00095 | Kimchi - Sinto Gourmet | *Pseudomonas trivialis* |
| SBP00095 | Kimchi - Sinto Gourmet | *Pseudomonas umsongensis* |
| SBP00095 | Kimchi - Sinto Gourmet | *Pseudomonas vancouverensis* |
| SBP00095 | Kimchi - Sinto Gourmet | *Pseudomonas veronii* |
| SBP00095 | Kimchi - Sinto Gourmet | *Pseudomonas versuta* |
| SBP00095 | Kimchi - Sinto Gourmet | *Pseudomonas viridiflava* |
| SBP00095 | Kimchi - Sinto Gourmet | *Pseudomonas xanthomarina* |
| SBP00095 | Kimchi - Sinto Gourmet | *Pseudomonas yamanorum* |
| SBP00095 | Kimchi - Sinto Gourmet | *Pseudonocardia autotrophica* |
| SBP00095 | Kimchi - Sinto Gourmet | *Pseudonocardia dioxanivorans* |
| SBP00095 | Kimchi - Sinto Gourmet | *Pseudorhodoplanes sinuspersici* |
| SBP00095 | Kimchi - Sinto Gourmet | *Pseudoxanthomonas spadix* |
| SBP00095 | Kimchi - Sinto Gourmet | *Pseudoxanthomonas suwonensis* |
| SBP00095 | Kimchi - Sinto Gourmet | *Psychrobacter alimentarius* |
| SBP00095 | Kimchi - Sinto Gourmet | *Psychrobacter arcticus* |
| SBP00095 | Kimchi - Sinto Gourmet | *Psychrobacter* sp. DAB_AL43B |
| SBP00095 | Kimchi - Sinto Gourmet | *Psychrobacter* sp. P11G5 |
| SBP00095 | Kimchi - Sinto Gourmet | *Psychrobacter* sp. PRwf-1 |
| SBP00095 | Kimchi - Sinto Gourmet | *Psychroflexus torquis* |
| SBP00095 | Kimchi - Sinto Gourmet | *Psychromonas* sp. CNPT3 |
| SBP00095 | Kimchi - Sinto Gourmet | *Pusillimonas* sp. T7-7 |
| SBP00095 | Kimchi - Sinto Gourmet | *Qipengyuania sediminis* |
| SBP00095 | Kimchi - Sinto Gourmet | *Rahnella aquatilis* |
| SBP00095 | Kimchi - Sinto Gourmet | *Rahnella* sp. ERMR1:05 |
| SBP00095 | Kimchi - Sinto Gourmet | *Rahnella* sp. Y9602 |
| SBP00095 | Kimchi - Sinto Gourmet | *Ralstonia insidiosa* |
| SBP00095 | Kimchi - Sinto Gourmet | *Ralstonia mannitolilytica* |
| SBP00095 | Kimchi - Sinto Gourmet | *Ralstonia pickettii* |
| SBP00095 | Kimchi - Sinto Gourmet | *Ralstonia solanacearum* |
| SBP00095 | Kimchi - Sinto Gourmet | *Ramlibacter tataouinensis* |
| SBP00095 | Kimchi - Sinto Gourmet | *Raoultella ornithinolytica* |
| SBP00095 | Kimchi - Sinto Gourmet | *Raoultella planticola* |
| SBP00095 | Kimchi - Sinto Gourmet | *Raoultella terrigena* |
| SBP00095 | Kimchi - Sinto Gourmet | *Rathayibacter festucae* |
| SBP00095 | Kimchi - Sinto Gourmet | *Rathayibacter iranicus* |
| SBP00095 | Kimchi - Sinto Gourmet | *Rathayibacter rathayi* |
| SBP00095 | Kimchi - Sinto Gourmet | *Rathayibacter tritici* |
| SBP00095 | Kimchi - Sinto Gourmet | *Renibacterium salmoninarum* |
| SBP00095 | Kimchi - Sinto Gourmet | *Rheinheimera* sp. LHK132 |
| SBP00095 | Kimchi - Sinto Gourmet | *Rhizobacter gummiphilus* |
| SBP00095 | Kimchi - Sinto Gourmet | *Rhizobium acidisoli* |
| SBP00095 | Kimchi - Sinto Gourmet | *Rhizobium etli* |
| SBP00095 | Kimchi - Sinto Gourmet | *Rhizobium favelukesii* |
| SBP00095 | Kimchi - Sinto Gourmet | *Rhizobium gallicum* |
| SBP00095 | Kimchi - Sinto Gourmet | *Rhizobium jaguaris* |
| SBP00095 | Kimchi - Sinto Gourmet | *Rhizobium leguminosarum* |
| SBP00095 | Kimchi - Sinto Gourmet | *Rhizobium phaseoli* |
| SBP00095 | Kimchi - Sinto Gourmet | *Rhizobium* sp. 11515TR |
| SBP00095 | Kimchi - Sinto Gourmet | *Rhizobium* sp. ACO-34A |
| SBP00095 | Kimchi - Sinto Gourmet | *Rhizobium* sp. CIAT894 |
| SBP00095 | Kimchi - Sinto Gourmet | *Rhizobium* sp. IE4771 |
| SBP00095 | Kimchi - Sinto Gourmet | *Rhizobium* sp. IRBG74 |
| SBP00095 | Kimchi - Sinto Gourmet | *Rhizobium* sp. Kim5 |
| SBP00095 | Kimchi - Sinto Gourmet | *Rhizobium* sp. NT-26 |
| SBP00095 | Kimchi - Sinto Gourmet | *Rhizobium* sp. NXC14 |
| SBP00095 | Kimchi - Sinto Gourmet | *Rhizobium* sp. NXC24 |
| SBP00095 | Kimchi - Sinto Gourmet | *Rhizobium* sp. S41 |
| SBP00095 | Kimchi - Sinto Gourmet | *Rhizobium* sp. Y9 |
| SBP00095 | Kimchi - Sinto Gourmet | *Rhizobium tropici* |
| SBP00095 | Kimchi - Sinto Gourmet | *Rhizorhabdus dicambivorans* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Rhodobacter blasticus* |
| SBP00095 | Kimchi - Sinto Gourmet | *Rhodobacter capsulatus* |
| SBP00095 | Kimchi - Sinto Gourmet | *Rhodobacter sphaeroides* |
| SBP00095 | Kimchi - Sinto Gourmet | *Rhodobacteraceae bacterium* |
| SBP00095 | Kimchi - Sinto Gourmet | *Rhodobacteraceae bacterium* QY30 |
| SBP00095 | Kimchi - Sinto Gourmet | *Rhodobiaceae bacterium* |
| SBP00095 | Kimchi - Sinto Gourmet | *Rhodococcus fascians* |
| SBP00095 | Kimchi - Sinto Gourmet | *Rhodococcus opacus* |
| SBP00095 | Kimchi - Sinto Gourmet | *Rhodococcus rhodochrous* |
| SBP00095 | Kimchi - Sinto Gourmet | *Rhodococcus ruber* |
| SBP00095 | Kimchi - Sinto Gourmet | *Rhodococcus* sp. PBTS 2 |
| SBP00095 | Kimchi - Sinto Gourmet | *Rhodococcus* sp. X156 |
| SBP00095 | Kimchi - Sinto Gourmet | *Rhodoferax antarcticus* |
| SBP00095 | Kimchi - Sinto Gourmet | *Rhodoferax ferrireducens* |
| SBP00095 | Kimchi - Sinto Gourmet | *Rhodoferax koreense* |
| SBP00095 | Kimchi - Sinto Gourmet | *Rhodoferax saidenbachensis* |
| SBP00095 | Kimchi - Sinto Gourmet | *Rhodoluna lacicola* |
| SBP00095 | Kimchi - Sinto Gourmet | *Rhodomicrobium vannielii* |
| SBP00095 | Kimchi - Sinto Gourmet | *Rhodopirellula baltica* |
| SBP00095 | Kimchi - Sinto Gourmet | *Rhodoplanes* sp. Z2-YC6860 |
| SBP00095 | Kimchi - Sinto Gourmet | *Rhodopseudomonas palustris* |
| SBP00095 | Kimchi - Sinto Gourmet | *Rhodothermus marinus* |
| SBP00095 | Kimchi - Sinto Gourmet | *Rhodovulum* sp. MB263 |
| SBP00095 | Kimchi - Sinto Gourmet | *Rhodovulum* sp. P5 |
| SBP00095 | Kimchi - Sinto Gourmet | *Rickettsia bellii* |
| SBP00095 | Kimchi - Sinto Gourmet | *Rickettsia canadensis* |
| SBP00095 | Kimchi - Sinto Gourmet | *Rickettsiales* endosymbiont of *Stachyamoeba lipophora* |
| SBP00095 | Kimchi - Sinto Gourmet | *Rivularia* sp. PCC 7116 |
| SBP00095 | Kimchi - Sinto Gourmet | *Robiginitalea biformata* |
| SBP00095 | Kimchi - Sinto Gourmet | *Roseateles depolymerans* |
| SBP00095 | Kimchi - Sinto Gourmet | *Roseibacterium elongatum* |
| SBP00095 | Kimchi - Sinto Gourmet | *Roseiflexus castenholzii* |
| SBP00095 | Kimchi - Sinto Gourmet | *Roseitalea porphyridii* |
| SBP00095 | Kimchi - Sinto Gourmet | *Roseobacter denitrificans* |
| SBP00095 | Kimchi - Sinto Gourmet | *Roseobacter litoralis* |
| SBP00095 | Kimchi - Sinto Gourmet | *Roseomonas gilardii* |
| SBP00095 | Kimchi - Sinto Gourmet | *Roseomonas* sp. FDAARGOS_362 |
| SBP00095 | Kimchi - Sinto Gourmet | *Rothia aeria* |
| SBP00095 | Kimchi - Sinto Gourmet | *Rothia dentocariosa* |
| SBP00095 | Kimchi - Sinto Gourmet | *Rubinisphaera brasiliensis* |
| SBP00095 | Kimchi - Sinto Gourmet | *Rubrivivax gelatinosus* |
| SBP00095 | Kimchi - Sinto Gourmet | *Ruegeria* sp. AD91A |
| SBP00095 | Kimchi - Sinto Gourmet | *Ruegeria* sp. NKC1-1 |
| SBP00095 | Kimchi - Sinto Gourmet | *Ruegeria* sp. TM1040 |
| SBP00095 | Kimchi - Sinto Gourmet | *Rufibacter* sp. DG15C |
| SBP00095 | Kimchi - Sinto Gourmet | *Rufibacter tibetensis* |
| SBP00095 | Kimchi - Sinto Gourmet | *Ruminococcus albus* |
| SBP00095 | Kimchi - Sinto Gourmet | *Ruminococcus champanellensis* |
| SBP00095 | Kimchi - Sinto Gourmet | *Saccharomonospora viridis* |
| SBP00095 | Kimchi - Sinto Gourmet | *Saccharophagus degradans* |
| SBP00095 | Kimchi - Sinto Gourmet | *Saccharospirillum mangrovi* |
| SBP00095 | Kimchi - Sinto Gourmet | *Salegentibacter* sp. T436 |
| SBP00095 | Kimchi - Sinto Gourmet | *Salimicrobium jeotgali* |
| SBP00095 | Kimchi - Sinto Gourmet | *Salinicoccus halodurans* |
| SBP00095 | Kimchi - Sinto Gourmet | *Salinimonas* sp. HMF8227 |
| SBP00095 | Kimchi - Sinto Gourmet | *Salinisphaera* sp. LB1 |
| SBP00095 | Kimchi - Sinto Gourmet | *Salinivibrio kushneri* |
| SBP00095 | Kimchi - Sinto Gourmet | *Salmonella bongori* |
| SBP00095 | Kimchi - Sinto Gourmet | *Salmonella enterica* |
| SBP00095 | Kimchi - Sinto Gourmet | *Sandaracinus amylolyticus* |
| SBP00095 | Kimchi - Sinto Gourmet | *Sanguibacter keddieii* |
| SBP00095 | Kimchi - Sinto Gourmet | *Scytonema* sp. HK-05 |
| SBP00095 | Kimchi - Sinto Gourmet | *Scytonema* sp. NIES-4073 |
| SBP00095 | Kimchi - Sinto Gourmet | *Sebaldella termitidis* |
| SBP00095 | Kimchi - Sinto Gourmet | *Sedimentisphaera cyanobacteriorum* |
| SBP00095 | Kimchi - Sinto Gourmet | *Selenomonas ruminantium* |
| SBP00095 | Kimchi - Sinto Gourmet | *Selenomonas sputigena* |
| SBP00095 | Kimchi - Sinto Gourmet | *Seonamhaeicola* sp. S2-3 |
| SBP00095 | Kimchi - Sinto Gourmet | *Serinicoccus chungangensis* |
| SBP00095 | Kimchi - Sinto Gourmet | *Serinicoccus* sp. JLT9 |
| SBP00095 | Kimchi - Sinto Gourmet | *Serpentinomonas mccroryi* |
| SBP00095 | Kimchi - Sinto Gourmet | *Serpentinomonas raichei* |
| SBP00095 | Kimchi - Sinto Gourmet | *Serratia entomophila* |
| SBP00095 | Kimchi - Sinto Gourmet | *Serratia ficaria* |
| SBP00095 | Kimchi - Sinto Gourmet | *Serratia fonticola* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Serratia liquefaciens* |
| SBP00095 | Kimchi - Sinto Gourmet | *Serratia marcescens* |
| SBP00095 | Kimchi - Sinto Gourmet | *Serratia odorifera* |
| SBP00095 | Kimchi - Sinto Gourmet | *Serratia plymuthica* |
| SBP00095 | Kimchi - Sinto Gourmet | *Serratia proteamaculans* |
| SBP00095 | Kimchi - Sinto Gourmet | *Serratia quinivorans* |
| SBP00095 | Kimchi - Sinto Gourmet | *Serratia rubidaea* |
| SBP00095 | Kimchi - Sinto Gourmet | *Serratia* sp. |
| SBP00095 | Kimchi - Sinto Gourmet | *Serratia* sp. 1D1416 |
| SBP00095 | Kimchi - Sinto Gourmet | *Serratia* sp. 3ACOL1 |
| SBP00095 | Kimchi - Sinto Gourmet | *Serratia* sp. ATCC 39006 |
| SBP00095 | Kimchi - Sinto Gourmet | *Serratia* sp. FDAARGOS_506 |
| SBP00095 | Kimchi - Sinto Gourmet | *Serratia* sp. FGI94 |
| SBP00095 | Kimchi - Sinto Gourmet | *Serratia* sp. FS14 |
| SBP00095 | Kimchi - Sinto Gourmet | *Serratia* sp. JKS000199 |
| SBP00095 | Kimchi - Sinto Gourmet | *Serratia* sp. MYb239 |
| SBP00095 | Kimchi - Sinto Gourmet | *Serratia* sp. P2ACOL2 |
| SBP00095 | Kimchi - Sinto Gourmet | *Serratia* sp. YD25 |
| SBP00095 | Kimchi - Sinto Gourmet | *Shewanella algae* |
| SBP00095 | Kimchi - Sinto Gourmet | *Shewanella amazonensis* |
| SBP00095 | Kimchi - Sinto Gourmet | *Shewanella loihica* |
| SBP00095 | Kimchi - Sinto Gourmet | *Shewanella pealeana* |
| SBP00095 | Kimchi - Sinto Gourmet | *Shewanella piezotolerans* |
| SBP00095 | Kimchi - Sinto Gourmet | *Shewanella putrefaciens* |
| SBP00095 | Kimchi - Sinto Gourmet | *Shewanella sediminis* |
| SBP00095 | Kimchi - Sinto Gourmet | *Shewanella* sp. FDAARGOS_354 |
| SBP00095 | Kimchi - Sinto Gourmet | *Shewanella* sp. TH2012 |
| SBP00095 | Kimchi - Sinto Gourmet | *Shewanella woodyi* |
| SBP00095 | Kimchi - Sinto Gourmet | *Shigella flexneri* |
| SBP00095 | Kimchi - Sinto Gourmet | *Shimwellia blattae* |
| SBP00095 | Kimchi - Sinto Gourmet | *Shinella* sp. HZN7 |
| SBP00095 | Kimchi - Sinto Gourmet | *Silicimonas algicola* |
| SBP00095 | Kimchi - Sinto Gourmet | *Simonsiella muelleri* |
| SBP00095 | Kimchi - Sinto Gourmet | *Simplicispira suum* |
| SBP00095 | Kimchi - Sinto Gourmet | *Singulisphaera acidiphila* |
| SBP00095 | Kimchi - Sinto Gourmet | *Sinomonas atrocyanea* |
| SBP00095 | Kimchi - Sinto Gourmet | *Sinorhizobium americanum* |
| SBP00095 | Kimchi - Sinto Gourmet | *Sinorhizobium fredii* |
| SBP00095 | Kimchi - Sinto Gourmet | *Sinorhizobium medicae* |
| SBP00095 | Kimchi - Sinto Gourmet | *Sinorhizobium meliloti* |
| SBP00095 | Kimchi - Sinto Gourmet | *Sinorhizobium* sp. CCBAU 05631 |
| SBP00095 | Kimchi - Sinto Gourmet | *Sinorhizobium* sp. RAC02 |
| SBP00095 | Kimchi - Sinto Gourmet | *Slackia heliotrinireducens* |
| SBP00095 | Kimchi - Sinto Gourmet | *Snodgrassella alvi* |
| SBP00095 | Kimchi - Sinto Gourmet | *Sodalis glossinidius* |
| SBP00095 | Kimchi - Sinto Gourmet | *Sodalis praecaptivus* |
| SBP00095 | Kimchi - Sinto Gourmet | *Solibacillus silvestris* |
| SBP00095 | Kimchi - Sinto Gourmet | *Solibacillus* sp. R5-41 |
| SBP00095 | Kimchi - Sinto Gourmet | *Solimonas* sp. K1W228-7 |
| SBP00095 | Kimchi - Sinto Gourmet | *Solitalea canadensis* |
| SBP00095 | Kimchi - Sinto Gourmet | *Sorangium cellulosum* |
| SBP00095 | Kimchi - Sinto Gourmet | *Sphaerochaeta coccoides* |
| SBP00095 | Kimchi - Sinto Gourmet | *Sphaerochaeta pleomorpha* |
| SBP00095 | Kimchi - Sinto Gourmet | *Sphaerospermopsis kisseleviana* |
| SBP00095 | Kimchi - Sinto Gourmet | *Sphingobacteriaceae bacterium* GW460-11-11-14-LB5 |
| SBP00095 | Kimchi - Sinto Gourmet | *Sphingobacterium daejeonense* |
| SBP00095 | Kimchi - Sinto Gourmet | *Sphingobacterium* sp. 21 |
| SBP00095 | Kimchi - Sinto Gourmet | *Sphingobacterium* sp. B29 |
| SBP00095 | Kimchi - Sinto Gourmet | *Sphingobacterium* sp. G1-14 |
| SBP00095 | Kimchi - Sinto Gourmet | *Sphingobacterium* sp. ML3W |
| SBP00095 | Kimchi - Sinto Gourmet | *Sphingobacterium thalpophilum* |
| SBP00095 | Kimchi - Sinto Gourmet | *Sphingobium amiense* |
| SBP00095 | Kimchi - Sinto Gourmet | *Sphingobium baderi* |
| SBP00095 | Kimchi - Sinto Gourmet | *Sphingobium chlorophenolicum* |
| SBP00095 | Kimchi - Sinto Gourmet | *Sphingobium cloacae* |
| SBP00095 | Kimchi - Sinto Gourmet | *Sphingobium fuliginis* |
| SBP00095 | Kimchi - Sinto Gourmet | *Sphingobium herbicidovorans* |
| SBP00095 | Kimchi - Sinto Gourmet | *Sphingobium hydrophobicum* |
| SBP00095 | Kimchi - Sinto Gourmet | *Sphingobium indicum* |
| SBP00095 | Kimchi - Sinto Gourmet | *Sphingobium japonicum* |
| SBP00095 | Kimchi - Sinto Gourmet | *Sphingobium* sp. EP60837 |
| SBP00095 | Kimchi - Sinto Gourmet | *Sphingobium* sp. MI1205 |
| SBP00095 | Kimchi - Sinto Gourmet | *Sphingobium* sp. RAC03 |
| SBP00095 | Kimchi - Sinto Gourmet | *Sphingobium* sp. SCG-1 |
| SBP00095 | Kimchi - Sinto Gourmet | *Sphingobium* sp. SYK-6 |
| SBP00095 | Kimchi - Sinto Gourmet | *Sphingobium* sp. TKS |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Sphingobium* sp. YBL2 |
| SBP00095 | Kimchi - Sinto Gourmet | *Sphingobium* sp. YG1 |
| SBP00095 | Kimchi - Sinto Gourmet | *Sphingobium yanoikuyae* |
| SBP00095 | Kimchi - Sinto Gourmet | *Sphingomonas indica* |
| SBP00095 | Kimchi - Sinto Gourmet | *Sphingomonas koreensis* |
| SBP00095 | Kimchi - Sinto Gourmet | *Sphingomonas melonis* |
| SBP00095 | Kimchi - Sinto Gourmet | *Sphingomonas panacis* |
| SBP00095 | Kimchi - Sinto Gourmet | *Sphingomonas paucimobilis* |
| SBP00095 | Kimchi - Sinto Gourmet | *Sphingomonas sanxanigenens* |
| SBP00095 | Kimchi - Sinto Gourmet | *Sphingomonas* sp. AAP5 |
| SBP00095 | Kimchi - Sinto Gourmet | *Sphingomonas* sp. C8-2 |
| SBP00095 | Kimchi - Sinto Gourmet | *Sphingomonas* sp. Cra20 |
| SBP00095 | Kimchi - Sinto Gourmet | *Sphingomonas* sp. FARSPH |
| SBP00095 | Kimchi - Sinto Gourmet | *Sphingomonas* sp. JJ-A5 |
| SBP00095 | Kimchi - Sinto Gourmet | *Sphingomonas* sp. KC8 |
| SBP00095 | Kimchi - Sinto Gourmet | *Sphingomonas* sp. LK11 |
| SBP00095 | Kimchi - Sinto Gourmet | *Sphingomonas* sp. LM7 |
| SBP00095 | Kimchi - Sinto Gourmet | *Sphingomonas* sp. MM-1 |
| SBP00095 | Kimchi - Sinto Gourmet | *Sphingomonas* sp. NIC1 |
| SBP00095 | Kimchi - Sinto Gourmet | *Sphingomonas* sp. YZ-8 |
| SBP00095 | Kimchi - Sinto Gourmet | *Sphingomonas taxi* |
| SBP00095 | Kimchi - Sinto Gourmet | *Sphingomonas wittichii* |
| SBP00095 | Kimchi - Sinto Gourmet | *Sphingopyxis alaskensis* |
| SBP00095 | Kimchi - Sinto Gourmet | *Sphingopyxis fribergensis* |
| SBP00095 | Kimchi - Sinto Gourmet | *Sphingopyxis granuli* |
| SBP00095 | Kimchi - Sinto Gourmet | *Sphingopyxis macrogoltabida* |
| SBP00095 | Kimchi - Sinto Gourmet | *Sphingopyxis* sp. 113P3 |
| SBP00095 | Kimchi - Sinto Gourmet | *Sphingopyxis* sp. EG6 |
| SBP00095 | Kimchi - Sinto Gourmet | *Sphingopyxis* sp. FD7 |
| SBP00095 | Kimchi - Sinto Gourmet | *Sphingopyxis* sp. QXT-31 |
| SBP00095 | Kimchi - Sinto Gourmet | *Sphingopyxis* sp. WSSA3p |
| SBP00095 | Kimchi - Sinto Gourmet | *Sphingorhabdus* sp. M41 |
| SBP00095 | Kimchi - Sinto Gourmet | *Sphingorhabdus* sp. YGSMI21 |
| SBP00095 | Kimchi - Sinto Gourmet | *Sphingosinicella microcystinivorans* |
| SBP00095 | Kimchi - Sinto Gourmet | *Sphingosinicella* sp. BN140058 |
| SBP00095 | Kimchi - Sinto Gourmet | *Spiribacter curvatus* |
| SBP00095 | Kimchi - Sinto Gourmet | *Spirochaeta africana* |
| SBP00095 | Kimchi - Sinto Gourmet | *Spiroplasma alleghenense* |
| SBP00095 | Kimchi - Sinto Gourmet | *Spiroplasma chrysopicola* |
| SBP00095 | Kimchi - Sinto Gourmet | *Spiroplasma clarkii* |
| SBP00095 | Kimchi - Sinto Gourmet | *Spiroplasma culicicola* |
| SBP00095 | Kimchi - Sinto Gourmet | *Spiroplasma syrphidicola* |
| SBP00095 | Kimchi - Sinto Gourmet | *Spiroplasma taiwanense* |
| SBP00095 | Kimchi - Sinto Gourmet | *Spirosoma aerolatum* |
| SBP00095 | Kimchi - Sinto Gourmet | *Spirosoma pollinicola* |
| SBP00095 | Kimchi - Sinto Gourmet | *Spirosoma radiotolerans* |
| SBP00095 | Kimchi - Sinto Gourmet | *Sporolactobacillus terrae* |
| SBP00095 | Kimchi - Sinto Gourmet | *Sporosarcina pasteurii* |
| SBP00095 | Kimchi - Sinto Gourmet | *Sporosarcina psychrophila* |
| SBP00095 | Kimchi - Sinto Gourmet | *Sporosarcina* sp. PTS2304 |
| SBP00095 | Kimchi - Sinto Gourmet | *Sporosarcina ureae* |
| SBP00095 | Kimchi - Sinto Gourmet | *Stackebrandtia nassauensis* |
| SBP00095 | Kimchi - Sinto Gourmet | *Stanieria cyanosphaera* |
| SBP00095 | Kimchi - Sinto Gourmet | *Staphylococcus agnetis* |
| SBP00095 | Kimchi - Sinto Gourmet | *Staphylococcus argenteus* |
| SBP00095 | Kimchi - Sinto Gourmet | *Staphylococcus arlettae* |
| SBP00095 | Kimchi - Sinto Gourmet | *Staphylococcus aureus* |
| SBP00095 | Kimchi - Sinto Gourmet | *Staphylococcus capitis* |
| SBP00095 | Kimchi - Sinto Gourmet | *Staphylococcus caprae* |
| SBP00095 | Kimchi - Sinto Gourmet | *Staphylococcus carnosus* |
| SBP00095 | Kimchi - Sinto Gourmet | *Staphylococcus cohnii* |
| SBP00095 | Kimchi - Sinto Gourmet | *Staphylococcus condimenti* |
| SBP00095 | Kimchi - Sinto Gourmet | *Staphylococcus epidermidis* |
| SBP00095 | Kimchi - Sinto Gourmet | *Staphylococcus equorum* |
| SBP00095 | Kimchi - Sinto Gourmet | *Staphylococcus felis* |
| SBP00095 | Kimchi - Sinto Gourmet | *Staphylococcus haemolyticus* |
| SBP00095 | Kimchi - Sinto Gourmet | *Staphylococcus hominis* |
| SBP00095 | Kimchi - Sinto Gourmet | *Staphylococcus hyicus* |
| SBP00095 | Kimchi - Sinto Gourmet | *Staphylococcus kloosii* |
| SBP00095 | Kimchi - Sinto Gourmet | *Staphylococcus lugdunensis* |
| SBP00095 | Kimchi - Sinto Gourmet | *Staphylococcus lutrae* |
| SBP00095 | Kimchi - Sinto Gourmet | *Staphylococcus muscae* |
| SBP00095 | Kimchi - Sinto Gourmet | *Staphylococcus nepalensis* |
| SBP00095 | Kimchi - Sinto Gourmet | *Staphylococcus pasteuri* |
| SBP00095 | Kimchi - Sinto Gourmet | *Staphylococcus pettenkoferi* |
| SBP00095 | Kimchi - Sinto Gourmet | *Staphylococcus piscifermentans* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | Staphylococcus saprophyticus |
| SBP00095 | Kimchi - Sinto Gourmet | Staphylococcus schleiferi |
| SBP00095 | Kimchi - Sinto Gourmet | Staphylococcus sciuri |
| SBP00095 | Kimchi - Sinto Gourmet | Staphylococcus simiae |
| SBP00095 | Kimchi - Sinto Gourmet | Staphylococcus simulans |
| SBP00095 | Kimchi - Sinto Gourmet | Staphylococcus sp. SDB 2975 |
| SBP00095 | Kimchi - Sinto Gourmet | Staphylococcus stepanovicii |
| SBP00095 | Kimchi - Sinto Gourmet | Staphylococcus succinus |
| SBP00095 | Kimchi - Sinto Gourmet | Staphylococcus warneri |
| SBP00095 | Kimchi - Sinto Gourmet | Staphylococcus xylosus |
| SBP00095 | Kimchi - Sinto Gourmet | Stappia sp. ES.058 |
| SBP00095 | Kimchi - Sinto Gourmet | Starkeya novella |
| SBP00095 | Kimchi - Sinto Gourmet | Stella humosa |
| SBP00095 | Kimchi - Sinto Gourmet | Stella vacuolata |
| SBP00095 | Kimchi - Sinto Gourmet | Stenotrophomonas acidaminiphila |
| SBP00095 | Kimchi - Sinto Gourmet | Stenotrophomonas maltophilia |
| SBP00095 | Kimchi - Sinto Gourmet | Stenotrophomonas rhizophila |
| SBP00095 | Kimchi - Sinto Gourmet | Stenotrophomonas sp. |
| SBP00095 | Kimchi - Sinto Gourmet | Stenotrophomonas sp. ESTM1D_MKCIP4_1 |
| SBP00095 | Kimchi - Sinto Gourmet | Stenotrophomonas sp. G4 |
| SBP00095 | Kimchi - Sinto Gourmet | Stenotrophomonas sp. LM091 |
| SBP00095 | Kimchi - Sinto Gourmet | Stenotrophomonas sp. MYb57 |
| SBP00095 | Kimchi - Sinto Gourmet | Stenotrophomonas sp. Pemsol |
| SBP00095 | Kimchi - Sinto Gourmet | Stenotrophomonas sp. SAU14A_NAIMI4_5 |
| SBP00095 | Kimchi - Sinto Gourmet | Stenotrophomonas sp. WZN-1 |
| SBP00095 | Kimchi - Sinto Gourmet | Stenotrophomonas sp. ZAC14A_NAIMI4_1 |
| SBP00095 | Kimchi - Sinto Gourmet | Stenotrophomonas sp. ZAC14D2_NAIMI4_7 |
| SBP00095 | Kimchi - Sinto Gourmet | Sterolibacteriaceae bacterium J5B |
| SBP00095 | Kimchi - Sinto Gourmet | Streptobacillus moniliformis |
| SBP00095 | Kimchi - Sinto Gourmet | Streptococcus acidominimus |
| SBP00095 | Kimchi - Sinto Gourmet | Streptococcus agalactiae |
| SBP00095 | Kimchi - Sinto Gourmet | Streptococcus anginosus |
| SBP00095 | Kimchi - Sinto Gourmet | Streptococcus australis |
| SBP00095 | Kimchi - Sinto Gourmet | Streptococcus canis |
| SBP00095 | Kimchi - Sinto Gourmet | Streptococcus cristatus |
| SBP00095 | Kimchi - Sinto Gourmet | Streptococcus dysgalactiae |
| SBP00095 | Kimchi - Sinto Gourmet | Streptococcus equi |
| SBP00095 | Kimchi - Sinto Gourmet | Streptococcus equinus |
| SBP00095 | Kimchi - Sinto Gourmet | Streptococcus ferus |
| SBP00095 | Kimchi - Sinto Gourmet | Streptococcus gallolyticus |
| SBP00095 | Kimchi - Sinto Gourmet | Streptococcus gordonii |
| SBP00095 | Kimchi - Sinto Gourmet | Streptococcus halotolerans |
| SBP00095 | Kimchi - Sinto Gourmet | Streptococcus himalayensis |
| SBP00095 | Kimchi - Sinto Gourmet | Streptococcus infantarius |
| SBP00095 | Kimchi - Sinto Gourmet | Streptococcus iniae |
| SBP00095 | Kimchi - Sinto Gourmet | Streptococcus intermedius |
| SBP00095 | Kimchi - Sinto Gourmet | Streptococcus macedonicus |
| SBP00095 | Kimchi - Sinto Gourmet | Streptococcus marmotae |
| SBP00095 | Kimchi - Sinto Gourmet | Streptococcus merionis |
| SBP00095 | Kimchi - Sinto Gourmet | Streptococcus milleri |
| SBP00095 | Kimchi - Sinto Gourmet | Streptococcus mitis |
| SBP00095 | Kimchi - Sinto Gourmet | Streptococcus mutans |
| SBP00095 | Kimchi - Sinto Gourmet | Streptococcus oralis |
| SBP00095 | Kimchi - Sinto Gourmet | Streptococcus pantholopis |
| SBP00095 | Kimchi - Sinto Gourmet | Streptococcus parasanguinis |
| SBP00095 | Kimchi - Sinto Gourmet | Streptococcus parauberis |
| SBP00095 | Kimchi - Sinto Gourmet | Streptococcus pasteurianus |
| SBP00095 | Kimchi - Sinto Gourmet | Streptococcus pluranimalium |
| SBP00095 | Kimchi - Sinto Gourmet | Streptococcus pneumoniae |
| SBP00095 | Kimchi - Sinto Gourmet | Streptococcus porcinus |
| SBP00095 | Kimchi - Sinto Gourmet | Streptococcus pseudopneumoniae |
| SBP00095 | Kimchi - Sinto Gourmet | Streptococcus pyogenes |
| SBP00095 | Kimchi - Sinto Gourmet | Streptococcus respiraculi |
| SBP00095 | Kimchi - Sinto Gourmet | Streptococcus ruminantium |
| SBP00095 | Kimchi - Sinto Gourmet | Streptococcus salivarius |
| SBP00095 | Kimchi - Sinto Gourmet | Streptococcus sanguinis |
| SBP00095 | Kimchi - Sinto Gourmet | Streptococcus sobrinus |
| SBP00095 | Kimchi - Sinto Gourmet | Streptococcus sp. A12 |
| SBP00095 | Kimchi - Sinto Gourmet | Streptococcus sp. FDAARGOS_192 |
| SBP00095 | Kimchi - Sinto Gourmet | Streptococcus sp. HSISB1 |
| SBP00095 | Kimchi - Sinto Gourmet | Streptococcus sp. HSISM1 |
| SBP00095 | Kimchi - Sinto Gourmet | Streptococcus sp. HSISS2 |
| SBP00095 | Kimchi - Sinto Gourmet | Streptococcus sp. HSISS3 |
| SBP00095 | Kimchi - Sinto Gourmet | Streptococcus sp. I-G2 |
| SBP00095 | Kimchi - Sinto Gourmet | Streptococcus sp. J-P16 |
| SBP00095 | Kimchi - Sinto Gourmet | Streptococcus sp. KCOM 2412 |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Streptococcus* sp. NPS 308 |
| SBP00095 | Kimchi - Sinto Gourmet | *Streptococcus* sp. oral taxon 064 |
| SBP00095 | Kimchi - Sinto Gourmet | *Streptococcus* sp. oral taxon 431 |
| SBP00095 | Kimchi - Sinto Gourmet | *Streptococcus* sp. Z15 |
| SBP00095 | Kimchi - Sinto Gourmet | *Streptococcus suis* |
| SBP00095 | Kimchi - Sinto Gourmet | *Streptococcus thermophilus* |
| SBP00095 | Kimchi - Sinto Gourmet | *Streptococcus troglodytae* |
| SBP00095 | Kimchi - Sinto Gourmet | *Streptococcus uberis* |
| SBP00095 | Kimchi - Sinto Gourmet | *Streptococcus urinalis* |
| SBP00095 | Kimchi - Sinto Gourmet | *Streptococcus vestibularis* |
| SBP00095 | Kimchi - Sinto Gourmet | *Streptococcus viridans* |
| SBP00095 | Kimchi - Sinto Gourmet | *Streptococcus* virus 7201 |
| SBP00095 | Kimchi - Sinto Gourmet | *Streptomyces albus* |
| SBP00095 | Kimchi - Sinto Gourmet | *Streptomyces bingchenggensis* |
| SBP00095 | Kimchi - Sinto Gourmet | *Streptomyces cattleya* |
| SBP00095 | Kimchi - Sinto Gourmet | *Streptomyces clavuligerus* |
| SBP00095 | Kimchi - Sinto Gourmet | *Streptomyces globisporus* |
| SBP00095 | Kimchi - Sinto Gourmet | *Streptomyces luteoverticillatus* |
| SBP00095 | Kimchi - Sinto Gourmet | *Streptomyces lydicus* |
| SBP00095 | Kimchi - Sinto Gourmet | *Streptomyces nigra* |
| SBP00095 | Kimchi - Sinto Gourmet | *Streptomyces niveus* |
| SBP00095 | Kimchi - Sinto Gourmet | *Streptomyces pactum* |
| SBP00095 | Kimchi - Sinto Gourmet | *Streptomyces rimosus* |
| SBP00095 | Kimchi - Sinto Gourmet | *Streptomyces roseochromogenus* |
| SBP00095 | Kimchi - Sinto Gourmet | *Streptomyces scabiei* |
| SBP00095 | Kimchi - Sinto Gourmet | *Streptomyces* sp. CCM_MD2014 |
| SBP00095 | Kimchi - Sinto Gourmet | *Streptomyces* sp. CdTB01 |
| SBP00095 | Kimchi - Sinto Gourmet | *Streptomyces* sp. fd1-xmd |
| SBP00095 | Kimchi - Sinto Gourmet | *Streptomyces* sp. M2 |
| SBP00095 | Kimchi - Sinto Gourmet | *Streptomyces* sp. Mg1 |
| SBP00095 | Kimchi - Sinto Gourmet | *Streptomyces* sp. MK45 |
| SBP00095 | Kimchi - Sinto Gourmet | *Streptomyces* sp. TLI_053 |
| SBP00095 | Kimchi - Sinto Gourmet | *Streptomyces* sp. TN58 |
| SBP00095 | Kimchi - Sinto Gourmet | *Streptomyces* sp. WAC00288 |
| SBP00095 | Kimchi - Sinto Gourmet | *Streptomyces violaceusniger* |
| SBP00095 | Kimchi - Sinto Gourmet | *Streptosporangium roseum* |
| SBP00095 | Kimchi - Sinto Gourmet | *Streptosporangium* sp. 'caverna' |
| SBP00095 | Kimchi - Sinto Gourmet | *Sulfitobacter pseudonitzschiae* |
| SBP00095 | Kimchi - Sinto Gourmet | *Sulfuricella denitrificans* |
| SBP00095 | Kimchi - Sinto Gourmet | *Sulfurimonas gotlandica* |
| SBP00095 | Kimchi - Sinto Gourmet | *Sulfuritalea hydrogenivorans* |
| SBP00095 | Kimchi - Sinto Gourmet | *Swingsia samuiensis* |
| SBP00095 | Kimchi - Sinto Gourmet | *Symbiobacterium thermophilum* |
| SBP00095 | Kimchi - Sinto Gourmet | *Synechococcus lividus* |
| SBP00095 | Kimchi - Sinto Gourmet | *Synechococcus* sp. CB0101 |
| SBP00095 | Kimchi - Sinto Gourmet | *Synechococcus* sp. CC9902 |
| SBP00095 | Kimchi - Sinto Gourmet | *Synechococcus* sp. KORDI-100 |
| SBP00095 | Kimchi - Sinto Gourmet | *Synechococcus* sp. PCC 6312 |
| SBP00095 | Kimchi - Sinto Gourmet | *Synechococcus* sp. PCC 7003 |
| SBP00095 | Kimchi - Sinto Gourmet | *Synechococcus* sp. PCC 7502 |
| SBP00095 | Kimchi - Sinto Gourmet | *Synechocystis* sp. PCC 6714 |
| SBP00095 | Kimchi - Sinto Gourmet | *Syntrophobacter fumaroxidans* |
| SBP00095 | Kimchi - Sinto Gourmet | *Tabrizicola* sp. K13M18 |
| SBP00095 | Kimchi - Sinto Gourmet | *Tannerella forsythia* |
| SBP00095 | Kimchi - Sinto Gourmet | *Tannerella* sp. oral taxon HOT-286 |
| SBP00095 | Kimchi - Sinto Gourmet | *Tatumella citrea* |
| SBP00095 | Kimchi - Sinto Gourmet | *Tatumella ptyseos* |
| SBP00095 | Kimchi - Sinto Gourmet | *Taylorella equigenitalis* |
| SBP00095 | Kimchi - Sinto Gourmet | *Tenacibaculum dicentrarchi* |
| SBP00095 | Kimchi - Sinto Gourmet | *Tenacibaculum jejuense* |
| SBP00095 | Kimchi - Sinto Gourmet | *Tenacibaculum* sp. SZ-18 |
| SBP00095 | Kimchi - Sinto Gourmet | *Tenacibaculum todarodis* |
| SBP00095 | Kimchi - Sinto Gourmet | *Tenericutes bacterium* MO-XQ |
| SBP00095 | Kimchi - Sinto Gourmet | *Tenericutes bacterium* MZ-XQ |
| SBP00095 | Kimchi - Sinto Gourmet | *Terribacillus goriensis* |
| SBP00095 | Kimchi - Sinto Gourmet | *Terriglobus roseus* |
| SBP00095 | Kimchi - Sinto Gourmet | *Tetragenococcus halophilus* |
| SBP00095 | Kimchi - Sinto Gourmet | *Tetragenococcus koreensis* |
| SBP00095 | Kimchi - Sinto Gourmet | *Tetragenococcus osmophilus* |
| SBP00095 | Kimchi - Sinto Gourmet | *Thalassococcus* sp. S3 |
| SBP00095 | Kimchi - Sinto Gourmet | *Thalassococcus* sp. SH-1 |
| SBP00095 | Kimchi - Sinto Gourmet | *Thalassolituus oleivorans* |
| SBP00095 | Kimchi - Sinto Gourmet | *Thalassospira indica* |
| SBP00095 | Kimchi - Sinto Gourmet | *Thalassotalea crassostreae* |
| SBP00095 | Kimchi - Sinto Gourmet | *Thauera aromatica* |
| SBP00095 | Kimchi - Sinto Gourmet | *Thauera humireducens* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Thauera* sp. K11 |
| SBP00095 | Kimchi - Sinto Gourmet | *Thauera* sp. MZ1T |
| SBP00095 | Kimchi - Sinto Gourmet | *Thermacetogenium phaeum* |
| SBP00095 | Kimchi - Sinto Gourmet | *Thermincola potens* |
| SBP00095 | Kimchi - Sinto Gourmet | *Thermoactinomyces vulgaris* |
| SBP00095 | Kimchi - Sinto Gourmet | *Thermoactinomycetaceae bacterium* SCSIO 07575 |
| SBP00095 | Kimchi - Sinto Gourmet | *Thermoanaerobacterium* sp. RBIITD |
| SBP00095 | Kimchi - Sinto Gourmet | *Thermoanaerobacterium thermosaccharolyticum* |
| SBP00095 | Kimchi - Sinto Gourmet | *Thermobaculum terrenum* |
| SBP00095 | Kimchi - Sinto Gourmet | *Thermococcus barossii* |
| SBP00095 | Kimchi - Sinto Gourmet | *Thermococcus celer* |
| SBP00095 | Kimchi - Sinto Gourmet | *Thermococcus pacificus* |
| SBP00095 | Kimchi - Sinto Gourmet | *Thermococcus paralvinellae* |
| SBP00095 | Kimchi - Sinto Gourmet | *Thermodesulfobacterium commune* |
| SBP00095 | Kimchi - Sinto Gourmet | *Thermodesulfobacterium geofontis* |
| SBP00095 | Kimchi - Sinto Gourmet | *Thermomonospora curvata* |
| SBP00095 | Kimchi - Sinto Gourmet | *Thermosediminibacter oceani* |
| SBP00095 | Kimchi - Sinto Gourmet | *Thermosynechococcus elongatus* |
| SBP00095 | Kimchi - Sinto Gourmet | *Thermosynechococcus* sp. NK55a |
| SBP00095 | Kimchi - Sinto Gourmet | *Thermotoga profunda* |
| SBP00095 | Kimchi - Sinto Gourmet | *Thermus thermophilus* |
| SBP00095 | Kimchi - Sinto Gourmet | *Thioalkalivibrio paradoxus* |
| SBP00095 | Kimchi - Sinto Gourmet | *Thiohalobacter thiocyanaticus* |
| SBP00095 | Kimchi - Sinto Gourmet | *Thiomicrorhabdus* sp. HaS4 |
| SBP00095 | Kimchi - Sinto Gourmet | *Thiomicrospira cyclica* |
| SBP00095 | Kimchi - Sinto Gourmet | *Thiomonas intermedia* |
| SBP00095 | Kimchi - Sinto Gourmet | *Thiomonas* sp. X19 |
| SBP00095 | Kimchi - Sinto Gourmet | *Tistrella mobilis* |
| SBP00095 | Kimchi - Sinto Gourmet | Tobacco vein clearing virus |
| SBP00095 | Kimchi - Sinto Gourmet | *Tolumonas auensis* |
| SBP00095 | Kimchi - Sinto Gourmet | *Treponema azotonutricium* |
| SBP00095 | Kimchi - Sinto Gourmet | *Treponema brennaborense* |
| SBP00095 | Kimchi - Sinto Gourmet | *Treponema denticola* |
| SBP00095 | Kimchi - Sinto Gourmet | *Treponema primitia* |
| SBP00095 | Kimchi - Sinto Gourmet | *Trichodesmium erythraeum* |
| SBP00095 | Kimchi - Sinto Gourmet | *Trichormus azollae* |
| SBP00095 | Kimchi - Sinto Gourmet | *Tumebacillus algifaecis* |
| SBP00095 | Kimchi - Sinto Gourmet | *Turicibacter* sp. H121 |
| SBP00095 | Kimchi - Sinto Gourmet | *Turneriella parva* |
| SBP00095 | Kimchi - Sinto Gourmet | *Undibacterium parvum* |
| SBP00095 | Kimchi - Sinto Gourmet | *Ureaplasma parvum* |
| SBP00095 | Kimchi - Sinto Gourmet | *Ureaplasma urealyticum* |
| SBP00095 | Kimchi - Sinto Gourmet | *Ureibacillus thermosphaericus* |
| SBP00095 | Kimchi - Sinto Gourmet | *Vagococcus penaei* |
| SBP00095 | Kimchi - Sinto Gourmet | *Vagococcus teuberi* |
| SBP00095 | Kimchi - Sinto Gourmet | *Vampirococcus* sp. LiM |
| SBP00095 | Kimchi - Sinto Gourmet | *Variibacter gotjawalensis* |
| SBP00095 | Kimchi - Sinto Gourmet | *Variovorax boronicumulans* |
| SBP00095 | Kimchi - Sinto Gourmet | *Variovorax paradoxus* |
| SBP00095 | Kimchi - Sinto Gourmet | *Variovorax* sp. HW608 |
| SBP00095 | Kimchi - Sinto Gourmet | *Variovorax* sp. PAMC 28711 |
| SBP00095 | Kimchi - Sinto Gourmet | *Variovorax* sp. PMC12 |
| SBP00095 | Kimchi - Sinto Gourmet | *Veillonella parvula* |
| SBP00095 | Kimchi - Sinto Gourmet | *Veillonella rodentium* |
| SBP00095 | Kimchi - Sinto Gourmet | *Verminephrobacter eiseniae* |
| SBP00095 | Kimchi - Sinto Gourmet | *Verrucomicrobium* sp. GAS474 |
| SBP00095 | Kimchi - Sinto Gourmet | *Verrucomicrobium spinosum* |
| SBP00095 | Kimchi - Sinto Gourmet | *Vibrio alginolyticus* |
| SBP00095 | Kimchi - Sinto Gourmet | *Vibrio azureus* |
| SBP00095 | Kimchi - Sinto Gourmet | *Vibrio breoganii* |
| SBP00095 | Kimchi - Sinto Gourmet | *Vibrio campbellii* |
| SBP00095 | Kimchi - Sinto Gourmet | *Vibrio casei* |
| SBP00095 | Kimchi - Sinto Gourmet | *Vibrio chagasii* |
| SBP00095 | Kimchi - Sinto Gourmet | *Vibrio cholerae* |
| SBP00095 | Kimchi - Sinto Gourmet | *Vibrio furnissii* |
| SBP00095 | Kimchi - Sinto Gourmet | *Vibrio gazogenes* |
| SBP00095 | Kimchi - Sinto Gourmet | *Vibrio harveyi* |
| SBP00095 | Kimchi - Sinto Gourmet | *Vibrio mediterranei* |
| SBP00095 | Kimchi - Sinto Gourmet | *Vibrio mimicus* |
| SBP00095 | Kimchi - Sinto Gourmet | *Vibrio nigripulchritudo* |
| SBP00095 | Kimchi - Sinto Gourmet | *Vibrio owensii* |
| SBP00095 | Kimchi - Sinto Gourmet | *Vibrio parahaemolyticus* |
| SBP00095 | Kimchi - Sinto Gourmet | *Vibrio qinghaiensis* |
| SBP00095 | Kimchi - Sinto Gourmet | *Vibrio scophthalmi* |
| SBP00095 | Kimchi - Sinto Gourmet | *Vibrio* sp. HBUAS61001 |
| SBP00095 | Kimchi - Sinto Gourmet | *Vibrio vulnificus* |

TABLE 3-continued

List of species identified in each metagenomic sample of each SBP Sample

| SBP ID | SBP Host Common Name | Genus sp. |
|---|---|---|
| SBP00095 | Kimchi - Sinto Gourmet | *Victivallales bacterium* CCUG 44730 |
| SBP00095 | Kimchi - Sinto Gourmet | *Virgibacillus dokdonensis* |
| SBP00095 | Kimchi - Sinto Gourmet | *Virgibacillus halodenitrificans* |
| SBP00095 | Kimchi - Sinto Gourmet | *Virgibacillus phasianinus* |
| SBP00095 | Kimchi - Sinto Gourmet | *Virgibacillus* sp. 6R |
| SBP00095 | Kimchi - Sinto Gourmet | *Virgibacillus* sp. Bac330 |
| SBP00095 | Kimchi - Sinto Gourmet | *Virgibacillus* sp. Bac332 |
| SBP00095 | Kimchi - Sinto Gourmet | *Virgibacillus* sp. SK37 |
| SBP00095 | Kimchi - Sinto Gourmet | *Vogesella* sp. LIG4 |
| SBP00095 | Kimchi - Sinto Gourmet | *Weissella ceti* |
| SBP00095 | Kimchi - Sinto Gourmet | *Weissella cibaria* |
| SBP00095 | Kimchi - Sinto Gourmet | *Weissella confusa* |
| SBP00095 | Kimchi - Sinto Gourmet | *Weissella hellenica* |
| SBP00095 | Kimchi - Sinto Gourmet | *Weissella jogaejeotgali* |
| SBP00095 | Kimchi - Sinto Gourmet | *Weissella koreensis* |
| SBP00095 | Kimchi - Sinto Gourmet | *Weissella paramesenteroides* |
| SBP00095 | Kimchi - Sinto Gourmet | *Weissella phage* WCP30 |
| SBP00095 | Kimchi - Sinto Gourmet | *Weissella soli* |
| SBP00095 | Kimchi - Sinto Gourmet | *Weissella viridescens* |
| SBP00095 | Kimchi - Sinto Gourmet | *Winogradskyella* sp. J14-2 |
| SBP00095 | Kimchi - Sinto Gourmet | *Winogradskyella* sp. PG-2 |
| SBP00095 | Kimchi - Sinto Gourmet | *Woeseia oceani* |
| SBP00095 | Kimchi - Sinto Gourmet | *Wolinella succinogenes* |
| SBP00095 | Kimchi - Sinto Gourmet | *Xanthobacter autotrophicus* |
| SBP00095 | Kimchi - Sinto Gourmet | *Xanthomonas albilineans* |
| SBP00095 | Kimchi - Sinto Gourmet | *Xanthomonas arboricola* |
| SBP00095 | Kimchi - Sinto Gourmet | *Xanthomonas campestris* |
| SBP00095 | Kimchi - Sinto Gourmet | *Xanthomonas citri* |
| SBP00095 | Kimchi - Sinto Gourmet | *Xanthomonas euvesicatoria* |
| SBP00095 | Kimchi - Sinto Gourmet | *Xanthomonas oryzae* |
| SBP00095 | Kimchi - Sinto Gourmet | *Xanthomonas translucens* |
| SBP00095 | Kimchi - Sinto Gourmet | *Xanthomonas vasicola* |
| SBP00095 | Kimchi - Sinto Gourmet | *Xanthomonas vesicatoria* |
| SBP00095 | Kimchi - Sinto Gourmet | *Xenorhabdus bovienii* |
| SBP00095 | Kimchi - Sinto Gourmet | *Xenorhabdus hominickii* |
| SBP00095 | Kimchi - Sinto Gourmet | *Xenorhabdus nematophila* |
| SBP00095 | Kimchi - Sinto Gourmet | *Xylella fastidiosa* |
| SBP00095 | Kimchi - Sinto Gourmet | *Yangia pacifica* |
| SBP00095 | Kimchi - Sinto Gourmet | *Yersinia aldovae* |
| SBP00095 | Kimchi - Sinto Gourmet | *Yersinia aleksiciae* |
| SBP00095 | Kimchi - Sinto Gourmet | *Yersinia enterocolitica* |
| SBP00095 | Kimchi - Sinto Gourmet | *Yersinia entomophaga* |
| SBP00095 | Kimchi - Sinto Gourmet | *Yersinia frederiksenii* |
| SBP00095 | Kimchi - Sinto Gourmet | *Yersinia kristensenii* |
| SBP00095 | Kimchi - Sinto Gourmet | *Yersinia pestis* |
| SBP00095 | Kimchi - Sinto Gourmet | *Yersinia phage* fHe-Yen9-04 |
| SBP00095 | Kimchi - Sinto Gourmet | *Yersinia pseudotuberculosis* |
| SBP00095 | Kimchi - Sinto Gourmet | *Yersinia rohdei* |
| SBP00095 | Kimchi - Sinto Gourmet | *Yersinia ruckeri* |
| SBP00095 | Kimchi - Sinto Gourmet | *Zhihengliuella* sp. ISTPL4 |
| SBP00095 | Kimchi - Sinto Gourmet | *Zobellella denitrificans* |
| SBP00095 | Kimchi - Sinto Gourmet | *Zobellia galactanivorans* |
| SBP00095 | Kimchi - Sinto Gourmet | *Zunongwangia profunda* |
| SBP00095 | Kimchi - Sinto Gourmet | *Zymomonas mobilis* |
| SBP00103 | Green cauliflower | *Acidovorax* sp. 1608163 |
| SBP00103 | Green cauliflower | *Acidovorax* sp. KKS102 |
| SBP00103 | Green cauliflower | *Aequorivita sublithincola* |
| SBP00103 | Green cauliflower | *Agrobacterium* sp. |
| SBP00103 | Green cauliflower | *Anaerotignum propionicum* |
| SBP00103 | Green cauliflower | *Bacillus oceanisediminis* |
| SBP00103 | Green cauliflower | *Bacillus* sp. (in: Bacteria) |
| SBP00103 | Green cauliflower | *Bacillus subtilis* |
| SBP00103 | Green cauliflower | *Bacillus thuringiensis* |
| SBP00103 | Green cauliflower | *Bacteroides fragilis* |
| SBP00103 | Green cauliflower | Bat associated circovirus 4 |
| SBP00103 | Green cauliflower | *Blastococcus saxobsidens* |
| SBP00103 | Green cauliflower | *Bradyrhizobium* sp. BTAi1 |
| SBP00103 | Green cauliflower | *Bradyrhizobium* sp. SK17 |
| SBP00103 | Green cauliflower | *Burkholderia contaminans* |
| SBP00103 | Green cauliflower | *Burkholderia multivorans* |
| SBP00103 | Green cauliflower | *Burkholderia pseudomallei* |
| SBP00103 | Green cauliflower | *Chryseobacterium* sp. G0162 |
| SBP00103 | Green cauliflower | *Colwellia* sp. PAMC 21821 |
| SBP00103 | Green cauliflower | *Cupriavidus metallidurans* |
| SBP00103 | Green cauliflower | *Cupriavidus taiwanensis* |
| SBP00103 | Green cauliflower | *Cutibacterium acnes* |

TABLE 3-continued

List of species identified in each metagenomic sample of each SBP Sample

| SBP ID | SBP Host Common Name | Genus sp. |
|---|---|---|
| SBP00103 | Green cauliflower | Cyanothece sp. PCC 7424 |
| SBP00103 | Green cauliflower | Delftia sp. |
| SBP00103 | Green cauliflower | Delftia tsuruhatensis |
| SBP00103 | Green cauliflower | Enterobacter cloacae |
| SBP00103 | Green cauliflower | Ereboglobus luteus |
| SBP00103 | Green cauliflower | Flavobacterium columnare |
| SBP00103 | Green cauliflower | Fuerstia marisgermanicae |
| SBP00103 | Green cauliflower | Geminocystis sp. NIES-3709 |
| SBP00103 | Green cauliflower | Klebsiella pneumoniae |
| SBP00103 | Green cauliflower | Lactobacillus brevis |
| SBP00103 | Green cauliflower | Lactobacillus crispatus |
| SBP00103 | Green cauliflower | Leclercia adecarboxylata |
| SBP00103 | Green cauliflower | Lentzea guizhouensis |
| SBP00103 | Green cauliflower | Leuconostoc mesenteroides |
| SBP00103 | Green cauliflower | Methyloceanibacter caenitepidi |
| SBP00103 | Green cauliflower | Moraxella osloensis |
| SBP00103 | Green cauliflower | Nocardia cyriacigeorgica |
| SBP00103 | Green cauliflower | Pantoea agglomerans |
| SBP00103 | Green cauliflower | Paraburkholderia phymatum |
| SBP00103 | Green cauliflower | Paracoccus sp. Arc7-R13 |
| SBP00103 | Green cauliflower | Pasteurella multocida |
| SBP00103 | Green cauliflower | Photobacterium damselae |
| SBP00103 | Green cauliflower | Plautia stali |
| SBP00103 | Green cauliflower | Prevotella intermedia |
| SBP00103 | Green cauliflower | Propionibacterium sp. oral taxon 193 |
| SBP00103 | Green cauliflower | Pseudoalteromonas sp. SM9913 |
| SBP00103 | Green cauliflower | Pseudomonas fluorescens |
| SBP00103 | Green cauliflower | Pseudomonas koreensis |
| SBP00103 | Green cauliflower | Pseudomonas poae |
| SBP00103 | Green cauliflower | Pseudomonas putida |
| SBP00103 | Green cauliflower | Pseudomonas reinekei |
| SBP00103 | Green cauliflower | Pseudomonas sp. |
| SBP00103 | Green cauliflower | Ralstonia insidiosa |
| SBP00103 | Green cauliflower | Ralstonia mannitolilytica |
| SBP00103 | Green cauliflower | Ralstonia pickettii |
| SBP00103 | Green cauliflower | Ralstonia solanacearum |
| SBP00103 | Green cauliflower | Rhodococcus fascians |
| SBP00103 | Green cauliflower | Sandaracinus amylolyticus |
| SBP00103 | Green cauliflower | Serratia marcescens |
| SBP00103 | Green cauliflower | Sphingobacteriaceae bacterium GW460-11-11-14-LB5 |
| SBP00103 | Green cauliflower | Staphylococcus aureus |
| SBP00103 | Green cauliflower | Staphylococcus epidermidis |
| SBP00103 | Green cauliflower | Staphylococcus haemolyticus |
| SBP00103 | Green cauliflower | Stenotrophomonas maltophilia |
| SBP00103 | Green cauliflower | Zymomonas mobilis |
| SBP00107 | Shallot | [Arcobacter] porcinus |
| SBP00107 | Shallot | [Brevibacterium] frigoritolerans |
| SBP00107 | Shallot | [Clostridium] saccharolyticum |
| SBP00107 | Shallot | [Clostridium] sphenoides |
| SBP00107 | Shallot | [Clostridium] ultunense |
| SBP00107 | Shallot | [Enterobacter] lignolyticus |
| SBP00107 | Shallot | [Eubacterium] cellulosolvens |
| SBP00107 | Shallot | [Eubacterium] eligens |
| SBP00107 | Shallot | [Eubacterium] hallii |
| SBP00107 | Shallot | [Eubacterium] rectale |
| SBP00107 | Shallot | [Polyangium] brachysporum |
| SBP00107 | Shallot | Acanthocystis turfacea chlorella virus 1 |
| SBP00107 | Shallot | Acaryochloris marina |
| SBP00107 | Shallot | Acetoanaerobium sticklandii |
| SBP00107 | Shallot | Acetohalobium arabaticum |
| SBP00107 | Shallot | Acholeplasma axanthum |
| SBP00107 | Shallot | Acholeplasma palmae |
| SBP00107 | Shallot | Achromobacter spanius |
| SBP00107 | Shallot | Acidianus brierleyi |
| SBP00107 | Shallot | Acidianus sulfidivorans |
| SBP00107 | Shallot | Acidisphaera sp. G45-3 |
| SBP00107 | Shallot | Acidobacterium capsulatum |
| SBP00107 | Shallot | Acinetobacter baumannii |
| SBP00107 | Shallot | Acinetobacter bereziniae |
| SBP00107 | Shallot | Acinetobacter calcoaceticus |
| SBP00107 | Shallot | Acinetobacter equi |
| SBP00107 | Shallot | Acinetobacter guillouiae |
| SBP00107 | Shallot | Acinetobacter haemolyticus |
| SBP00107 | Shallot | Acinetobacter junii |
| SBP00107 | Shallot | Acinetobacter larvae |
| SBP00107 | Shallot | Acinetobacter nosocomialis |

TABLE 3-continued

List of species identified in each metagenomic sample of each SBP Sample

| SBP ID | SBP Host Common Name | Genus sp. |
|---|---|---|
| SBP00107 | Shallot | *Acinetobacter oleivorans* |
| SBP00107 | Shallot | *Acinetobacter pittii* |
| SBP00107 | Shallot | *Acinetobacter schindleri* |
| SBP00107 | Shallot | *Acinetobacter* sp. ACNIH1 |
| SBP00107 | Shallot | *Acinetobacter* sp. ACNIH2 |
| SBP00107 | Shallot | *Acinetobacter venetianus* |
| SBP00107 | Shallot | *Acinetobacter wuhouensis* |
| SBP00107 | Shallot | *Actinobacillus pleuropneumoniae* |
| SBP00107 | Shallot | *Actinobacteria bacterium* IMCC26077 |
| SBP00107 | Shallot | *Actinomyces* sp. oral taxon 171 |
| SBP00107 | Shallot | *Actinomyces* sp. VUL4_3 |
| SBP00107 | Shallot | *Actinomyces* sp. Z16 |
| SBP00107 | Shallot | *Actinoplanes derwentensis* |
| SBP00107 | Shallot | *Actinoplanes missouriensis* |
| SBP00107 | Shallot | *Actinoplanes* sp. ATCC 31351 |
| SBP00107 | Shallot | *Advenella kashmirensis* |
| SBP00107 | Shallot | *Aequorivita* sp. H23M31 |
| SBP00107 | Shallot | *Aequorivita sublithincola* |
| SBP00107 | Shallot | *Aeribacillus pallidus* |
| SBP00107 | Shallot | *Aerococcus urinaeequi* |
| SBP00107 | Shallot | *Aerococcus viridans* |
| SBP00107 | Shallot | *Aeromicrobium* sp. 592 |
| SBP00107 | Shallot | *Aeromonas hydrophila* |
| SBP00107 | Shallot | *Aeromonas phage* phiAS5 |
| SBP00107 | Shallot | *Aeromonas* sp. |
| SBP00107 | Shallot | *Agarilytica rhodophyticola* |
| SBP00107 | Shallot | *Aggregatibacter aphrophilus* |
| SBP00107 | Shallot | *Agrobacterium* sp. |
| SBP00107 | Shallot | *Agrobacterium tumefaciens* |
| SBP00107 | Shallot | *Agrobacterium vitis* |
| SBP00107 | Shallot | *Agromyces flavus* |
| SBP00107 | Shallot | *Akkermansia muciniphila* |
| SBP00107 | Shallot | *Alcaligenes faecalis* |
| SBP00107 | Shallot | *Algibacter alginicilyticus* |
| SBP00107 | Shallot | *Algoriphagus machipongonensis* |
| SBP00107 | Shallot | *Aliivibrio fischeri* |
| SBP00107 | Shallot | *Aliivibrio salmonicida* |
| SBP00107 | Shallot | *Aliivibrio wodanis* |
| SBP00107 | Shallot | *Alkaliphilus metalliredigens* |
| SBP00107 | Shallot | *Alkalitalea saponilacus* |
| SBP00107 | Shallot | alpha proteobacterium HIMB5 |
| SBP00107 | Shallot | alpha proteobacterium HIMB59 |
| SBP00107 | Shallot | *Alteromonas addita* |
| SBP00107 | Shallot | *Alteromonas macleodii* |
| SBP00107 | Shallot | *Alteromonas mediterranea* |
| SBP00107 | Shallot | *Alteromonas* sp. MB-3u-76 |
| SBP00107 | Shallot | *Amycolatopsis orientalis* |
| SBP00107 | Shallot | *Anabaena cylindrica* |
| SBP00107 | Shallot | *Anabaena* sp. 90 |
| SBP00107 | Shallot | *Anabaena* sp. WA102 |
| SBP00107 | Shallot | *Anaerostipes hadrus* |
| SBP00107 | Shallot | *Anaerotignum propionicum* |
| SBP00107 | Shallot | *Anoxybacter fermentans* |
| SBP00107 | Shallot | *Antarcticibacterium flavum* |
| SBP00107 | Shallot | *Antarctobacter heliothermus* |
| SBP00107 | Shallot | *Apibacter* sp. HY041 |
| SBP00107 | Shallot | *Aquiflexum balticum* |
| SBP00107 | Shallot | *Aquimarina* sp. AD1 |
| SBP00107 | Shallot | *Aquimarina* sp. AD10 |
| SBP00107 | Shallot | *Aquimarina* sp. BL5 |
| SBP00107 | Shallot | *Arachidicoccus* sp. KI559-12 |
| SBP00107 | Shallot | *Arcobacter anaerophilus* |
| SBP00107 | Shallot | *Arcobacter bivalviorum* |
| SBP00107 | Shallot | *Arcobacter butzleri* |
| SBP00107 | Shallot | *Arcobacter cryaerophilus* |
| SBP00107 | Shallot | *Arcobacter ellisii* |
| SBP00107 | Shallot | *Arcobacter halophilus* |
| SBP00107 | Shallot | *Arcobacter marinus* |
| SBP00107 | Shallot | *Arcobacter molluscorum* |
| SBP00107 | Shallot | *Arcobacter mytili* |
| SBP00107 | Shallot | *Arcobacter nitrofigilis* |
| SBP00107 | Shallot | *Arcobacter pacificus* |
| SBP00107 | Shallot | *Arcobacter skirrowii* |
| SBP00107 | Shallot | *Arcobacter* sp. L |
| SBP00107 | Shallot | *Arcobacter* sp. PSE-93 |
| SBP00107 | Shallot | *Arcobacter suis* |

TABLE 3-continued

List of species identified in each metagenomic sample of each SBP Sample

| SBP ID | SBP Host Common Name | Genus sp. |
|---|---|---|
| SBP00107 | Shallot | *Arcobacter trophiarum* |
| SBP00107 | Shallot | *Arcticibacterium luteifluviistationis* |
| SBP00107 | Shallot | *Arenibacter algicola* |
| SBP00107 | Shallot | *Arsenicicoccus* sp. oral taxon 190 |
| SBP00107 | Shallot | *Arsenophonus nasoniae* |
| SBP00107 | Shallot | *Asticcacaulis excentricus* |
| SBP00107 | Shallot | *Bacillus altitudinis* |
| SBP00107 | Shallot | *Bacillus amyloliquefaciens* |
| SBP00107 | Shallot | *Bacillus asahii* |
| SBP00107 | Shallot | *Bacillus butanolivorans* |
| SBP00107 | Shallot | *Bacillus cellulosilyticus* |
| SBP00107 | Shallot | *Bacillus cereus* |
| SBP00107 | Shallot | *Bacillus ciccensis* |
| SBP00107 | Shallot | *Bacillus circulans* |
| SBP00107 | Shallot | *Bacillus clausii* |
| SBP00107 | Shallot | *Bacillus cohnii* |
| SBP00107 | Shallot | *Bacillus cytotoxicus* |
| SBP00107 | Shallot | *Bacillus flexus* |
| SBP00107 | Shallot | *Bacillus foraminis* |
| SBP00107 | Shallot | *Bacillus freudenreichii* |
| SBP00107 | Shallot | *Bacillus glycinifermentans* |
| SBP00107 | Shallot | *Bacillus halodurans* |
| SBP00107 | Shallot | *Bacillus halotolerans* |
| SBP00107 | Shallot | *Bacillus infantis* |
| SBP00107 | Shallot | *Bacillus jeotgali* |
| SBP00107 | Shallot | *Bacillus kochii* |
| SBP00107 | Shallot | *Bacillus krulwichiae* |
| SBP00107 | Shallot | *Bacillus lehensis* |
| SBP00107 | Shallot | *Bacillus lentus* |
| SBP00107 | Shallot | *Bacillus licheniformis* |
| SBP00107 | Shallot | *Bacillus litoralis* |
| SBP00107 | Shallot | *Bacillus marisflavi* |
| SBP00107 | Shallot | *Bacillus megaterium* |
| SBP00107 | Shallot | *Bacillus mesonae* |
| SBP00107 | Shallot | *Bacillus methanolicus* |
| SBP00107 | Shallot | *Bacillus mycoides* |
| SBP00107 | Shallot | *Bacillus oceanisediminis* |
| SBP00107 | Shallot | *Bacillus paralicheniformis* |
| SBP00107 | Shallot | *Bacillus phage Evoli* |
| SBP00107 | Shallot | *Bacillus pseudomycoides* |
| SBP00107 | Shallot | *Bacillus pumilus* |
| SBP00107 | Shallot | *Bacillus safensis* |
| SBP00107 | Shallot | *Bacillus simplex* |
| SBP00107 | Shallot | *Bacillus smithii* |
| SBP00107 | Shallot | *Bacillus* sp. (in: Bacteria) |
| SBP00107 | Shallot | *Bacillus* sp. 1NLA3E |
| SBP00107 | Shallot | *Bacillus* sp. FJAT-18017 |
| SBP00107 | Shallot | *Bacillus* sp. FJAT-22090 |
| SBP00107 | Shallot | *Bacillus* sp. FJAT-42376 |
| SBP00107 | Shallot | *Bacillus* sp. X1(2014) |
| SBP00107 | Shallot | *Bacillus* sp. Y1 |
| SBP00107 | Shallot | *Bacillus subtilis* |
| SBP00107 | Shallot | *Bacillus thuringiensis* |
| SBP00107 | Shallot | *Bacillus velezensis* |
| SBP00107 | Shallot | *Bacillus weihaiensis* |
| SBP00107 | Shallot | *Bacterioplanes sanyensis* |
| SBP00107 | Shallot | *Bacteriovorax stolpii* |
| SBP00107 | Shallot | *Bacteroides caccae* |
| SBP00107 | Shallot | *Bacteroides cellulosilyticus* |
| SBP00107 | Shallot | *Bacteroides fragilis* |
| SBP00107 | Shallot | *Bacteroides ovatus* |
| SBP00107 | Shallot | *Bacteroides salanitronis* |
| SBP00107 | Shallot | *Bacteroides thetaiotaomicron* |
| SBP00107 | Shallot | *Bacteroides vulgatus* |
| SBP00107 | Shallot | Banana streak CA virus |
| SBP00107 | Shallot | Banana streak IM virus |
| SBP00107 | Shallot | *Bartonella grahamii* |
| SBP00107 | Shallot | *Bartonella henselae* |
| SBP00107 | Shallot | *Bdellovibrio bacteriovorus* |
| SBP00107 | Shallot | BeAn 58058 virus |
| SBP00107 | Shallot | Beet curly top virus |
| SBP00107 | Shallot | *Beggiatoa leptomitoformis* |
| SBP00107 | Shallot | *Belliella baltica* |
| SBP00107 | Shallot | *Bernardetia litoralis* |
| SBP00107 | Shallot | *Beutenbergia cavernae* |
| SBP00107 | Shallot | *Bifidobacterium breve* |

TABLE 3-continued

List of species identified in each metagenomic sample of each SBP Sample

| SBP ID | SBP Host Common Name | Genus sp. |
|---|---|---|
| SBP00107 | Shallot | Blastomonas fulva |
| SBP00107 | Shallot | Blattabacterium sp. (Blaberus giganteus) |
| SBP00107 | Shallot | Blautia hansenii |
| SBP00107 | Shallot | Blautia producta |
| SBP00107 | Shallot | Blautia sp. SC05848 |
| SBP00107 | Shallot | Bordetella sp. H567 |
| SBP00107 | Shallot | Bordetella sp. N |
| SBP00107 | Shallot | Borrelia anserina |
| SBP00107 | Shallot | Borrelia hermsii |
| SBP00107 | Shallot | Borreliella burgdorferi |
| SBP00107 | Shallot | Bosea sp. AS-1 |
| SBP00107 | Shallot | Bougainvillea chlorotic vein banding virus |
| SBP00107 | Shallot | Brachyspira hampsonii |
| SBP00107 | Shallot | Brachyspira intermedia |
| SBP00107 | Shallot | Brachyspira murdochii |
| SBP00107 | Shallot | Brachyspira pilosicoli |
| SBP00107 | Shallot | Bradyrhizobium diazoefficiens |
| SBP00107 | Shallot | Bradyrhizobium erythrophlei |
| SBP00107 | Shallot | Bradyrhizobium guangdongense |
| SBP00107 | Shallot | Bradyrhizobium japonicum |
| SBP00107 | Shallot | Bradyrhizobium sp. BTAi1 |
| SBP00107 | Shallot | Bradyrhizobium sp. ORS 3257 |
| SBP00107 | Shallot | Bradyrhizobium sp. SK17 |
| SBP00107 | Shallot | Brevibacillus brevis |
| SBP00107 | Shallot | Brevibacillus laterosporus |
| SBP00107 | Shallot | Brevibacillus sp. SCSIO 07484 |
| SBP00107 | Shallot | Brevibacterium aurantiacum |
| SBP00107 | Shallot | Brochothrix thermosphacta |
| SBP00107 | Shallot | Buchnera aphidicola |
| SBP00107 | Shallot | Burkholderia cenocepacia |
| SBP00107 | Shallot | Burkholderia cepacia |
| SBP00107 | Shallot | Burkholderia contaminans |
| SBP00107 | Shallot | Burkholderia gladioli |
| SBP00107 | Shallot | Burkholderia lata |
| SBP00107 | Shallot | Burkholderia multivorans |
| SBP00107 | Shallot | Burkholderia plantarii |
| SBP00107 | Shallot | Burkholderia pseudomallei |
| SBP00107 | Shallot | Burkholderia sp. AD24 |
| SBP00107 | Shallot | Burkholderia sp. BDU8 |
| SBP00107 | Shallot | Burkholderia sp. CCGE1003 |
| SBP00107 | Shallot | Burkholderia sp. MSM8617WGS |
| SBP00107 | Shallot | Burkholderia sp. PAMC 28687 |
| SBP00107 | Shallot | Burkholderia vietnamiensis |
| SBP00107 | Shallot | Butyricimonas sp. H184 |
| SBP00107 | Shallot | Butyrivibrio proteoclasticus |
| SBP00107 | Shallot | Cacao swollen shoot Ghana J virus |
| SBP00107 | Shallot | Cacao swollen shoot Ghana L virus |
| SBP00107 | Shallot | Caldanaerobacter subterraneus |
| SBP00107 | Shallot | Caldisericum exile |
| SBP00107 | Shallot | Caldisphaera lagunensis |
| SBP00107 | Shallot | Calothrix parasitica |
| SBP00107 | Shallot | Calothrix parietina |
| SBP00107 | Shallot | Calothrix sp. NIES-2098 |
| SBP00107 | Shallot | Calothrix sp. NIES-2100 |
| SBP00107 | Shallot | Calothrix sp. NIES-3974 |
| SBP00107 | Shallot | Calothrix sp. PCC 7507 |
| SBP00107 | Shallot | Caminibacter mediatlanticus |
| SBP00107 | Shallot | Campylobacter coli |
| SBP00107 | Shallot | Campylobacter concisus |
| SBP00107 | Shallot | Campylobacter cuniculorum |
| SBP00107 | Shallot | Campylobacter fetus |
| SBP00107 | Shallot | Campylobacter gracilis |
| SBP00107 | Shallot | Campylobacter hepaticus |
| SBP00107 | Shallot | Campylobacter hyointestinalis |
| SBP00107 | Shallot | Campylobacter jejuni |
| SBP00107 | Shallot | Campylobacter lari |
| SBP00107 | Shallot | Campylobacter peloridis |
| SBP00107 | Shallot | Campylobacter pinnipediorum |
| SBP00107 | Shallot | Campylobacter sputorum |
| SBP00107 | Shallot | Campylobacter subantarcticus |
| SBP00107 | Shallot | Campylobacter ureolyticus |
| SBP00107 | Shallot | Campylobacter volucris |
| SBP00107 | Shallot | Candidatus Arthromitus sp. SFB-rat-Yit |
| SBP00107 | Shallot | Candidatus Azobacteroides pseudotrichonymphae |
| SBP00107 | Shallot | Candidatus Baumannia cicadellinicola |
| SBP00107 | Shallot | Candidatus Coxiella mudrowiae |

TABLE 3-continued

List of species identified in each metagenomic sample of each SBP Sample

| SBP ID | SBP Host Common Name | Genus sp. |
|---|---|---|
| SBP00107 | Shallot | *Candidatus Desulfofervidus auxilii* |
| SBP00107 | Shallot | *Candidatus Endolissoclinum faulkneri* |
| SBP00107 | Shallot | *Candidatus Gracilibacteria bacterium* HOT-871 |
| SBP00107 | Shallot | *Candidatus Hamiltonella defensa* |
| SBP00107 | Shallot | *Candidatus Liberibacter americanus* |
| SBP00107 | Shallot | *Candidatus Nitrosocosmicus franklandus* |
| SBP00107 | Shallot | *Candidatus Nitrosomarinus catalina* |
| SBP00107 | Shallot | *Candidatus Pelagibacter ubique* |
| SBP00107 | Shallot | *Candidatus Phycorickettsia trachydisci* |
| SBP00107 | Shallot | *Candidatus Protochlamydia amoebophila* |
| SBP00107 | Shallot | *Candidatus Rickettsiella viridis* |
| SBP00107 | Shallot | *Candidatus Sulcia muelleri* |
| SBP00107 | Shallot | *Candidatus Tachikawaea gelatinosa* |
| SBP00107 | Shallot | *Candidatus Thioglobus singularis* |
| SBP00107 | Shallot | *Capnocytophaga canimorsus* |
| SBP00107 | Shallot | *Capnocytophaga cynodegmi* |
| SBP00107 | Shallot | *Capnocytophaga gingivalis* |
| SBP00107 | Shallot | *Capnocytophaga sputigena* |
| SBP00107 | Shallot | *Capnocytophaga stomatis* |
| SBP00107 | Shallot | *Carnobacterium divergens* |
| SBP00107 | Shallot | *Carnobacterium inhibens* |
| SBP00107 | Shallot | *Carnobacterium maltaromaticum* |
| SBP00107 | Shallot | *Carnobacterium* sp. 17-4 |
| SBP00107 | Shallot | *Carnobacterium* sp. CP1 |
| SBP00107 | Shallot | *Castellaniella defragrans* |
| SBP00107 | Shallot | *Catenovulum* sp. CCB-QB4 |
| SBP00107 | Shallot | *Catenulispora acidiphila* |
| SBP00107 | Shallot | *Cedecea neteri* |
| SBP00107 | Shallot | *Celeribacter baekdonensis* |
| SBP00107 | Shallot | *Cellulophaga algicola* |
| SBP00107 | Shallot | *Cellulophaga baltica* |
| SBP00107 | Shallot | *Cellulophaga lytica* |
| SBP00107 | Shallot | *Chamaesiphon minutus* |
| SBP00107 | Shallot | *Chitinophaga caeni* |
| SBP00107 | Shallot | *Chitinophaga* sp. MD30 |
| SBP00107 | Shallot | *Chondrocystis* sp. NIES-4102 |
| SBP00107 | Shallot | *Chondromyces crocatus* |
| SBP00107 | Shallot | *Chromatiaceae bacterium* 2141T.STBD.0c.01a |
| SBP00107 | Shallot | *Chroococcidiopsis thermalis* |
| SBP00107 | Shallot | *Chryseobacterium antarcticum* |
| SBP00107 | Shallot | *Chryseobacterium arthrosphaerae* |
| SBP00107 | Shallat | *Chryseobacterium balustinum* |
| SBP00107 | Shallot | *Chryseobacterium camelliae* |
| SBP00107 | Shallot | *Chryseobacterium carnipullorum* |
| SBP00107 | Shallot | *Chryseobacterium carnis* |
| SBP00107 | Shallot | *Chryseobacterium gallinarum* |
| SBP00107 | Shallot | *Chryseobacterium glaciei* |
| SBP00107 | Shallot | *Chryseobacterium gleum* |
| SBP00107 | Shallot | *Chryseobacterium haifense* |
| SBP00107 | Shallot | *Chryseobacterium indologenes* |
| SBP00107 | Shallot | *Chryseobacterium indoltheticum* |
| SBP00107 | Shallot | *Chryseobacterium jeonii* |
| SBP00107 | Shallot | *Chryseobacterium joostei* |
| SBP00107 | Shallot | *Chryseobacterium lactis* |
| SBP00107 | Shallot | *Chryseobacterium nakagawai* |
| SBP00107 | Shallot | *Chryseobacterium piperi* |
| SBP00107 | Shallot | *Chryseobacterium shandongense* |
| SBP00107 | Shallot | *Chryseobacterium* sp. 175167 |
| SBP00107 | Shallot | *Chryseobacterium* sp. 3008163 |
| SBP00107 | Shallot | *Chryseobacterium* sp. G0162 |
| SBP00107 | Shallot | *Chryseobacterium* sp. G0186 |
| SBP00107 | Shallot | *Chryseobacterium* sp. G0201 |
| SBP00107 | Shallot | *Chryseobacterium* sp. IHB B 17019 |
| SBP00107 | Shallot | *Chryseobacterium* sp. StRB126 |
| SBP00107 | Shallot | *Chryseobacterium* sp. T16E-39 |
| SBP00107 | Shallot | *Chryseobacterium taklimakanense* |
| SBP00107 | Shallot | *Chryseolinea* sp. KIS68-18 |
| SBP00107 | Shallot | *Chrysochromulina ericina* virus |
| SBP00107 | Shallot | *Citrobacter freundii* |
| SBP00107 | Shallot | *Citromicrobium* sp. JL477 |
| SBP00107 | Shallot | *Cloacibacillus porcorum* |
| SBP00107 | Shallot | *Clostridiaceae bacterium* 1450207 |
| SBP00107 | Shallot | *Clostridiales bacterium* 70B-A |
| SBP00107 | Shallot | *Clostridioides difficile* |
| SBP00107 | Shallot | *Clostridium aceticum* |
| SBP00107 | Shallot | *Clostridium acetobutylicum* |

TABLE 3-continued

List of species identified in each metagenomic sample of each SBP Sample

| SBP ID | SBP Host Common Name | Genus sp. |
|---|---|---|
| SBP00107 | Shallot | *Clostridium argentinense* |
| SBP00107 | Shallot | *Clostridium autoethanogenum* |
| SBP00107 | Shallot | *Clostridium baratii* |
| SBP00107 | Shallot | *Clostridium beijerinckii* |
| SBP00107 | Shallot | *Clostridium bornimense* |
| SBP00107 | Shallot | *Clostridium botulinum* |
| SBP00107 | Shallot | *Clostridium butyricum* |
| SBP00107 | Shallot | *Clostridium carboxidivorans* |
| SBP00107 | Shallot | *Clostridium cellulovorans* |
| SBP00107 | Shallot | *Clostridium chauvoei* |
| SBP00107 | Shallot | *Clostridium cochlearium* |
| SBP00107 | Shallot | *Clostridium drakei* |
| SBP00107 | Shallot | *Clostridium estertheticum* |
| SBP00107 | Shallot | *Clostridium formicaceticum* |
| SBP00107 | Shallot | *Clostridium isatidis* |
| SBP00107 | Shallot | *Clostridium kluyveri* |
| SBP00107 | Shallot | *Clostridium novyi* |
| SBP00107 | Shallot | *Clostridium pasteurianum* |
| SBP00107 | Shallot | *Clostridium perfringens* |
| SBP00107 | Shallot | *Clostridium saccharobutylicum* |
| SBP00107 | Shallot | *Clostridium saccharoperbutylacetonicum* |
| SBP00107 | Shallot | *Clostridium scatologenes* |
| SBP00107 | Shallot | *Clostridium septicum* |
| SBP00107 | Shallot | *Clostridium sp. AWRP* |
| SBP00107 | Shallot | *Clostridium sp. BNL1100* |
| SBP00107 | Shallot | *Clostridium sp. CT4* |
| SBP00107 | Shallot | *Clostridium sp. DL-VIII* |
| SBP00107 | Shallot | *Clostridium sp. JN-1* |
| SBP00107 | Shallot | *Clostridium sp. JNS00901* |
| SBP00107 | Shallot | *Clostridium sporogenes* |
| SBP00107 | Shallot | *Clostridium taeniosporum* |
| SBP00107 | Shallot | *Clostridium tetani* |
| SBP00107 | Shallot | *Clostridium tyrobutyricum* |
| SBP00107 | Shallot | *Collimonas arenae* |
| SBP00107 | Shallot | *Colwellia beringensis* |
| SBP00107 | Shallot | *Colwellia psychrerythraea* |
| SBP00107 | Shallot | *Colwellia sp. Arc7-D* |
| SBP00107 | Shallot | *Colwellia sp. PAMC 20917* |
| SBP00107 | Shallot | *Commensalibacter sp. AMU001* |
| SBP00107 | Shallot | *Conexibacter woesei* |
| SBP00107 | Shallot | *Corallococcus coralloides* |
| SBP00107 | Shallot | *Corynebacterium glutamicum* |
| SBP00107 | Shallot | *Corynebacterium maris* |
| SBP00107 | Shallot | *Corynebacterium singulare* |
| SBP00107 | Shallot | *Crinalium epipsammum* |
| SBP00107 | Shallot | *Croceibacter atlanticus* |
| SBP00107 | Shallot | *Cronobacter sakazakii* |
| SBP00107 | Shallot | *Cuniculiplasma divulgatum* |
| SBP00107 | Shallot | *Cupriavidus metallidurans* |
| SBP00107 | Shallot | *Cupriavidus necator* |
| SBP00107 | Shallot | *Cupriavidus taiwanensis* |
| SBP00107 | Shallot | *Cutibacterium acnes* |
| SBP00107 | Shallot | *Cyanobacterium aponinum* |
| SBP00107 | Shallot | *Cyanothece sp. ATCC 51142* |
| SBP00107 | Shallot | *Cyanothece sp. PCC 7425* |
| SBP00107 | Shallot | *Cyanothece sp. PCC 7822* |
| SBP00107 | Shallot | *Cyclobacterium amurskyense* |
| SBP00107 | Shallot | *Cyclobacterium marinum* |
| SBP00107 | Shallot | *Cylindrospermum stagnale* |
| SBP00107 | Shallot | *Cyprinid herpesvirus 3* |
| SBP00107 | Shallot | *Cystobacter fuscus* |
| SBP00107 | Shallot | *Cytophaga hutchinsonii* |
| SBP00107 | Shallot | *Dactylococcopsis salina* |
| SBP00107 | Shallot | *Deferribacter desulfuricans* |
| SBP00107 | Shallot | *Defluviitoga tunisiensis* |
| SBP00107 | Shallot | *Dehalococcoides mccartyi* |
| SBP00107 | Shallot | *Delftia sp.* |
| SBP00107 | Shallot | *Desulfallas gibsoniae* |
| SBP00107 | Shallot | *Desulfatibacillum aliphaticivorans* |
| SBP00107 | Shallot | *Desulfitobacterium dichloroeliminans* |
| SBP00107 | Shallot | *Desulfobacula toluolica* |
| SBP00107 | Shallot | *Desulfofarcimen acetoxidans* |
| SBP00107 | Shallot | *Desulfoglaeba alkanexedens* |
| SBP00107 | Shallot | *Desulfomicrobium baculatum* |
| SBP00107 | Shallot | *Desulfosporosinus acidiphilus* |
| SBP00107 | Shallot | *Desulfosporosinus meridiei* |

TABLE 3-continued

List of species identified in each metagenomic sample of each SBP Sample

| SBP ID | SBP Host Common Name | Genus sp. |
|---|---|---|
| SBP00107 | Shallot | *Desulfosporosinus orientis* |
| SBP00107 | Shallot | *Desulfosporosinus youngiae* |
| SBP00107 | Shallot | *Desulfovibrio africanus* |
| SBP00107 | Shallot | *Desulfovibrio vulgaris* |
| SBP00107 | Shallot | *Desulfurococcus amylolyticus* |
| SBP00107 | Shallot | *Dickeya chrysanthemi* |
| SBP00107 | Shallot | *Dickeya paradisiaca* |
| SBP00107 | Shallot | *Dickeya zeae* |
| SBP00107 | Shallot | *Dictyoglomus thermophilum* |
| SBP00107 | Shallot | *Diolcogaster facetosa bracovirus* |
| SBP00107 | Shallot | *Dokdonia* sp. 4H-3-7-5 |
| SBP00107 | Shallot | *Dokdonia* sp. Dokd-P16 |
| SBP00107 | Shallot | *Dokdonia* sp. PRO95 |
| SBP00107 | Shallot | *Dyadobacter fermentans* |
| SBP00107 | Shallot | *Echinicola rosea* |
| SBP00107 | Shallot | *Echinicola strongylocentroti* |
| SBP00107 | Shallot | *Echinicola vietnamensis* |
| SBP00107 | Shallot | *Ehrlichia ruminantium* |
| SBP00107 | Shallot | *Eikenella corrodens* |
| SBP00107 | Shallot | *Elizabethkingia anophelis* |
| SBP00107 | Shallot | *Elizabethkingia meningoseptica* |
| SBP00107 | Shallot | *Elizabethkingia ursingii* |
| SBP00107 | Shallot | *Emcibacter congregatus* |
| SBP00107 | Shallot | *Endozoicomonas montiporae* |
| SBP00107 | Shallot | *Enterobacter cloacae* |
| SBP00107 | Shallot | *Enterobacter cloacae* complex sp. |
| SBP00107 | Shallot | *Enterobacter ludwigii* |
| SBP00107 | Shallot | *Enterococcus avium* |
| SBP00107 | Shallot | *Enterococcus faecalis* |
| SBP00107 | Shallot | *Enterococcus faecium* |
| SBP00107 | Shallot | *Enterococcus gilvus* |
| SBP00107 | Shallot | *Enterococcus hirae* |
| SBP00107 | Shallot | *Enterococcus mundtii* |
| SBP00107 | Shallot | *Enterococcus thailandicus* |
| SBP00107 | Shallot | *Enterococcus wangshanyuanii* |
| SBP00107 | Shallot | *Entomoplasma somnilux* |
| SBP00107 | Shallot | *Epibacterium mobile* |
| SBP00107 | Shallot | *Erwinia persicina* |
| SBP00107 | Shallot | *Erysipelotrichaceae bacterium* GAM147 |
| SBP00107 | Shallot | *Erysipelotrichaceae bacterium* SG0102 |
| SBP00107 | Shallot | *Erythrobacter atlanticus* |
| SBP00107 | Shallot | *Erythrobacter flavus* |
| SBP00107 | Shallot | *Erythrobacter seohaensis* |
| SBP00107 | Shallot | *Erythrobacter* sp. KYS |
| SBP00107 | Shallot | *Escherichia albertii* |
| SBP00107 | Shallot | *Escherichia coli* |
| SBP00107 | Shallot | *Escherichia* sp. E4742 |
| SBP00107 | Shallot | *Eubacterium limosum* |
| SBP00107 | Shallot | *Exiguobacterium mexicanum* |
| SBP00107 | Shallot | *Fabibacter pacificus* |
| SBP00107 | Shallot | *Faecalitalea cylindroides* |
| SBP00107 | Shallot | *Fermentimonas caenicola* |
| SBP00107 | Shallot | *Fibrobacter succinogenes* |
| SBP00107 | Shallot | *Fictibacillus arsenicus* |
| SBP00107 | Shallot | *Fictibacillus phosphorivorans* |
| SBP00107 | Shallot | *Filifactor alocis* |
| SBP00107 | Shallot | *Finegoldia magna* |
| SBP00107 | Shallot | *Fischerella* sp. NIES-3754 |
| SBP00107 | Shallot | *Fischerella* sp. NIES-4106 |
| SBP00107 | Shallot | *Flagellimonas* sp. HME9304 |
| SBP00107 | Shallot | *Flammeovirga* sp. L12M1 |
| SBP00107 | Shallot | *Flammeovirga* sp. MY04 |
| SBP00107 | Shallot | *Flavisolibacter* sp. 17J28-1 |
| SBP00107 | Shallot | *Flavisolibacter tropicus* |
| SBP00107 | Shallot | *Flavivirga eckloniae* |
| SBP00107 | Shallot | *Flavobacteriaceae bacterium* |
| SBP00107 | Shallot | *Flavobacteriaceae bacterium* MAR_2010_188 |
| SBP00107 | Shallot | *Flavobacteriaceae bacterium* UJ101 |
| SBP00107 | Shallot | *Flavobacterium album* |
| SBP00107 | Shallot | *Flavobacterium anhuiense* |
| SBP00107 | Shallot | *Flavobacterium branchiophilum* |
| SBP00107 | Shallot | *Flavobacterium columnare* |
| SBP00107 | Shallot | *Flavobacterium crocinum* |
| SBP00107 | Shallot | *Flavobacterium faecale* |
| SBP00107 | Shallot | *Flavobacterium gilvum* |
| SBP00107 | Shallot | *Flavobacterium indicum* |

TABLE 3-continued

List of species identified in each metagenomic sample of each SBP Sample

| SBP ID | SBP Host Common Name | Genus sp. |
|---|---|---|
| SBP00107 | Shallot | *Flavobacterium johnsoniae* |
| SBP00107 | Shallot | *Flavobacterium kingsejongi* |
| SBP00107 | Shallot | *Flavobacterium pallidum* |
| SBP00107 | Shallot | *Flavobacterium psychrophilum* |
| SBP00107 | Shallot | *Flavobacterium* sp. 140616W15 |
| SBP00107 | Shallot | *Flavobacterium* sp. HYN0086 |
| SBP00107 | Shallot | *Flavobacterium* sp. MEBIC07310 |
| SBP00107 | Shallot | *Formosa agariphila* |
| SBP00107 | Shallot | *Formosa* sp. Hel1_31_208 |
| SBP00107 | Shallot | *Formosa* sp. Hel1_33_131 |
| SBP00107 | Shallot | *Francisella halioticida* |
| SBP00107 | Shallot | *Francisella hispaniensis* |
| SBP00107 | Shallot | *Francisella persica* |
| SBP00107 | Shallot | *Francisella philomiragia* |
| SBP00107 | Shallot | *Francisella* sp. TX077308 |
| SBP00107 | Shallot | *Francisella tularensis* |
| SBP00107 | Shallot | *Frischella perrara* |
| SBP00107 | Shallot | *Fusobacterium gonidiaformans* |
| SBP00107 | Shallot | *Fusobacterium hwasookii* |
| SBP00107 | Shallot | *Fusobacterium mortiferum* |
| SBP00107 | Shallot | *Fusobacterium necrophorum* |
| SBP00107 | Shallot | *Fusobacterium nucleatum* |
| SBP00107 | Shallot | *Fusobacterium periodonticum* |
| SBP00107 | Shallot | *Fusobacterium ulcerans* |
| SBP00107 | Shallot | *Fusobacterium varium* |
| SBP00107 | Shallot | *Gardnerella vaginalis* |
| SBP00107 | Shallot | *Gemella morbillorum* |
| SBP00107 | Shallot | *Geminocystis herdmanii* |
| SBP00107 | Shallot | *Geminocystis* sp. NIES-3708 |
| SBP00107 | Shallot | *Geminocystis* sp. NIES-3709 |
| SBP00107 | Shallot | *Gemmata obscuriglobus* |
| SBP00107 | Shallot | *Geobacter* sp. M18 |
| SBP00107 | Shallot | *Geobacter sulfurreducens* |
| SBP00107 | Shallot | *Geosporobacter ferrireducens* |
| SBP00107 | Shallot | *Gilliamella apicola* |
| SBP00107 | Shallot | *Gillisia* sp. Hel1_33_143 |
| SBP00107 | Shallot | *Glaciecola nitratireducens* |
| SBP00107 | Shallot | *Gloeocapsa* sp. PCC 7428 |
| SBP00107 | Shallot | *Gottschalkia acidurici* |
| SBP00107 | Shallot | *Gramella flava* |
| SBP00107 | Shallot | *Gramella forsetii* |
| SBP00107 | Shallot | *Gramella* sp. MAR_2010_102 |
| SBP00107 | Shallot | *Gramella* sp. MAR_2010_147 |
| SBP00107 | Shallot | *Gramella* sp. SH35 |
| SBP00107 | Shallot | *Granulicella mallensis* |
| SBP00107 | Shallot | *Gynuella sunshinyii* |
| SBP00107 | Shallot | *Haemophilus influenzae* |
| SBP00107 | Shallot | *Haemophilus parainfluenzae* |
| SBP00107 | Shallot | *Hafnia alvei* |
| SBP00107 | Shallot | *Halanaerobium hydrogeniformans* |
| SBP00107 | Shallot | *Halanaerobium praevalens* |
| SBP00107 | Shallot | *Haliangium ochraceum* |
| SBP00107 | Shallot | *Haliscomenobacter hydrossis* |
| SBP00107 | Shallot | *Halobacillus litoralis* |
| SBP00107 | Shallot | *Halobacillus mangrovi* |
| SBP00107 | Shallot | *Halobacteriovorax marinus* |
| SBP00107 | Shallot | *Halobacteriovorax* sp. 8ALOs_7 |
| SBP00107 | Shallot | *Halobacteroides halobius* |
| SBP00107 | Shallot | *Halocella* sp. SP3-1 |
| SBP00107 | Shallot | *Halomonas beimenensis* |
| SBP00107 | Shallot | *Halomonas* sp. GT |
| SBP00107 | Shallot | *Haloquadratum walsbyi* |
| SBP00107 | Shallot | *Halorhodospira halochloris* |
| SBP00107 | Shallot | *Halothece* sp. PCC 7418 |
| SBP00107 | Shallot | *Halothermothrix orenii* |
| SBP00107 | Shallot | *Hathewaya histolytica* |
| SBP00107 | Shallot | *Helicobacter bilis* |
| SBP00107 | Shallot | *Helicobacter cetorum* |
| SBP00107 | Shallot | *Helicobacter cinaedi* |
| SBP00107 | Shallot | *Helicobacter mustelae* |
| SBP00107 | Shallot | *Helicobacter pylori* |
| SBP00107 | Shallot | *Helicobacter saguini* |
| SBP00107 | Shallot | *Helicobacter typhlonius* |
| SBP00107 | Shallot | *Herbinix luporum* |
| SBP00107 | Shallot | *Histophilus somni* |
| SBP00107 | Shallot | *Hungateiclostridium clariflavum* |

TABLE 3-continued

List of species identified in each metagenomic sample of each SBP Sample

| SBP ID | SBP Host Common Name | Genus sp. |
|---|---|---|
| SBP00107 | Shallot | *Hydrogenophaga crassostreae* |
| SBP00107 | Shallot | *Hydrogenophaga* sp. NH-16 |
| SBP00107 | Shallot | *Hyphomicrobium denitrificans* |
| SBP00107 | Shallot | *Ignavibacterium album* |
| SBP00107 | Shallot | *Iodobacter* sp. H11R3 |
| SBP00107 | Shallot | *Janthinobacterium agaricidamnosum* |
| SBP00107 | Shallot | *Janthinobacterium* sp. Marseille |
| SBP00107 | Shallot | *Janthinobacterium svalbardensis* |
| SBP00107 | Shallot | *Kangiella geojedonensis* |
| SBP00107 | Shallot | *Kangiella koreensis* |
| SBP00107 | Shallot | *Klebsiella aerogenes* |
| SBP00107 | Shallot | *Klebsiella michiganensis* |
| SBP00107 | Shallot | *Klebsiella oxytoca* |
| SBP00107 | Shallot | *Klebsiella pneumoniae* |
| SBP00107 | Shallot | *Klebsiella variicola* |
| SBP00107 | Shallot | *Kocuria flava* |
| SBP00107 | Shallot | *Kordia* sp. SMS9 |
| SBP00107 | Shallot | *Kribbella flavida* |
| SBP00107 | Shallot | *Lachnoanaerobaculum umeaense* |
| SBP00107 | Shallot | *Lachnoclostridium phytofermentans* |
| SBP00107 | Shallot | *Lachnospiraceae bacterium* GAM79 |
| SBP00107 | Shallot | *Lacimicrobium alkaliphilum* |
| SBP00107 | Shallot | *Lacinutrix* sp. SH-3-7-4 |
| SBP00107 | Shallot | *Lacinutrix* sp. Bg11-31 |
| SBP00107 | Shallot | *Lacinutrix venerupis* |
| SBP00107 | Shallot | *Lactobacillus acidophilus* |
| SBP00107 | Shallot | *Lactobacillus allii* |
| SBP00107 | Shallot | *Lactobacillus amylovorus* |
| SBP00107 | Shallot | *Lactobacillus brevis* |
| SBP00107 | Shallot | *Lactobacillus buchneri* |
| SBP00107 | Shallot | *Lactobacillus curvatus* |
| SBP00107 | Shallot | *Lactobacillus delbrueckii* |
| SBP00107 | Shallot | *Lactobacillus farciminis* |
| SBP00107 | Shallot | *Lactobacillus fermentum* |
| SBP00107 | Shallot | *Lactobacillus heilongjiangensis* |
| SBP00107 | Shallot | *Lactobacillus hordei* |
| SBP00107 | Shallot | *Lactobacillus jensenii* |
| SBP00107 | Shallot | *Lactobacillus johnsonii* |
| SBP00107 | Shallot | *Lactobacillus paracollinoides* |
| SBP00107 | Shallot | *Lactobacillus plantarum* |
| SBP00107 | Shallot | *Lactobacillus reuteri* |
| SBP00107 | Shallot | *Lactobacillus rhamnosus* |
| SBP00107 | Shallot | *Lactobacillus sakei* |
| SBP00107 | Shallot | *Lactobacillus salivarius* |
| SBP00107 | Shallot | *Lactococcus garvieae* |
| SBP00107 | Shallot | *Lactococcus lactis* |
| SBP00107 | Shallot | *Lactococcus piscium* |
| SBP00107 | Shallot | *Lawsonia intracellularis* |
| SBP00107 | Shallot | *Leclercia adecarboxylata* |
| SBP00107 | Shallot | *Legionella anisa* |
| SBP00107 | Shallot | *Legionella cherrii* |
| SBP00107 | Shallot | *Legionella clemsonensis* |
| SBP00107 | Shallot | *Legionella* endosymbiont of *Polyplax serrata* |
| SBP00107 | Shallot | *Legionella lansingensis* |
| SBP00107 | Shallot | *Legionella longbeachae* |
| SBP00107 | Shallot | *Legionella pneumophila* |
| SBP00107 | Shallot | *Legionella sainthelensi* |
| SBP00107 | Shallot | *Legionella waltersii* |
| SBP00107 | Shallot | *Lentzea guizhouensis* |
| SBP00107 | Shallot | *Leptospira biflexa* |
| SBP00107 | Shallot | *Leptospira interrogans* |
| SBP00107 | Shallot | *Leptospira santarosai* |
| SBP00107 | Shallot | *Leptospirillum ferriphilum* |
| SBP00107 | Shallot | *Leptotrichia* sp. oral taxon 212 |
| SBP00107 | Shallot | *Leptotrichia* sp. oral taxon 847 |
| SBP00107 | Shallot | *Leuconostoc gelidum* |
| SBP00107 | Shallot | *Leuconostoc mesenteroides* |
| SBP00107 | Shallot | *Limnohabitans* sp. 63ED37-2 |
| SBP00107 | Shallot | *Listeria innocua* |
| SBP00107 | Shallot | *Listeria monocytogenes* |
| SBP00107 | Shallot | *Listeria welshimeri* |
| SBP00107 | Shallot | *Litorilituus sediminis* |
| SBP00107 | Shallot | *Lonsdalea britannica* |
| SBP00107 | Shallot | *Lutibacter profundi* |
| SBP00107 | Shallot | *Lutibacter* sp. LPB0138 |
| SBP00107 | Shallot | *Lysinibacillus* sp. 2017 |

TABLE 3-continued

List of species identified in each metagenomic sample of each SBP Sample

| SBP ID | SBP Host Common Name | Genus sp. |
| --- | --- | --- |
| SBP00107 | Shallot | *Lysinibacillus* sp. Marseille-P5727 |
| SBP00107 | Shallot | *Lysinibacillus* sp. SGAir0095 |
| SBP00107 | Shallot | *Lysinibacillus* sp. YS11 |
| SBP00107 | Shallot | *Lysinibacillus sphaericus* |
| SBP00107 | Shallot | *Lysobacter capsici* |
| SBP00107 | Shallot | *Macrococcus canis* |
| SBP00107 | Shallot | *Maribacter cobaltidurans* |
| SBP00107 | Shallot | *Maribacter* sp. HTCC2170 |
| SBP00107 | Shallot | *Marinifilaceae bacterium* SPP2 |
| SBP00107 | Shallot | *Mariniflexile* sp. TRM1-10 |
| SBP00107 | Shallot | *Marinilactibacillus* sp. 15R |
| SBP00107 | Shallot | *Marivirga tractuosa* |
| SBP00107 | Shallot | *Maruca vitrata* nucleopolyhedrovirus |
| SBP00107 | Shallot | *Massilia albidiflava* |
| SBP00107 | Shallot | *Massilia* sp. WGS |
| SBP00107 | Shallot | *Massilia umbonata* |
| SBP00107 | Shallot | *Megavirus chiliensis* |
| SBP00107 | Shallot | *Melittangium boletus* |
| SBP00107 | Shallot | *Mesoplasma florum* |
| SBP00107 | Shallot | *Mesorhizobium* sp. M6A.T.Cr.TU.016.01.1.1 |
| SBP00107 | Shallot | *Methanobacterium formicicum* |
| SBP00107 | Shallot | *Methanobacterium lacus* |
| SBP00107 | Shallot | *Methanobacterium paludis* |
| SBP00107 | Shallot | *Methanobacterium* sp. MB1 |
| SBP00107 | Shallot | *Methanobrevibacter olleyae* |
| SBP00107 | Shallot | *Methanobrevibacter ruminantium* |
| SBP00107 | Shallot | *Methanobrevibacter* sp. AbM4 |
| SBP00107 | Shallot | *Methanocaldococcus bathoardescens* |
| SBP00107 | Shallot | *Methanocaldococcus vulcanius* |
| SBP00107 | Shallot | *Methanococcus aeolicus* |
| SBP00107 | Shallot | *Methanococcus maripaludis* |
| SBP00107 | Shallot | *Methanococcus vannielii* |
| SBP00107 | Shallot | *Methanococcus voltae* |
| SBP00107 | Shallot | *Methanohalobium evestigatum* |
| SBP00107 | Shallot | *Methanoregula boonei* |
| SBP00107 | Shallot | *Methanoregula formicica* |
| SBP00107 | Shallot | *Methanosarcina barkeri* |
| SBP00107 | Shallot | *Methanosarcina horonobensis* |
| SBP00107 | Shallot | *Methanosarcina lacustris* |
| SBP00107 | Shallot | *Methanosarcina mazei* |
| SBP00107 | Shallot | *Methanosarcina siciliae* |
| SBP00107 | Shallot | *Methanosphaera* sp. BMS |
| SBP00107 | Shallot | *Methanosphaera stadtmanae* |
| SBP00107 | Shallot | *Methanotorris igneus* |
| SBP00107 | Shallot | *Methylobacillus flagellatus* |
| SBP00107 | Shallot | *Methylobacterium radiotolerans* |
| SBP00107 | Shallot | *Methylomicrobium album* |
| SBP00107 | Shallot | *Methylomicrobium* sp. wino1 |
| SBP00107 | Shallot | *Methylorubrum extorquens* |
| SBP00107 | Shallot | *Microbacterium foliorum* |
| SBP00107 | Shallot | *Microchaete diplosiphon* |
| SBP00107 | Shallot | *Microcoleus* sp. PCC 7113 |
| SBP00107 | Shallot | *Micromonospora echinaurantiaca* |
| SBP00107 | Shallot | *Moorea producens* |
| SBP00107 | Shallot | *Moraxella osloensis* |
| SBP00107 | Shallot | *Morganella* phage vB_MmoP_MP2 |
| SBP00107 | Shallot | *Moritella yayanosii* |
| SBP00107 | Shallot | *Mucilaginibacter gotjawali* |
| SBP00107 | Shallot | *Mucilaginibacter mallensis* |
| SBP00107 | Shallot | *Mucilaginibacter paludis* |
| SBP00107 | Shallot | *Mucilaginibacter* sp. BJC16-A31 |
| SBP00107 | Shallot | Mulberry badnavirus 1 |
| SBP00107 | Shallot | *Muribaculum intestinale* |
| SBP00107 | Shallot | *Muricauda ruestringensis* |
| SBP00107 | Shallot | *Mycoavidus cysteinexigens* |
| SBP00107 | Shallot | *Mycobacterium avium* |
| SBP00107 | Shallot | *Mycobacterium dioxanotrophicus* |
| SBP00107 | Shallot | *Mycobacteroides abscessus* |
| SBP00107 | Shallot | *Mycolicibacterium goodii* |
| SBP00107 | Shallot | *Mycoplasma anatis* |
| SBP00107 | Shallot | *Mycoplasma arginini* |
| SBP00107 | Shallot | *Mycoplasma bovirhinis* |
| SBP00107 | Shallot | *Mycoplasma bovis* |
| SBP00107 | Shallot | *Mycoplasma californicum* |
| SBP00107 | Shallot | *Mycoplasma canis* |
| SBP00107 | Shallot | *Mycoplasma citelli* |

TABLE 3-continued

List of species identified in each metagenomic sample of each SBP Sample

| SBP ID | SBP Host Common Name | Genus sp. |
|---|---|---|
| SBP00107 | Shallot | *Mycoplasma columborale* |
| SBP00107 | Shallot | *Mycoplasma dispar* |
| SBP00107 | Shallot | *Mycoplasma gallinaceum* |
| SBP00107 | Shallot | *Mycoplasma hominis* |
| SBP00107 | Shallot | *Mycoplasma hyopneumoniae* |
| SBP00107 | Shallot | *Mycoplasma iowae* |
| SBP00107 | Shallot | *Mycoplasma maculosum* |
| SBP00107 | Shallot | *Mycoplasma penetrans* |
| SBP00107 | Shallot | *Mycoplasma phocicerebrale* |
| SBP00107 | Shallot | *Mycoplasma pullorum* |
| SBP00107 | Shallot | *Mycoplasma pulmonis* |
| SBP00107 | Shallot | *Mycoplasma putrefaciens* |
| SBP00107 | Shallot | *Mycoplasma* sp. 2F1A |
| SBP00107 | Shallot | *Mycoplasma wenyonii* |
| SBP00107 | Shallot | *Mycoplasma yeatsii* |
| SBP00107 | Shallot | *Myroides odoratimimus* |
| SBP00107 | Shallot | *Myroides odoratus* |
| SBP00107 | Shallot | *Myroides* sp. A21 |
| SBP00107 | Shallot | *Myxococcus xanthus* |
| SBP00107 | Shallot | *Nakamurella multipartita* |
| SBP00107 | Shallot | *Natronolimnobius aegyptiacus* |
| SBP00107 | Shallot | *Nautilia profundicola* |
| SBP00107 | Shallot | *Neisseriaceae bacterium* DSM 100970 |
| SBP00107 | Shallot | *Neorhizobium galegae* |
| SBP00107 | Shallot | *Neorhizobium* sp. NCHU2750 |
| SBP00107 | Shallot | *Niabella soli* |
| SBP00107 | Shallot | *Niastella koreensis* |
| SBP00107 | Shallot | *Nitrosomonas eutropha* |
| SBP00107 | Shallot | *Nocardia cyriacigeorgica* |
| SBP00107 | Shallot | *Nocardia terpenica* |
| SBP00107 | Shallot | *Nocardioides* sp. JS614 |
| SBP00107 | Shallot | *Nonlabens marinus* |
| SBP00107 | Shallot | *Nonlabens* sp. MI115 |
| SBP00107 | Shallot | *Nostoc carneum* |
| SBP00107 | Shallot | *Nostoc flagelliforme* |
| SBP00107 | Shallot | *Nostoc linckia* |
| SBP00107 | Shallot | *Nostoc piscinale* |
| SBP00107 | Shallot | *Nostoc punctiforme* |
| SBP00107 | Shallot | *Nostoc* sp. 'Lobaria pulmonaria (5183) cyanobiont' |
| SBP00107 | Shallot | *Nostoc* sp. 'Peltigera membranacea cyanobiont' N6 |
| SBP00107 | Shallot | *Nostoc* sp. CENA543 |
| SBP00107 | Shallot | *Nostoc* sp. NIES-2111 |
| SBP00107 | Shallot | *Nostoc* sp. NIES-4103 |
| SBP00107 | Shallot | *Nostoc* sp. PCC 7107 |
| SBP00107 | Shallot | *Nostoc* sp. PCC 7524 |
| SBP00107 | Shallot | *Nostocales cyanobacterium* HT-58-2 |
| SBP00107 | Shallot | *Novibacillus thermophilus* |
| SBP00107 | Shallot | *Oceanisphaera avium* |
| SBP00107 | Shallot | *Oceanisphaera profunda* |
| SBP00107 | Shallot | *Oceanobacillus iheyensis* |
| SBP00107 | Shallot | *Oceanobacillus kimchii* |
| SBP00107 | Shallot | *Oceanobacillus* sp. 160 |
| SBP00107 | Shallot | *Ochrobactrum* sp. A44 |
| SBP00107 | Shallot | *Oleiphilus messinensis* |
| SBP00107 | Shallot | *Olleya aquimaris* |
| SBP00107 | Shallot | *Opitutaceae bacterium* TAVS |
| SBP00107 | Shallot | *Orientia tsutsugamushi* |
| SBP00107 | Shallot | *Ornithobacterium rhinotracheale* |
| SBP00107 | Shallot | *Orpheovirus* IHUMI-LCC2 |
| SBP00107 | Shallot | *Oscillatoria acuminata* |
| SBP00107 | Shallot | *Oscillatoria nigro-viridis* |
| SBP00107 | Shallot | *Oscillibacter* sp. PEA192 |
| SBP00107 | Shallot | *Paenibacillus baekrokdamisoli* |
| SBP00107 | Shallot | *Paenibacillus borealis* |
| SBP00107 | Shallot | *Paenibacillus bovis* |
| SBP00107 | Shallot | *Paenibacillus chitinolyticus* |
| SBP00107 | Shallot | *Paenibacillus donghaensis* |
| SBP00107 | Shallot | *Paenibacillus durus* |
| SBP00107 | Shallot | *Paenibacillus glucanolyticus* |
| SBP00107 | Shallot | *Paenibacillus graminis* |
| SBP00107 | Shallot | *Paenibacillus larvae* |
| SBP00107 | Shallot | *Paenibacillus odorifer* |
| SBP00107 | Shallot | *Paenibacillus polymyxa* |
| SBP00107 | Shallot | *Paenibacillus riograndensis* |
| SBP00107 | Shallot | *Paenibacillus* sp. FSL R7-0273 |
| SBP00107 | Shallot | *Paenibacillus* sp. MBLB1234 |

TABLE 3-continued

List of species identified in each metagenomic sample of each SBP Sample

| SBP ID | SBP Host Common Name | Genus sp. |
| --- | --- | --- |
| SBP00107 | Shallot | *Paenibacillus* sp. Y412MC10 |
| SBP00107 | Shallot | *Paenibacillus swuensis* |
| SBP00107 | Shallot | *Paeniclostridium sordellii* |
| SBP00107 | Shallot | *Pantoea agglomerans* |
| SBP00107 | Shallot | *Pantoea alhagi* |
| SBP00107 | Shallot | *Pantoea vagans* |
| SBP00107 | Shallot | *Paraburkholderia caribensis* |
| SBP00107 | Shallot | *Paraburkholderia phymatum* |
| SBP00107 | Shallot | *Paraburkholderia* sp. SO53 |
| SBP00107 | Shallot | *Paracoccus aminovorans* |
| SBP00107 | Shallot | *Parageobacillus* genomosp. 1 |
| SBP00107 | Shallot | *Paraglaciecola psychrophila* |
| SBP00107 | Shallot | *Paraliobacillus* sp. X-1125 |
| SBP00107 | Shallot | *Paraphotobacterium marinum* |
| SBP00107 | Shallot | *Parvimonas micra* |
| SBP00107 | Shallot | *Pasteurella multocida* |
| SBP00107 | Shallot | *Pasteurellaceae bacterium* NI 1060 |
| SBP00107 | Shallot | *Pectobacterium atrosepticum* |
| SBP00107 | Shallot | *Pectobacterium carotovorum* |
| SBP00107 | Shallot | *Pectobacterium parmentieri* |
| SBP00107 | Shallot | *Pedobacter* sp. eg |
| SBP00107 | Shallot | *Pedobacter* sp. G11 |
| SBP00107 | Shallot | *Pedobacter* sp. PACM 27299 |
| SBP00107 | Shallot | *Pedobacter steynii* |
| SBP00107 | Shallot | *Pelosinus fermentans* |
| SBP00107 | Shallot | *Pelosinus* sp. UFO1 |
| SBP00107 | Shallot | *Persicobacter* sp. JZB09 |
| SBP00107 | Shallot | *Petrotoga mobilis* |
| SBP00107 | Shallot | *Phaeobacter porticola* |
| SBP00107 | Shallot | *Phenylobacterium zucineum* |
| SBP00107 | Shallot | *Photobacterium damselae* |
| SBP00107 | Shallot | *Photobacterium profundum* |
| SBP00107 | Shallot | *Photorhabdus laumondii* |
| SBP00107 | Shallot | *Photorhabdus thracensis* |
| SBP00107 | Shallot | Pigeon aviadenovirus B |
| SBP00107 | Shallot | *Piscirickettsia salmonis* |
| SBP00107 | Shallot | *Planctopirus limnophila* |
| SBP00107 | Shallot | *Planktothrix agardhii* |
| SBP00107 | Shallot | *Planococcus donghaensis* |
| SBP00107 | Shallot | *Planococcus plakortidis* |
| SBP00107 | Shallot | *Plantactinospora* sp. BB1 |
| SBP00107 | Shallot | *Plantibacter* sp. |
| SBP00107 | Shallot | *Plautia stali* |
| SBP00107 | Shallot | *Polaribacter reichenbachii* |
| SBP00107 | Shallot | *Polaribacter* sp. ALD11 |
| SBP00107 | Shallot | *Polaribacter* sp. BM10 |
| SBP00107 | Shallot | *Polaribacter* sp. Hel1_33_78 |
| SBP00107 | Shallot | *Polaribacter* sp. KT25b |
| SBP00107 | Shallot | *Polaribacter* sp. MED152 |
| SBP00107 | Shallot | *Polaribacter* sp. SA4-10 |
| SBP00107 | Shallot | *Polaribacter* sp. SA4-12 |
| SBP00107 | Shallot | *Polaribacter vadi* |
| SBP00107 | Shallot | *Polynucleobacter necessarius* |
| SBP00107 | Shallot | *Pontibacter korlensis* |
| SBP00107 | Shallot | *Porphyromonas gingivalis* |
| SBP00107 | Shallot | *Prevotella intermedia* |
| SBP00107 | Shallot | *Prevotella melaninogenica* |
| SBP00107 | Shallot | *Prevotella oris* |
| SBP00107 | Shallot | *Prevotella ruminicola* |
| SBP00107 | Shallot | *Prochlorococcus marinus* |
| SBP00107 | Shallot | *Prochlorococcus* sp. MIT 0801 |
| SBP00107 | Shallot | *Proteus hauseri* |
| SBP00107 | Shallot | *Proteus mirabilis* |
| SBP00107 | Shallot | *Proteus* phage PM 85 |
| SBP00107 | Shallot | *Proteus vulgaris* |
| SBP00107 | Shallot | *Providencia heimbachae* |
| SBP00107 | Shallot | *Providencia rettgeri* |
| SBP00107 | Shallot | *Providencia rustigianii* |
| SBP00107 | Shallot | *Providencia stuartii* |
| SBP00107 | Shallot | *Pseudanabaena* sp. PCC 7367 |
| SBP00107 | Shallot | *Pseudoalteromonas aliena* |
| SBP00107 | Shallot | *Pseudoalteromonas arctica* |
| SBP00107 | Shallot | *Pseudoalteromonas donghaensis* |
| SBP00107 | Shallot | *Pseudoalteromonas luteoviolacea* |
| SBP00107 | Shallot | *Pseudoalteromonas phenolica* |
| SBP00107 | Shallot | *Pseudoalteromonas piratica* |

TABLE 3-continued

List of species identified in each metagenomic sample of each SBP Sample

| SBP ID | SBP Host Common Name | Genus sp. |
|---|---|---|
| SBP00107 | Shallot | *Pseudoalteromonas piscicida* |
| SBP00107 | Shallot | *Pseudoalteromonas* sp. 13-15 |
| SBP00107 | Shallot | *Pseudoalteromonas* sp. DL-6 |
| SBP00107 | Shallot | *Pseudoalteromonas spongiae* |
| SBP00107 | Shallot | *Pseudomonas aeruginosa* |
| SBP00107 | Shallot | *Pseudomonas azotoformans* |
| SBP00107 | Shallot | *Pseudomonas fluorescens* |
| SBP00107 | Shallot | *Pseudomonas guangdongensis* |
| SBP00107 | Shallot | *Pseudomonas koreensis* |
| SBP00107 | Shallot | *Pseudomonas mandelii* |
| SBP00107 | Shallot | *Pseudomonas mucidolens* |
| SBP00107 | Shallot | *Pseudomonas poae* |
| SBP00107 | Shallot | *Pseudomonas protegens* |
| SBP00107 | Shallot | *Pseudomonas putida* |
| SBP00107 | Shallot | *Pseudomonas rhizosphaerae* |
| SBP00107 | Shallot | *Pseudomonas sabulinigri* |
| SBP00107 | Shallot | *Pseudomonas* sp. |
| SBP00107 | Shallot | *Pseudomonas stutzeri* |
| SBP00107 | Shallot | *Pseudomonas synxantha* |
| SBP00107 | Shallot | *Pseudomonas syringae* |
| SBP00107 | Shallot | *Pseudomonas trivialis* |
| SBP00107 | Shallot | *Pseudomonas versuta* |
| SBP00107 | Shallot | *Pseudomonas viridiflava* |
| SBP00107 | Shallot | *Pseudopedobacter saltans* |
| SBP00107 | Shallot | *Pseudothermotoga thermarum* |
| SBP00107 | Shallot | *Psychrobacter urativorans* |
| SBP00107 | Shallot | *Psychroflexus torquis* |
| SBP00107 | Shallot | *Pyrococcus kukulkanii* |
| SBP00107 | Shallot | *Ralstonia insidiosa* |
| SBP00107 | Shallot | *Ralstonia mannitolilytica* |
| SBP00107 | Shallot | *Ralstonia pickettii* |
| SBP00107 | Shallot | *Ralstonia solanacearum* |
| SBP00107 | Shallot | *Raoultella ornithinolytica* |
| SBP00107 | Shallot | *Rheinheimera* sp. LHK132 |
| SBP00107 | Shallot | *Rhizobium leguminosarum* |
| SBP00107 | Shallot | *Rhizobium* sp. ACO-34A |
| SBP00107 | Shallot | *Rhizobium tropici* |
| SBP00107 | Shallot | *Rhizorhabdus dicambivorans* |
| SBP00107 | Shallot | *Rhodobiaceae bacterium* |
| SBP00107 | Shallot | *Rhodococcus fascians* |
| SBP00107 | Shallot | *Rhodococcus opacus* |
| SBP00107 | Shallot | *Rhodopseudomonas palustris* |
| SBP00107 | Shallot | *Rickettsiales bacterium* Ac37b |
| SBP00107 | Shallot | *Rickettsiales* endosymbiont of *Stachyamoeba lipophora* |
| SBP00107 | Shallot | *Riemerella anatipestifer* |
| SBP00107 | Shallot | *Rivularia* sp. PCC 7116 |
| SBP00107 | Shallot | *Roseburia intestinalis* |
| SBP00107 | Shallot | *Roseobacter denitrificans* |
| SBP00107 | Shallot | *Rothia mucilaginosa* |
| SBP00107 | Shallot | *Rufibacter* sp. DG31D |
| SBP00107 | Shallot | *Ruminococcus bicirculans* |
| SBP00107 | Shallot | *Rummeliibacillus stabekisii* |
| SBP00107 | Shallot | *Runella* sp. HYN0085 |
| SBP00107 | Shallot | *Runella* sp. SP2 |
| SBP00107 | Shallot | *Ruthenibacterium lactatiformans* |
| SBP00107 | Shallot | *Salegentibacter* sp. T436 |
| SBP00107 | Shallot | *Salinicoccus halodurans* |
| SBP00107 | Shallot | *Salmonella bongori* |
| SBP00107 | Shallot | *Salmonella enterica* |
| SBP00107 | Shallot | *Sandaracinus amylolyticus* |
| SBP00107 | Shallot | *Scytonema* sp. HK-05 |
| SBP00107 | Shallot | *Scytonema* sp. NIES-4073 |
| SBP00107 | Shallot | *Sebaldella termitidis* |
| SBP00107 | Shallot | secondary endosymbiont of *Heteropsylla cubana* |
| SBP00107 | Shallot | *Sediminicola* sp. YIK13 |
| SBP00107 | Shallot | *Seonamhaeicola* sp. S2-3 |
| SBP00107 | Shallot | *Serratia fonticola* |
| SBP00107 | Shallot | *Serratia marcescens* |
| SBP00107 | Shallot | *Serratia* sp. |
| SBP00107 | Shallot | *Shewanella baltica* |
| SBP00107 | Shallot | *Shewanella denitrificans* |
| SBP00107 | Shallot | *Shewanella halifaxensis* |
| SBP00107 | Shallot | *Shewanella piezotolerans* |
| SBP00107 | Shallot | *Shewanella psychrophila* |
| SBP00107 | Shallot | *Shewanella putrefaciens* |

TABLE 3-continued

List of species identified in each metagenomic sample of each SBP Sample

| SBP ID | SBP Host Common Name | Genus sp. |
|---|---|---|
| SBP00107 | Shallot | *Shewanella* sp. M2 |
| SBP00107 | Shallot | *Shewanella spongiae* |
| SBP00107 | Shallot | *Shewanella violacea* |
| SBP00107 | Shallot | *Siansivirga zeaxanthinifaciens* |
| SBP00107 | Shallot | Sida yellow blotch virus |
| SBP00107 | Shallot | *Singulisphaera acidiphila* |
| SBP00107 | Shallot | *Sinorhizobium fredii* |
| SBP00107 | Shallot | *Sinorhizobium meliloti* |
| SBP00107 | Shallot | *Sinorhizobium* sp. RAC02 |
| SBP00107 | Shallot | *Snodgrassella alvi* |
| SBP00107 | Shallot | *Sodalis praecaptivus* |
| SBP00107 | Shallot | *Solibacillus silvestris* |
| SBP00107 | Shallot | *Solibacillus* sp. R5-41 |
| SBP00107 | Shallot | *Solitalea canadensis* |
| SBP00107 | Shallot | *Sorangium cellulosum* |
| SBP00107 | Shallot | *Sphaerospermopsis kisseleviana* |
| SBP00107 | Shallot | *Sphingobacteriaceae bacterium* GW460-11-11-14-LB5 |
| SBP00107 | Shallot | *Sphingobacterium daejeonense* |
| SBP00107 | Shallot | *Sphingobacterium mizutaii* |
| SBP00107 | Shallot | *Sphingobacterium psychroaquaticum* |
| SBP00107 | Shallot | *Sphingobacterium* sp. 21 |
| SBP00107 | Shallot | *Sphingobacterium* sp. G1-14 |
| SBP00107 | Shallot | *Sphingobacterium* sp. ML3W |
| SBP00107 | Shallot | *Sphingobacterium thalpophilum* |
| SBP00107 | Shallot | *Sphingobium amiense* |
| SBP00107 | Shallot | *Sphingomonas panacis* |
| SBP00107 | Shallot | *Sphingopyxis alaskensis* |
| SBP00107 | Shallot | *Sphingopyxis granuli* |
| SBP00107 | Shallot | *Sphingopyxis* sp. LPB0140 |
| SBP00107 | Shallot | *Sphingosinicella microcystinivorans* |
| SBP00107 | Shallot | *Spiroplasma alleghenense* |
| SBP00107 | Shallot | *Spiroplasma chrysopicola* |
| SBP00107 | Shallot | *Spiroplasma culicicola* |
| SBP00107 | Shallot | *Spiroplasma diminutum* |
| SBP00107 | Shallot | *Spiroplasma floricola* |
| SBP00107 | Shallot | *Spiroplasma gladiatoris* |
| SBP00107 | Shallot | *Spiroplasma litorale* |
| SBP00107 | Shallot | *Spirosoma pollinicola* |
| SBP00107 | Shallot | *Sporosarcina pasteurii* |
| SBP00107 | Shallot | *Sporosarcina ureae* |
| SBP00107 | Shallot | *Stanieria cyanosphaera* |
| SBP00107 | Shallot | *Stanieria* sp. NIES-3757 |
| SBP00107 | Shallot | *Staphylococcus argenteus* |
| SBP00107 | Shallot | *Staphylococcus aureus* |
| SBP00107 | Shallot | *Staphylococcus capitis* |
| SBP00107 | Shallot | *Staphylococcus caprae* |
| SBP00107 | Shallot | *Staphylococcus carnosus* |
| SBP00107 | Shallot | *Staphylococcus cohnii* |
| SBP00107 | Shallot | *Staphylococcus condimenti* |
| SBP00107 | Shallot | *Staphylococcus epidermidis* |
| SBP00107 | Shallot | *Staphylococcus equorum* |
| SBP00107 | Shallot | *Staphylococcus haemolyticus* |
| SBP00107 | Shallot | *Staphylococcus hominis* |
| SBP00107 | Shallot | *Staphylococcus kloosii* |
| SBP00107 | Shallot | *Staphylococcus lugdunensis* |
| SBP00107 | Shallot | *Staphylococcus muscae* |
| SBP00107 | Shallot | *Staphylococcus nepalensis* |
| SBP00107 | Shallot | *Staphylococcus saprophyticus* |
| SBP00107 | Shallot | *Staphylococcus schleiferi* |
| SBP00107 | Shallot | *Staphylococcus sciuri* |
| SBP00107 | Shallot | *Staphylococcus simiae* |
| SBP00107 | Shallot | *Staphylococcus stepanovicii* |
| SBP00107 | Shallot | *Staphylococcus succinus* |
| SBP00107 | Shallot | *Staphylococcus xylosus* |
| SBP00107 | Shallot | *Stenotrophomonas maltophilia* |
| SBP00107 | Shallot | *Stenotrophomonas rhizophila* |
| SBP00107 | Shallot | Strawberry vein banding virus |
| SBP00107 | Shallot | *Streptacidiphilus* sp. DSM 106435 |
| SBP00107 | Shallot | *Streptobacillus moniliformis* |
| SBP00107 | Shallot | *Streptococcus australis* |
| SBP00107 | Shallot | *Streptococcus dysgalactiae* |
| SBP00107 | Shallot | *Streptococcus equi* |
| SBP00107 | Shallot | *Streptococcus equinus* |
| SBP00107 | Shallot | *Streptococcus gordonii* |
| SBP00107 | Shallot | *Streptococcus mitis* |
| SBP00107 | Shallot | *Streptococcus mutans* |

TABLE 3-continued

List of species identified in each metagenomic sample of each SBP Sample

| SBP ID | SBP Host Common Name | Genus sp. |
|---|---|---|
| SBP00107 | Shallot | Streptococcus oralis |
| SBP00107 | Shallot | Streptococcus pneumoniae |
| SBP00107 | Shallot | Streptococcus pyogenes |
| SBP00107 | Shallot | Streptococcus ruminantium |
| SBP00107 | Shallot | Streptococcus salivarius |
| SBP00107 | Shallot | Streptococcus sp. HSISS1 |
| SBP00107 | Shallot | Streptococcus suis |
| SBP00107 | Shallot | Streptococcus thermophilus |
| SBP00107 | Shallot | Streptomyces asterosporus |
| SBP00107 | Shallot | Streptomyces clavuligerus |
| SBP00107 | Shallot | Streptomyces dengpaensis |
| SBP00107 | Shallot | Streptomyces fulvissimus |
| SBP00107 | Shallot | Streptomyces globisporus |
| SBP00107 | Shallot | Streptomyces globosus |
| SBP00107 | Shallot | Streptomyces griseorubiginosus |
| SBP00107 | Shallot | Streptomyces hundungensis |
| SBP00107 | Shallot | Streptomyces hygroscopicus |
| SBP00107 | Shallot | Streptomyces lydicus |
| SBP00107 | Shallot | Streptomyces malaysiensis |
| SBP00107 | Shallot | Streptomyces niveus |
| SBP00107 | Shallot | Streptomyces pristinaespiralis |
| SBP00107 | Shallot | Streptomyces reticuli |
| SBP00107 | Shallot | Streptomyces scabiei |
| SBP00107 | Shallot | Streptomyces sp. 3214.6 |
| SBP00107 | Shallot | Streptomyces sp. WAC 01529 |
| SBP00107 | Shallot | Sulfitobacter sp. AM1-D1 |
| SBP00107 | Shallot | Sulfitobacter sp. D7 |
| SBP00107 | Shallot | Sulfitobacter sp. SK012 |
| SBP00107 | Shallot | Sulfolobus islandicus |
| SBP00107 | Shallot | Sulfurihydrogenibium sp. YO3AOP1 |
| SBP00107 | Shallot | Sulfurimonas gotlandica |
| SBP00107 | Shallot | Sulfurisphaera tokodaii |
| SBP00107 | Shallot | Synechococcus phage ACG-2014c |
| SBP00107 | Shallot | Synechococcus sp. PCC 7502 |
| SBP00107 | Shallot | Tabrizicola sp. K13M18 |
| SBP00107 | Shallot | Tamlana sp. UJ94 |
| SBP00107 | Shallot | Tatlockia micdadei |
| SBP00107 | Shallot | Tenacibaculum jejuense |
| SBP00107 | Shallot | Tenacibaculum maritimum |
| SBP00107 | Shallot | Tenacibaculum mesophilum |
| SBP00107 | Shallot | Tenacibaculum sp. DSM 106434 |
| SBP00107 | Shallot | Tenacibaculum sp. SZ-18 |
| SBP00107 | Shallot | Tenacibaculum todarodis |
| SBP00107 | Shallot | Tepidanaerobacter acetatoxydans |
| SBP00107 | Shallot | Tetragenococcus halophilus |
| SBP00107 | Shallot | Tetragenococcus osmophilus |
| SBP00107 | Shallot | Thalassolituus oleivorans |
| SBP00107 | Shallot | Thalassospira marina |
| SBP00107 | Shallot | Thermacetogenium phaeum |
| SBP00107 | Shallot | Thermincola potens |
| SBP00107 | Shallot | Thermoanaerobacter italicus |
| SBP00107 | Shallot | Thermoanaerobacterales bacterium SK-G1 |
| SBP00107 | Shallot | Thermoanaerobacterium sp. RBIITD |
| SBP00107 | Shallot | Thermoanaerobacterium thermosaccharolyticum |
| SBP00107 | Shallot | Thermobacillus composti |
| SBP00107 | Shallot | Thermococcus barophilus |
| SBP00107 | Shallot | Thermodesulfobium acidiphilum |
| SBP00107 | Shallot | Thermosipho africanus |
| SBP00107 | Shallot | Thermosipho melanesiensis |
| SBP00107 | Shallot | Thermosulfidibacter takaii |
| SBP00107 | Shallot | Thermotoga caldifontis |
| SBP00107 | Shallot | Thiomonas sp. X19 |
| SBP00107 | Shallot | Treponema denticola |
| SBP00107 | Shallot | Treponema succinifaciens |
| SBP00107 | Shallot | Trichodesmium erythraeum |
| SBP00107 | Shallot | Trichoplusia ni ascovirus 2c |
| SBP00107 | Shallot | Trichormus azollae |
| SBP00107 | Shallot | Trichormus variabilis |
| SBP00107 | Shallot | Tropheryma whipplei |
| SBP00107 | Shallot | Trueperella pyogenes |
| SBP00107 | Shallot | Turicibacter sp. H121 |
| SBP00107 | Shallot | Variibacter gotjawalensis |
| SBP00107 | Shallot | Variovorax paradoxus |
| SBP00107 | Shallot | Veillonella parvula |
| SBP00107 | Shallot | Verrucosispora maris |
| SBP00107 | Shallot | Vibrio aphrogenes |

TABLE 3-continued

List of species identified in each metagenomic sample of each SBP Sample

| SBP ID | SBP Host Common Name | Genus sp. |
|---|---|---|
| SBP00107 | Shallot | *Vibrio azureus* |
| SBP00107 | Shallot | *Vibrio breoganii* |
| SBP00107 | Shallot | *Vibrio campbellii* |
| SBP00107 | Shallot | *Vibrio cholerae* |
| SBP00107 | Shallot | *Vibrio coralliilyticus* |
| SBP00107 | Shallot | *Vibrio gazogenes* |
| SBP00107 | Shallot | *Vibrio harveyi* |
| SBP00107 | Shallot | *Vibrio mediterranei* |
| SBP00107 | Shallot | *Vibrio parahaemolyticus* |
| SBP00107 | Shallot | *Vibrio rotiferianus* |
| SBP00107 | Shallot | *Vibrio scophthalmi* |
| SBP00107 | Shallot | *Vibrio splendidus* |
| SBP00107 | Shallot | *Vibrio tritonius* |
| SBP00107 | Shallot | *Vibrio vulnificus* |
| SBP00107 | Shallot | *Victivallales bacterium* CCUG 44730 |
| SBP00107 | Shallot | *Virgibacillus halodenitrificans* |
| SBP00107 | Shallot | *Virgibacillus necropolis* |
| SBP00107 | Shallot | *Virgibacillus phasianinus* |
| SBP00107 | Shallot | *Virgibacillus* sp. 6R |
| SBP00107 | Shallot | *Weissella koreensis* |
| SBP00107 | Shallot | *Wenyingzhuangia fucanilytica* |
| SBP00107 | Shallot | *Winogradskyella* sp. J14-2 |
| SBP00107 | Shallot | *Winogradskyella* sp. PC-19 |
| SBP00107 | Shallot | *Winogradskyella* sp. PG-2 |
| SBP00107 | Shallot | *Winogradskyella* sp. RHA_55 |
| SBP00107 | Shallot | *Xanthomonas campestris* |
| SBP00107 | Shallot | *Xenorhabdus poinarii* |
| SBP00107 | Shallot | *Yersinia enterocolitica* |
| SBP00107 | Shallot | *Yersinia frederiksenii* |
| SBP00107 | Shallot | *Yersinia pseudotuberculosis* |
| SBP00107 | Shallot | *Yersinia ruckeri* |
| SBP00107 | Shallot | *Zobellia galactanivorans* |
| SBP00107 | Shallot | *Zunongwangia profunda* |
| SBP00107 | Shallot | *Zymomonas mobilis* |
| SBP00108 | Cilantro | [*Brevibacterium*] *frigoritolerans* |
| SBP00108 | Cilantro | *Acetobacter orientalis* |
| SBP00108 | Cilantro | *Acholeplasma oculi* |
| SBP00108 | Cilantro | *Achromobacter spanius* |
| SBP00108 | Cilantro | *Acidovorax* sp. JS42 |
| SBP00108 | Cilantro | *Acidovorax* sp. KKS102 |
| SBP00108 | Cilantro | *Acinetobacter baumannii* |
| SBP00108 | Cilantro | *Acinetobacter calcoaceticus* |
| SBP00108 | Cilantro | *Acinetobacter equi* |
| SBP00108 | Cilantro | *Acinetobacter guillouiae* |
| SBP00108 | Cilantro | *Acinetobacter haemolyticus* |
| SBP00108 | Cilantro | *Acinetobacter johnsonii* |
| SBP00108 | Cilantro | *Acinetobacter junii* |
| SBP00108 | Cilantro | *Acinetobacter Iwoffii* |
| SBP00108 | Cilantro | *Acinetobacter nosocomialis* |
| SBP00108 | Cilantro | *Acinetobacter pittii* |
| SBP00108 | Cilantro | *Acinetobacter* sp. TGL-Y2 |
| SBP00108 | Cilantro | *Acinetobacter* sp. TTH0-4 |
| SBP00108 | Cilantro | *Acinetobacter* sp. WCHAc010034 |
| SBP00108 | Cilantro | *Acinetobacter ursingii* |
| SBP00108 | Cilantro | *Acinetobacter wuhouensis* |
| SBP00108 | Cilantro | *Actinomyces* sp. 299 |
| SBP00108 | Cilantro | *Actinomyces* sp. oral taxon 414 |
| SBP00108 | Cilantro | *Actinoplanes* sp. ATCC 31351 |
| SBP00108 | Cilantro | *Aerococcus viridans* |
| SBP00108 | Cilantro | *Aeromonas* sp. ASNIH1 |
| SBP00108 | Cilantro | *Agrobacterium* sp. |
| SBP00108 | Cilantro | *Agrobacterium tumefaciens* |
| SBP00108 | Cilantro | *Akkermansia muciniphila* |
| SBP00108 | Cilantro | *Alcaligenes faecalis* |
| SBP00108 | Cilantro | *Aliivibrio fischeri* |
| SBP00108 | Cilantro | *Aliivibrio wodanis* |
| SBP00108 | Cilantro | *Alteromonas mediterranea* |
| SBP00108 | Cilantro | Angelica bushy stunt virus |
| SBP00108 | Cilantro | *Anoxybacter fermentans* |
| SBP00108 | Cilantro | *Aquiflexum balticum* |
| SBP00108 | Cilantro | *Aquimarina* sp. AD10 |
| SBP00108 | Cilantro | *Arachidicoccus* sp. KIS59-12 |
| SBP00108 | Cilantro | *Archaeoglobus veneficus* |
| SBP00108 | Cilantro | *Arcobacter anaerophilus* |
| SBP00108 | Cilantro | *Arcobacter butzleri* |
| SBP00108 | Cilantro | *Arcobacter ellisii* |

TABLE 3-continued

List of species identified in each metagenomic sample of each SBP Sample

| SBP ID | SBP Host Common Name | Genus sp. |
|---|---|---|
| SBP00108 | Cilantro | *Arcobacter pacificus* |
| SBP00108 | Cilantro | *Arcobacter* sp. LPB0137 |
| SBP00108 | Cilantro | *Arcobacter suis* |
| SBP00108 | Cilantro | *Arthrobacter* sp. ERGS1:01 |
| SBP00108 | Cilantro | *Arthrobacter* sp. PGP41 |
| SBP00108 | Cilantro | *Asticcacaulis excentricus* |
| SBP00108 | Cilantro | *Azospirillum brasilense* |
| SBP00108 | Cilantro | *Azospirillum* sp. TSA2s |
| SBP00108 | Cilantro | *Bacillus atrophaeus* |
| SBP00108 | Cilantro | *Bacillus butanolivorans* |
| SBP00108 | Cilantro | *Bacillus cereus* |
| SBP00108 | Cilantro | *Bacillus coagulans* |
| SBP00108 | Cilantro | *Bacillus glycinifermentans* |
| SBP00108 | Cilantro | *Bacillus halotolerans* |
| SBP00108 | Cilantro | *Bacillus infantis* |
| SBP00108 | Cilantro | *Bacillus kochii* |
| SBP00108 | Cilantro | *Bacillus krulwichiae* |
| SBP00108 | Cilantro | *Bacillus megaterium* |
| SBP00108 | Cilantro | *Bacillus mycoides* |
| SBP00108 | Cilantro | *Bacillus paralicheniformis* |
| SBP00108 | Cilantro | *Bacillus pumilus* |
| SBP00108 | Cilantro | *Bacillus safensis* |
| SBP00108 | Cilantro | *Bacillus* sp. (in: Bacteria) |
| SBP00108 | Cilantro | *Bacillus* sp. FJAT-18017 |
| SBP00108 | Cilantro | *Bacillus* sp. X1(2014) |
| SBP00108 | Cilantro | *Bacillus* sp. Y1 |
| SBP00108 | Cilantro | *Bacillus subtilis* |
| SBP00108 | Cilantro | *Bacillus thuringiensis* |
| SBP00108 | Cilantro | *Bacillus weihaiensis* |
| SBP00108 | Cilantro | *Bacteroides cellulosilyticus* |
| SBP00108 | Cilantro | *Bacteroides coprosuis* |
| SBP00108 | Cilantro | *Bacteroides ovatus* |
| SBP00108 | Cilantro | *Bacteroides thetaiotaomicron* |
| SBP00108 | Cilantro | *Bartonella grahamii* |
| SBP00108 | Cilantro | *Bdellovibrio bacteriovorus* |
| SBP00108 | Cilantro | *Bernardetia litoralis* |
| SBP00108 | Cilantro | *Bifidobacterium dentium* |
| SBP00108 | Cilantro | *Brachyspira intermedia* |
| SBP00108 | Cilantro | *Bradyrhizobium diazoefficiens* |
| SBP00108 | Cilantro | *Bradyrhizobium erythrophlei* |
| SBP00108 | Cilantro | *Bradyrhizobium guangxiense* |
| SBP00108 | Cilantro | *Bradyrhizobium lablabi* |
| SBP00108 | Cilantro | *Bradyrhizobium* sp. BTAi1 |
| SBP00108 | Cilantro | *Bradyrhizobium* sp. CCGE-LA001 |
| SBP00108 | Cilantro | *Bradyrhizobium* sp. S23321 |
| SBP00108 | Cilantro | *Bradyrhizobium* sp. SK17 |
| SBP00108 | Cilantro | *Brevibacillus brevis* |
| SBP00108 | Cilantro | *Brevibacillus laterosporus* |
| SBP00108 | Cilantro | *Brevundimonas* sp. GW460-12-10-14-LB2 |
| SBP00108 | Cilantro | *Buchnera aphidicola* |
| SBP00108 | Cilantro | *Burkholderia diffusa* |
| SBP00108 | Cilantro | *Burkholderia* sp. LA-2-3-30-S1-D2 |
| SBP00108 | Cilantro | *Burkholderia ubonensis* |
| SBP00108 | Cilantro | *Campylobacter avium* |
| SBP00108 | Cilantro | *Campylobacter coli* |
| SBP00108 | Cilantro | *Campylobacter jejuni* |
| SBP00108 | Cilantro | *Campylobacter lari* |
| SBP00108 | Cilantro | *Campylobacter* sp. NCTC 13003 |
| SBP00108 | Cilantro | *Campylobacter sputorum* |
| SBP00108 | Cilantro | *Candidatus Endolissoclinum faulkneri* |
| SBP00108 | Cilantro | *Candidatus Enterovibrio luxaltus* |
| SBP00108 | Cilantro | *Candidatus Planktophila limnetica* |
| SBP00108 | Cilantro | *Candidatus Rickettsiella viridis* |
| SBP00108 | Cilantro | *Capnocytophaga canimorsus* |
| SBP00108 | Cilantro | Carnation etched ring virus |
| SBP00108 | Cilantro | *Carnobacterium divergens* |
| SBP00108 | Cilantro | *Cellulophaga lytica* |
| SBP00108 | Cilantro | *Chromobacterium violaceum* |
| SBP00108 | Cilantro | *Chryseobacterium balustinum* |
| SBP00108 | Cilantro | *Chryseobacterium indoltheticum* |
| SBP00108 | Cilantro | *Chryseobacterium lactis* |
| SBP00108 | Cilantro | *Chryseobacterium shandongense* |
| SBP00108 | Cilantro | *Chryseobacterium taklimakanense* |
| SBP00108 | Cilantro | *Citrobacter rodentium* |
| SBP00108 | Cilantro | *Citrobacter werkmanii* |
| SBP00108 | Cilantro | *Clostridiaceae bacterium* 14S0207 |

TABLE 3-continued

List of species identified in each metagenomic sample of each SBP Sample

| SBP ID | SBP Host Common Name | Genus sp. |
|---|---|---|
| SBP00108 | Cilantro | *Clostridioides difficile* |
| SBP00108 | Cilantro | *Clostridium baratii* |
| SBP00108 | Cilantro | *Clostridium beijerinckii* |
| SBP00108 | Cilantro | *Clostridium botulinum* |
| SBP00108 | Cilantro | *Clostridium butyricum* |
| SBP00108 | Cilantro | *Clostridium cellulovorans* |
| SBP00108 | Cilantro | *Clostridium estertheticum* |
| SBP00108 | Cilantro | *Clostridium isatidis* |
| SBP00108 | Cilantro | *Clostridium kluyveri* |
| SBP00108 | Cilantro | *Clostridium pasteurianum* |
| SBP00108 | Cilantro | *Clostridium perfringens* |
| SBP00108 | Cilantro | *Clostridium saccharobutylicum* |
| SBP00108 | Cilantro | *Clostridium scatologenes* |
| SBP00108 | Cilantro | *Clostridium* sp. AWRP |
| SBP00108 | Cilantro | *Clostridium* sp. DL-VIII |
| SBP00108 | Cilantro | *Clostridium* sp. JN-1 |
| SBP00108 | Cilantro | *Clostridium tyrobutyricum* |
| SBP00108 | Cilantro | *Collinsella aerofaciens* |
| SBP00108 | Cilantro | *Colwellia* sp. Arc7-635 |
| SBP00108 | Cilantro | *Colwellia* sp. MT41 |
| SBP00108 | Cilantro | *Corynebacterium camporealensis* |
| SBP00108 | Cilantro | *Corynebacterium* sp. ATCC 6931 |
| SBP00108 | Cilantro | *Cupriavidus metallidurans* |
| SBP00108 | Cilantro | *Cupriavidus taiwanensis* |
| SBP00108 | Cilantro | *cyanobacterium* endosymbiont of *Rhopalodia gibberula* |
| SBP00108 | Cilantro | *Cyanothece* sp. ATCC 51142 |
| SBP00108 | Cilantro | *Cyanothece* sp. PCC 7822 |
| SBP00108 | Cilantro | *Cylindrospermum stagnale* |
| SBP00108 | Cilantro | *Cyprinid* herpesvirus 2 |
| SBP00108 | Cilantro | *Deferribacter desulfuricans* |
| SBP00108 | Cilantro | *Deinococcus gobiensis* |
| SBP00108 | Cilantro | *Delftia* sp. |
| SBP00108 | Cilantro | *Delftia* sp. Cs1-4 |
| SBP00108 | Cilantro | *Desulfobacula toluolica* |
| SBP00108 | Cilantro | *Desulfomonile tiedjei* |
| SBP00108 | Cilantro | *Desulfotalea psychrophila* |
| SBP00108 | Cilantro | *Desulfovibrio magneticus* |
| SBP00108 | Cilantro | *Dickeya chrysanthemi* |
| SBP00108 | Cilantro | *Dickeya dianthicola* |
| SBP00108 | Cilantro | *Dolichospermum compactum* |
| SBP00108 | Cilantro | *Draconibacterium orientale* |
| SBP00108 | Cilantro | *Echinicola rosea* |
| SBP00108 | Cilantro | *Elizabethkingia anophelis* |
| SBP00108 | Cilantro | *Enterobacter cloacae* |
| SBP00108 | Cilantro | *Enterobacter hormaechei* |
| SBP00108 | Cilantro | *Enterobacter ludwigii* |
| SBP00108 | Cilantro | *Enterococcus avium* |
| SBP00108 | Cilantro | *Enterococcus faecium* |
| SBP00108 | Cilantro | *Enterococcus mundtil* |
| SBP00108 | Cilantro | *Erysipelothrix larvae* |
| SBP00108 | Cilantro | *Escherichia albertii* |
| SBP00108 | Cilantro | *Escherichia coli* |
| SBP00108 | Cilantro | *Exiguobacterium antarcticum* |
| SBP00108 | Cilantro | *Exiguobacterium sibiricum* |
| SBP00108 | Cilantro | *Exiguobacterium* sp. MH3 |
| SBP00108 | Cilantro | *Ezakiella massiliensis* |
| SBP00108 | Cilantro | *Ferroglobus placidus* |
| SBP00108 | Cilantro | *Fischerella* sp. NIES-4106 |
| SBP00108 | Cilantro | *Flammeovirga* sp. MY04 |
| SBP00108 | Cilantro | *Flavisolibacter tropicus* |
| SBP00108 | Cilantro | *Flavivirga eckloniae* |
| SBP00108 | Cilantro | *Flavobacteriaceae bacterium* UJ101 |
| SBP00108 | Cilantro | *Flavobacterium anhuiense* |
| SBP00108 | Cilantro | *Flavobacterium columnare* |
| SBP00108 | Cilantro | *Flavobacterium crocinum* |
| SBP00108 | Cilantro | *Flavobacterium johnsoniae* |
| SBP00108 | Cilantro | *Flavobacterium* sp. 140616W15 |
| SBP00108 | Cilantro | *Flavobacterium* sp. HYN0086 |
| SBP00108 | Cilantro | *Francisella* sp. TX077308 |
| SBP00108 | Cilantro | *Fusobacterium nucleatum* |
| SBP00108 | Cilantro | *Fusobacterium periodonticum* |
| SBP00108 | Cilantro | *Gardnerella vaginalis* |
| SBP00108 | Cilantro | *Geobacillus* sp. WCH70 |
| SBP00108 | Cilantro | *Geobacillus thermocatenulatus* |
| SBP00108 | Cilantro | *Geobacter daltonii* |

TABLE 3-continued

List of species identified in each metagenomic sample of each SBP Sample

| SBP ID | SBP Host Common Name | Genus sp. |
|---|---|---|
| SBP00108 | Cilantro | *Glutamicibacter creatinolyticus* |
| SBP00108 | Cilantro | *Gramella forsetii* |
| SBP00108 | Cilantro | *Gramella salexigens* |
| SBP00108 | Cilantro | *Granulicella tundricola* |
| SBP00108 | Cilantro | *Haemophilus influenzae* |
| SBP00108 | Cilantro | *Haloarcula taiwanensis* |
| SBP00108 | Cilantro | *Halobacteriovorax marinus* |
| SBP00108 | Cilantro | *Halocynthia phage* JM-2012 |
| SBP00108 | Cilantro | *Halomonas aestuarii* |
| SBP00108 | Cilantro | *Halomonas subglaciescola* |
| SBP00108 | Cilantro | *Helicobacter hepaticus* |
| SBP00108 | Cilantro | *Helicobacter pullorum* |
| SBP00108 | Cilantro | *Helicobacter pylori* |
| SBP00108 | Cilantro | *Herbaspirillum rubrisubalbicans* |
| SBP00108 | Cilantro | *Histophilus somni* |
| SBP00108 | Cilantro | Human betaherpesvirus 5 |
| SBP00108 | Cilantro | *Hungateiclostridium clariflavum* |
| SBP00108 | Cilantro | *Hydrogenophaga* sp. NH-16 |
| SBP00108 | Cilantro | *Hydromonas* sp. F02 |
| SBP00108 | Cilantro | *Hymenobacter swuensis* |
| SBP00108 | Cilantro | *Indioceanicola profundi* |
| SBP00108 | Cilantro | *Janibacter limosus* |
| SBP00108 | Cilantro | *Janthinobacterium agaricidamnosum* |
| SBP00108 | Cilantro | *Janthinobacterium svalbardensis* |
| SBP00108 | Cilantro | *Jeotgalibacillus malaysiensis* |
| SBP00108 | Cilantro | *Kangiella koreensis* |
| SBP00108 | Cilantro | *Kingella kingae* |
| SBP00108 | Cilantro | *Klebsiella oxytoca* |
| SBP00108 | Cilantro | *Klebsiella pneumoniae* |
| SBP00108 | Cilantro | *Klebsiella* sp. MSal |
| SBP00108 | Cilantro | *Kordia* sp. SMS9 |
| SBP00108 | Cilantro | *Lacinutrix* sp. 5H-3-7-4 |
| SBP00108 | Cilantro | *Lactobacillus hokkaidonensis* |
| SBP00108 | Cilantro | *Lactobacillus murinus* |
| SBP00108 | Cilantro | *Lactobacillus parabuchneri* |
| SBP00108 | Cilantro | *Lactobacillus reuteri* |
| SBP00108 | Cilantro | *Lactococcus lactis* |
| SBP00108 | Cilantro | *Lactococcus* sp. 1JSPR-7 |
| SBP00108 | Cilantro | *Leadbetterella byssophila* |
| SBP00108 | Cilantro | *Legionella cherrii* |
| SBP00108 | Cilantro | *Legionella pneumophila* |
| SBP00108 | Cilantro | *Lentibacillus amyloliquefaciens* |
| SBP00108 | Cilantro | *Leptotrichia buccalis* |
| SBP00108 | Cilantro | *Leptotrichia* sp. oral taxon 498 |
| SBP00108 | Cilantro | *Leuconostoc gelidum* |
| SBP00108 | Cilantro | *Leuconostoc mesenteroides* |
| SBP00108 | Cilantro | *Luteimonas* sp. 83-4 |
| SBP00108 | Cilantro | *Lutibacter* sp. LPB0138 |
| SBP00108 | Cilantro | *Lysinibacillus* sp. Marseille-P5727 |
| SBP00108 | Cilantro | *Lysinibacillus sphaericus* |
| SBP00108 | Cilantro | *Lysobacter antibioticus* |
| SBP00108 | Cilantro | *Lysobacter enzymogenes* |
| SBP00108 | Cilantro | *Marinifilaceae bacterium* SPP2 |
| SBP00108 | Cilantro | *Massilia albidiflava* |
| SBP00108 | Cilantro | *Massilia armeniaca* |
| SBP00108 | Cilantro | *Massilia lutea* |
| SBP00108 | Cilantro | *Massilia oculi* |
| SBP00108 | Cilantro | *Massilia putida* |
| SBP00108 | Cilantro | *Massilia* sp. NR 4-1 |
| SBP00108 | Cilantro | *Massilia* sp. WG5 |
| SBP00108 | Cilantro | *Massilia* sp. YMA4 |
| SBP00108 | Cilantro | *Massilia umbonata* |
| SBP00108 | Cilantro | *Massilia violaceinigra* |
| SBP00108 | Cilantro | *Mesoplasma florum* |
| SBP00108 | Cilantro | *Mesorhizobium* sp. M9A.F.Ca.ET.002.03.1.2 |
| SBP00108 | Cilantro | *Methanobrevibacter millerae* |
| SBP00108 | Cilantro | *Methanobrevibacter olleyae* |
| SBP00108 | Cilantro | *Methanobrevibacter smithii* |
| SBP00108 | Cilantro | *Methanocella conradil* |
| SBP00108 | Cilantro | *Methanococcus maripaludis* |
| SBP00108 | Cilantro | *Methanohalobium evestigatum* |
| SBP00108 | Cilantro | *Methanosalsum zhilinae* |
| SBP00108 | Cilantro | *Methylobacterium brachiatum* |
| SBP00108 | Cilantro | *Methylomicrobium buryatense* |
| SBP00108 | Cilantro | *Methylomonas koyamae* |
| SBP00108 | Cilantro | *Methylomonas methanica* |

TABLE 3-continued

List of species identified in each metagenomic sample of each SBP Sample

| SBP ID | SBP Host Common Name | Genus sp. |
| --- | --- | --- |
| SBP00108 | Cilantro | *Methylophilus* sp. TWE2 |
| SBP00108 | Cilantro | *Methylorubrum extorquens* |
| SBP00108 | Cilantro | *Methylorubrum populi* |
| SBP00108 | Cilantro | *Microbacterium foliorum* |
| SBP00108 | Cilantro | *Microbacterium* sp. ABRD_28 |
| SBP00108 | Cilantro | *Microbacterium* sp. BH-3-3-3 |
| SBP00108 | Cilantro | *Microbacterium testaceum* |
| SBP00108 | Cilantro | *Microcystis aeruginosa* |
| SBP00108 | Cilantro | *Micromonospora aurantiaca* |
| SBP00108 | Cilantro | *Microvirga* sp. 17 mud 1-3 |
| SBP00108 | Cilantro | *Moorea producens* |
| SBP00108 | Cilantro | *Moraxella catarrhalis* |
| SBP00108 | Cilantro | *Morganella morganii* |
| SBP00108 | Cilantro | *Moritella viscosa* |
| SBP00108 | Cilantro | *Mucilaginibacter gotjawali* |
| SBP00108 | Cilantro | *Mucilaginibacter* sp. PAMC 26640 |
| SBP00108 | Cilantro | *Mycoplasma crocodyli* |
| SBP00108 | Cilantro | *Mycoplasma flocculare* |
| SBP00108 | Cilantro | *Mycoplasma phocidae* |
| SBP00108 | Cilantro | *Myxococcus xanthus* |
| SBP00108 | Cilantro | *Nitrosospira multiformis* |
| SBP00108 | Cilantro | *Nocardia brasiliensis* |
| SBP00108 | Cilantro | *Nodularia spurigena* |
| SBP00108 | Cilantro | *Nonlabens* sp. MIC269 |
| SBP00108 | Cilantro | *Nonomuraea* sp. ATCC 55076 |
| SBP00108 | Cilantro | *Nostoc flagelliforme* |
| SBP00108 | Cilantro | *Nostoc piscinale* |
| SBP00108 | Cilantro | *Nostoc* sp. NIES-3756 |
| SBP00108 | Cilantro | *Nostoc* sp. PCC 7524 |
| SBP00108 | Cilantro | *Oceanicoccus sagamiensis* |
| SBP00108 | Cilantro | *Oceanithermus profundus* |
| SBP00108 | Cilantro | *Oceanobacillus iheyensis* |
| SBP00108 | Cilantro | *Odoribacter splanchnicus* |
| SBP00108 | Cilantro | *Oleiphilus messinensis* |
| SBP00108 | Cilantro | *Orgi virus* |
| SBP00108 | Cilantro | *Oscillatoria nigro-viridis* |
| SBP00108 | Cilantro | *Ottowia oryzae* |
| SBP00108 | Cilantro | *Paenibacillus baekrokdamisoli* |
| SBP00108 | Cilantro | *Paenibacillus graminis* |
| SBP00108 | Cilantro | *Paenibacillus mucilaginosus* |
| SBP00108 | Cilantro | *Paenibacillus polymyxa* |
| SBP00108 | Cilantro | *Paenibacillus* sp. BIHB4019 |
| SBP00108 | Cilantro | *Paenibacillus* sp. FSL H7-0357 |
| SBP00108 | Cilantro | *Paenibacillus* sp. JDR-2 |
| SBP00108 | Cilantro | *Paenibacillus swuensis* |
| SBP00108 | Cilantro | *Pandoraea oxalativorans* |
| SBP00108 | Cilantro | *Pandoravirus inopinatum* |
| SBP00108 | Cilantro | *Pandoravirus macleodensis* |
| SBP00108 | Cilantro | *Pannonibacter phragmitetus* |
| SBP00108 | Cilantro | *Pantoea agglomerans* |
| SBP00108 | Cilantro | *Pantoea vagans* |
| SBP00108 | Cilantro | *Parabacteroides distasonis* |
| SBP00108 | Cilantro | *Paracoccus* sp. Arc7-R13 |
| SBP00108 | Cilantro | *Paracoccus zhejiangensis* |
| SBP00108 | Cilantro | *Paraglaciecola psychrophila* |
| SBP00108 | Cilantro | *Pasteurella multocida* |
| SBP00108 | Cilantro | *Pectobacterium polaris* |
| SBP00108 | Cilantro | *Pedobacter ginsengisoli* |
| SBP00108 | Cilantro | *Pedobacter* sp. PACM 27299 |
| SBP00108 | Cilantro | *Pelobacter propionicus* |
| SBP00108 | Cilantro | *Peptostreptococcaceae bacterium* oral taxon 929 |
| SBP00108 | Cilantro | *Phenylobacterium* sp. HYN0004 |
| SBP00108 | Cilantro | *Photobacterium damselae* |
| SBP00108 | Cilantro | *Photobacterium profundum* |
| SBP00108 | Cilantro | *Piscirickettsia salmonis* |
| SBP00108 | Cilantro | *Plautia stali* |
| SBP00108 | Cilantro | *Polaribacter reichenbachii* |
| SBP00108 | Cilantro | *Polaribacter* sp. KT 15 |
| SBP00108 | Cilantro | *Polaribacter* sp. SA4-10 |
| SBP00108 | Cilantro | *Polynucleobacter necessarius* |
| SBP00108 | Cilantro | *Polynucleobacter wuianus* |
| SBP00108 | Cilantro | *Pontibacter korlensis* |
| SBP00108 | Cilantro | *Prevotella intermedia* |
| SBP00108 | Cilantro | *Prochlorococcus marinus* |
| SBP00108 | Cilantro | *Prochlorococcus* sp. MIT 0801 |
| SBP00108 | Cilantro | *Proteus hauseri* |

TABLE 3-continued

List of species identified in each metagenomic sample of each SBP Sample

| SBP ID | SBP Host Common Name | Genus sp. |
|---|---|---|
| SBP00108 | Cilantro | *Proteus mirabilis* |
| SBP00108 | Cilantro | *Providencia rettgeri* |
| SBP00108 | Cilantro | *Providencia rustigianii* |
| SBP00108 | Cilantro | *Pseudarthrobacter phenanthrenivorans* |
| SBP00108 | Cilantro | *Pseudoalteromonas luteoviolacea* |
| SBP00108 | Cilantro | *Pseudoalteromonas rubra* |
| SBP00108 | Cilantro | *Pseudoalteromonas* sp. Xi13 |
| SBP00108 | Cilantro | *Pseudomonas chlororaphis* |
| SBP00108 | Cilantro | *Pseudomonas fluorescens* |
| SBP00108 | Cilantro | *Pseudomonas koreensis* |
| SBP00108 | Cilantro | *Pseudomonas orientalis* |
| SBP00108 | Cilantro | *Pseudomonas parafulva* |
| SBP00108 | Cilantro | *Pseudomonas poae* |
| SBP00108 | Cilantro | *Pseudomonas protegens* |
| SBP00108 | Cilantro | *Pseudomonas putida* |
| SBP00108 | Cilantro | *Pseudomonas rhizosphaerae* |
| SBP00108 | Cilantro | *Pseudomonas* sp. |
| SBP00108 | Cilantro | *Pseudomonas* sp. HLS-6 |
| SBP00108 | Cilantro | *Pseudomonas stutzeri* |
| SBP00108 | Cilantro | *Pseudomonas syringae* |
| SBP00108 | Cilantro | *Pseudomonas viridiflava* |
| SBP00108 | Cilantro | *Pseudopedobacter saltans* |
| SBP00108 | Cilantro | *Psychrobacter* sp. YP14 |
| SBP00108 | Cilantro | *Ralstonia insidiosa* |
| SBP00108 | Cilantro | *Ralstonia mannitolilytica* |
| SBP00108 | Cilantro | *Ralstonia pickettii* |
| SBP00108 | Cilantro | *Raoultella ornithinolytica* |
| SBP00108 | Cilantro | *Rathayibacter festucae* |
| SBP00108 | Cilantro | *Rhizobium leguminosarum* |
| SBP00108 | Cilantro | *Rhodobacter sphaeroides* |
| SBP00108 | Cilantro | *Rhodobiaceae bacterium* |
| SBP00108 | Cilantro | *Rhodococcus coprophilus* |
| SBP00108 | Cilantro | *Rhodococcus fascians* |
| SBP00108 | Cilantro | *Rhodococcus* sp. YL-1 |
| SBP00108 | Cilantro | *Rhodopseudomonas palustris* |
| SBP00108 | Cilantro | *Rhodothermaceae bacterium* |
| SBP00108 | Cilantro | *Rickettsiales* endosymbiont of *Stachyamoeba lipophora* |
| SBP00108 | Cilantro | *Riemerella anatipestifer* |
| SBP00108 | Cilantro | *Rothia mucilaginosa* |
| SBP00108 | Cilantro | *Rufibacter* sp. DG15C |
| SBP00108 | Cilantro | *Ruminococcaceae bacterium* CPB6 |
| SBP00108 | Cilantro | *Ruminococcus albus* |
| SBP00108 | Cilantro | *Rummeliibacillus stabekisii* |
| SBP00108 | Cilantro | *Runella* sp. SP2 |
| SBP00108 | Cilantro | *Saccharothrix espanaensis* |
| SBP00108 | Cilantro | *Salmonella enterica* |
| SBP00108 | Cilantro | *Scytonema* sp. NIES-4073 |
| SBP00108 | Cilantro | *Sediminicola* sp. YIK13 |
| SBP00108 | Cilantro | *Sediminispirochaeta smaragdinae* |
| SBP00108 | Cilantro | *Serratia marcescens* |
| SBP00108 | Cilantro | *Shewanella oneidensis* |
| SBP00108 | Cilantro | *Shewanella sediminis* |
| SBP00108 | Cilantro | *Shewanella* sp. ANA-3 |
| SBP00108 | Cilantro | *Shewanella* sp. FDAARGOS_354 |
| SBP00108 | Cilantro | *Sideroxydans lithotrophicus* |
| SBP00108 | Cilantro | *Simkania negevensis* |
| SBP00108 | Cilantro | *Simplicispira suum* |
| SBP00108 | Cilantro | *Singulisphaera acidiphila* |
| SBP00108 | Cilantro | *Solitalea canadensis* |
| SBP00108 | Cilantro | *Sorangium cellulosum* |
| SBP00108 | Cilantro | *Sphingobacterium* sp. 21 |
| SBP00108 | Cilantro | *Sphingobacterium thalpophilum* |
| SBP00108 | Cilantro | *Sphingobium amiense* |
| SBP00108 | Cilantro | *Sphingobium hydrophobicum* |
| SBP00108 | Cilantro | *Sphingobium yanoikuyae* |
| SBP00108 | Cilantro | *Sphingomonas koreensis* |
| SBP00108 | Cilantro | *Sphingomonas melonis* |
| SBP00108 | Cilantro | *Sphingomonas panacis* |
| SBP00108 | Cilantro | *Sphingomonas paucimobilis* |
| SBP00108 | Cilantro | *Sphingomonas sanxanigenens* |
| SBP00108 | Cilantro | *Sphingomonas* sp. AAP5 |
| SBP00108 | Cilantro | *Sphingomonas* sp. Cra20 |
| SBP00108 | Cilantro | *Sphingomonas* sp. FARSPH |
| SBP00108 | Cilantro | *Sphingomonas* sp. KC8 |
| SBP00108 | Cilantro | *Sphingomonas* sp. LK11 |

TABLE 3-continued

List of species identified in each metagenomic sample of each SBP Sample

| SBP ID | SBP Host Common Name | Genus sp. |
|---|---|---|
| SBP00108 | Cilantro | Sphingomonas sp. LM7 |
| SBP00108 | Cilantro | Sphingomonas sp. NIC1 |
| SBP00108 | Cilantro | Sphingomonas taxi |
| SBP00108 | Cilantro | Sphingorhabdus sp. M41 |
| SBP00108 | Cilantro | Spiroplasma diminutum |
| SBP00108 | Cilantro | Spiroplasma floricola |
| SBP00108 | Cilantro | Spiroplasma gladiatoris |
| SBP00108 | Cilantro | Spiroplasma turonicum |
| SBP00108 | Cilantro | Sporosarcina ureae |
| SBP00108 | Cilantro | Staphylococcus aureus |
| SBP00108 | Cilantro | Staphylococcus cohnii |
| SBP00108 | Cilantro | Staphylococcus felis |
| SBP00108 | Cilantro | Staphylococcus hominis |
| SBP00108 | Cilantro | Staphylococcus pasteuri |
| SBP00108 | Cilantro | Staphylococcus stepanovicii |
| SBP00108 | Cilantro | Stenotrophomonas maltophilia |
| SBP00108 | Cilantro | Stenotrophomonas sp. ESTM1D_MKCIP4_1 |
| SBP00108 | Cilantro | Stenotrophomonas sp. G4 |
| SBP00108 | Cilantro | Streptococcus gordonii |
| SBP00108 | Cilantro | Streptococcus iniae |
| SBP00108 | Cilantro | Streptococcus lutetiensis |
| SBP00108 | Cilantro | Streptococcus mitis |
| SBP00108 | Cilantro | Streptococcus mutans |
| SBP00108 | Cilantro | Streptococcus pyogenes |
| SBP00108 | Cilantro | Streptococcus sanguinis |
| SBP00108 | Cilantro | Streptococcus sobrinus |
| SBP00108 | Cilantro | Streptococcus suis |
| SBP00108 | Cilantro | Streptococcus thermophilus |
| SBP00108 | Cilantro | Streptococcus troglodytae |
| SBP00108 | Cilantro | Streptococcus urinalis |
| SBP00108 | Cilantro | Streptomyces hundungensis |
| SBP00108 | Cilantro | Streptomyces lydicus |
| SBP00108 | Cilantro | Streptomyces niveus |
| SBP00108 | Cilantro | Streptomyces olivoreticuli |
| SBP00108 | Cilantro | Streptomyces sp. 11-1-2 |
| SBP00108 | Cilantro | Streptomyces sp. 3214.6 |
| SBP00108 | Cilantro | Streptomyces sp. 4F |
| SBP00108 | Cilantro | Streptomyces venezuelae |
| SBP00108 | Cilantro | Sulfolobus islandicus |
| SBP00108 | Cilantro | Sulfurimonas gotlandica |
| SBP00108 | Cilantro | Sulfurospirillum deleyianum |
| SBP00108 | Cilantro | Sulfurospirillum halorespirans |
| SBP00108 | Cilantro | Synechococcus sp. CC9605 |
| SBP00108 | Cilantro | Tamlana sp. UJ94 |
| SBP00108 | Cilantro | Tatlockia micdadei |
| SBP00108 | Cilantro | Tatumella citrea |
| SBP00108 | Cilantro | Tenacibaculum maritimum |
| SBP00108 | Cilantro | Tenacibaculum sp. SZ-18 |
| SBP00108 | Cilantro | Terriglobus saanensis |
| SBP00108 | Cilantro | Thermoclostridium stercorarium |
| SBP00108 | Cilantro | Thermomonospora curvata |
| SBP00108 | Cilantro | Thermotoga profunda |
| SBP00108 | Cilantro | Thiomicrospira aerophila |
| SBP00108 | Cilantro | Trichodesmium erythraeum |
| SBP00108 | Cilantro | Variovorax boronicumulans |
| SBP00108 | Cilantro | Variovorax paradoxus |
| SBP00108 | Cilantro | Variovorax sp. HW608 |
| SBP00108 | Cilantro | Variovorax sp. PMC12 |
| SBP00108 | Cilantro | Vibrio jasicida |
| SBP00108 | Cilantro | Vibrio parahaemolyticus |
| SBP00108 | Cilantro | Vibrio rotiferianus |
| SBP00108 | Cilantro | Vibrio tapetis |
| SBP00108 | Cilantro | Vibrio tritonius |
| SBP00108 | Cilantro | Vibrio tubiashii |
| SBP00108 | Cilantro | Vibrio vulnificus |
| SBP00108 | Cilantro | Virgibacillus necropolis |
| SBP00108 | Cilantro | Weissella cibaria |
| SBP00108 | Cilantro | Wigglesworthia glossinidia |
| SBP00108 | Cilantro | Winogradskyella sp. PC-19 |
| SBP00108 | Cilantro | Winogradskyella sp. PG-2 |
| SBP00108 | Cilantro | Xanthomonas citri |
| SBP00108 | Cilantro | Xenorhabdus hominickii |
| SBP00108 | Cilantro | Zhongshania aliphaticivorans |
| SBP00109 | Squash gourd | [Polyangium] brachysporum |
| SBP00109 | Squash gourd | [Polyangium] brachysporum |
| SBP00109 | Squash gourd | [Polyangium] brachysporum |

TABLE 3-continued

List of species identified in each metagenomic sample of each SBP Sample

| SBP ID | SBP Host Common Name | Genus sp. |
|---|---|---|
| SBP00109 | Squash gourd | [Polyangium] brachysporum |
| SBP00109 | Squash gourd | [Polyangium] brachysporum |
| SBP00109 | Squash gourd | [Polyangium] brachysporum |
| SBP00109 | Squash gourd | Achromobacter denitrificans |
| SBP00109 | Squash gourd | Achromobacter denitrificans |
| SBP00109 | Squash gourd | Achromobacter denitrificans |
| SBP00109 | Squash gourd | Achromobacter denitrificans |
| SBP00109 | Squash gourd | Achromobacter denitrificans |
| SBP00109 | Squash gourd | Achromobacter denitrificans |
| SBP00109 | Squash gourd | Achromobacter insolitus |
| SBP00109 | Squash gourd | Achromobacter insolitus |
| SBP00109 | Squash gourd | Achromobacter insolitus |
| SBP00109 | Squash gourd | Achromobacter insolitus |
| SBP00109 | Squash gourd | Achromobacter insolitus |
| SBP00109 | Squash gourd | Achromobacter insolitus |
| SBP00109 | Squash gourd | Achromobacter sp. B7 |
| SBP00109 | Squash gourd | Achromobacter sp. B7 |
| SBP00109 | Squash gourd | Achromobacter sp. B7 |
| SBP00109 | Squash gourd | Achromobacter sp. B7 |
| SBP00109 | Squash gourd | Achromobacter sp. B7 |
| SBP00109 | Squash gourd | Achromobacter sp. 87 |
| SBP00109 | Squash gourd | Achromobacter sp. MFA1 R4 |
| SBP00109 | Squash gourd | Achromobacter sp. MFA1 R4 |
| SBP00109 | Squash gourd | Achromobacter sp. MFA1 R4 |
| SBP00109 | Squash gourd | Achromobacter sp. MFA1 R4 |
| SBP00109 | Squash gourd | Achromobacter sp. MFA1 R4 |
| SBP00109 | Squash gourd | Achromobacter spanius |
| SBP00109 | Squash gourd | Achromobacter spanius |
| SBP00109 | Squash gourd | Achromobacter spanius |
| SBP00109 | Squash gourd | Achromobacter spanius |
| SBP00109 | Squash gourd | Achromobacter spanius |
| SBP00109 | Squash gourd | Achromobacter spanius |
| SBP00109 | Squash gourd | Achromobacter xylosoxidans |
| SBP00109 | Squash gourd | Achromobacter xylosoxidans |
| SBP00109 | Squash gourd | Achromobacter xylosoxidans |
| SBP00109 | Squash gourd | Achromobacter xylosoxidans |
| SBP00109 | Squash gourd | Achromobacter xylosoxidans |
| SBP00109 | Squash gourd | Achromobacter xylosoxidans |
| SBP00109 | Squash gourd | Acidovorax avenae |
| SBP00109 | Squash gourd | Acidovorax avenae |
| SBP00109 | Squash gourd | Acidovorax avenae |
| SBP00109 | Squash gourd | Acidovorax avenae |
| SBP00109 | Squash gourd | Acidovorax avenae |
| SBP00109 | Squash gourd | Acidovorax avenae |
| SBP00109 | Squash gourd | Acidovorax carolinensis |
| SBP00109 | Squash gourd | Acidovorax carolinensis |
| SBP00109 | Squash gourd | Acidovorax carolinensis |
| SBP00109 | Squash gourd | Acidovorax carolinensis |
| SBP00109 | Squash gourd | Acidovorax carolinensis |
| SBP00109 | Squash gourd | Acidovorax carolinensis |
| SBP00109 | Squash gourd | Acidovorax ebreus |
| SBP00109 | Squash gourd | Acidovorax ebreus |
| SBP00109 | Squash gourd | Acidovorax ebreus |
| SBP00109 | Squash gourd | Acidovorax ebreus |
| SBP00109 | Squash gourd | Acidovorax ebreus |
| SBP00109 | Squash gourd | Acidovorax ebreus |
| SBP00109 | Squash gourd | Acidovorax sp. 1608163 |
| SBP00109 | Squash gourd | Acidovorax sp. 1608163 |
| SBP00109 | Squash gourd | Acidovorax sp. 1608163 |
| SBP00109 | Squash gourd | Acidovorax sp. 1608163 |
| SBP00109 | Squash gourd | Acidovorax sp. 1608163 |
| SBP00109 | Squash gourd | Acidovorax sp. 1608163 |
| SBP00109 | Squash gourd | Acidovorax sp. JS42 |
| SBP00109 | Squash gourd | Acidovorax sp. JS42 |
| SBP00109 | Squash gourd | Acidovorax sp. JS42 |
| SBP00109 | Squash gourd | Acidovorax sp. JS42 |
| SBP00109 | Squash gourd | Acidovorax sp. JS42 |
| SBP00109 | Squash gourd | Acidovorax sp. JS42 |
| SBP00109 | Squash gourd | Acidovorax sp. KKS102 |
| SBP00109 | Squash gourd | Acidovorax sp. KKS102 |
| SBP00109 | Squash gourd | Acidovorax sp. KKS102 |
| SBP00109 | Squash gourd | Acidovorax sp. KKS102 |
| SBP00109 | Squash gourd | Acidovorax sp. KKS102 |
| SBP00109 | Squash gourd | Acidovorax sp. KKS102 |
| SBP00109 | Squash gourd | Acidovorax sp. T1 |

TABLE 3-continued

List of species identified in each metagenomic sample of each SBP Sample

| SBP ID | SBP Host Common Name | Genus sp. |
|---|---|---|
| SBP00109 | Squash gourd | *Acidovorax* sp. T1 |
| SBP00109 | Squash gourd | *Acidovorax* sp. T1 |
| SBP00109 | Squash gourd | *Acidovorax* sp. T1 |
| SBP00109 | Squash gourd | *Acidovorax* sp. T1 |
| SBP00109 | Squash gourd | *Acidovorax* sp. T1 |
| SBP00109 | Squash gourd | *Acinetobacter baumannii* |
| SBP00109 | Squash gourd | *Acinetobacter baumannii* |
| SBP00109 | Squash gourd | *Acinetobacter baumannii* |
| SBP00109 | Squash gourd | *Acinetobacter baumannii* |
| SBP00109 | Squash gourd | *Acinetobacter baumannii* |
| SBP00109 | Squash gourd | *Acinetobacter baumannii* |
| SBP00109 | Squash gourd | *Acinetobacter johnsonii* |
| SBP00109 | Squash gourd | *Acinetobacter johnsonii* |
| SBP00109 | Squash gourd | *Acinetobacter johnsonii* |
| SBP00109 | Squash gourd | *Acinetobacter johnsonii* |
| SBP00109 | Squash gourd | *Acinetobacter johnsonii* |
| SBP00109 | Squash gourd | *Acinetobacter johnsonii* |
| SBP00109 | Squash gourd | *Actinoalloteichus hymeniacidonis* |
| SBP00109 | Squash gourd | *Actinoalloteichus hymeniacidonis* |
| SBP00109 | Squash gourd | *Actinoalloteichus hymeniacidonis* |
| SBP00109 | Squash gourd | *Actinoalloteichus hymeniacidonis* |
| SBP00109 | Squash gourd | *Actinoalloteichus hymeniacidonis* |
| SBP00109 | Squash gourd | *Actinoalloteichus hymeniacidonis* |
| SBP00109 | Squash gourd | *Actinoalloteichus* sp. AHMU CJ021 |
| SBP00109 | Squash gourd | *Actinoalloteichus* sp. AHMU CJ021 |
| SBP00109 | Squash gourd | *Actinoalloteichus* sp. AHMU CJ021 |
| SBP00109 | Squash gourd | *Actinoalloteichus* sp. AHMU CJ021 |
| SBP00109 | Squash gourd | *Actinoalloteichus* sp. AHMU CJ021 |
| SBP00109 | Squash gourd | *Actinoalloteichus* sp. AHMU CJ021 |
| SBP00109 | Squash gourd | *Actinomyces meyeri* |
| SBP00109 | Squash gourd | *Actinomyces meyeri* |
| SBP00109 | Squash gourd | *Actinomyces meyeri* |
| SBP00109 | Squash gourd | *Actinomyces meyeri* |
| SBP00109 | Squash gourd | *Actinomyces meyeri* |
| SBP00109 | Squash gourd | *Actinomyces meyeri* |
| SBP00109 | Squash gourd | *Actinomyces* sp. oral taxon 414 |
| SBP00109 | Squash gourd | *Actinomyces* sp. oral taxon 414 |
| SBP00109 | Squash gourd | *Actinomyces* sp. oral taxon 414 |
| SBP00109 | Squash gourd | *Actinomyces* sp. oral taxon 414 |
| SBP00109 | Squash gourd | *Actinomyces* sp. oral taxon 414 |
| SBP00109 | Squash gourd | *Actinomyces* sp. oral taxon 414 |
| SBP00109 | Squash gourd | *Actinoplanes* sp. OR16 |
| SBP00109 | Squash gourd | *Actinoplanes* sp. OR16 |
| SBP00109 | Squash gourd | *Actinoplanes* sp. OR16 |
| SBP00109 | Squash gourd | *Actinoplanes* sp. OR16 |
| SBP00109 | Squash gourd | *Actinoplanes* sp. OR16 |
| SBP00109 | Squash gourd | *Actinoplanes* sp. OR16 |
| SBP00109 | Squash gourd | *Actinoplanes teichomyceticus* |
| SBP00109 | Squash gourd | *Actinoplanes teichomyceticus* |
| SBP00109 | Squash gourd | *Actinoplanes teichomyceticus* |
| SBP00109 | Squash gourd | *Actinoplanes teichomyceticus* |
| SBP00109 | Squash gourd | *Actinoplanes teichomyceticus* |
| SBP00109 | Squash gourd | *Actinoplanes teichomyceticus* |
| SBP00109 | Squash gourd | *Aeromicrobium* sp. 592 |
| SBP00109 | Squash gourd | *Aeromicrobium* sp. 592 |
| SBP00109 | Squash gourd | *Aeromicrobium* sp. 592 |
| SBP00109 | Squash gourd | *Aeromicrobium* sp. 592 |
| SBP00109 | Squash gourd | *Aeromicrobium* sp. 592 |
| SBP00109 | Squash gourd | *Aeromicrobium* sp. 592 |
| SBP00109 | Squash gourd | *Aeromonas media* |
| SBP00109 | Squash gourd | *Aeromonas media* |
| SBP00109 | Squash gourd | *Aeromonas media* |
| SBP00109 | Squash gourd | *Aeromonas media* |
| SBP00109 | Squash gourd | *Aeromonas media* |
| SBP00109 | Squash gourd | *Aeromonas media* |
| SBP00109 | Squash gourd | *Afipia* sp. GAS231 |
| SBP00109 | Squash gourd | *Afipia* sp. GAS231 |
| SBP00109 | Squash gourd | *Afipia* sp. GAS231 |
| SBP00109 | Squash gourd | *Afipia* sp. GAS231 |
| SBP00109 | Squash gourd | *Afipia* sp. GAS231 |
| SBP00109 | Squash gourd | *Afipia* sp. GAS231 |
| SBP00109 | Squash gourd | *Agrobacterium fabrum* |
| SBP00109 | Squash gourd | *Agrobacterium fabrum* |
| SBP00109 | Squash gourd | *Agrobacterium fabrum* |
| SBP00109 | Squash gourd | *Agrobacterium fabrum* |
| SBP00109 | Squash gourd | *Agrobacterium fabrum* |

TABLE 3-continued

List of species identified in each metagenomic sample of each SBP Sample

| SBP ID | SBP Host Common Name | Genus sp. |
|---|---|---|
| SBP00109 | Squash gourd | *Agrobacterium fabrum* |
| SBP00109 | Squash gourd | *Agrobacterium* sp. |
| SBP00109 | Squash gourd | *Agrobacterium* sp. |
| SBP00109 | Squash gourd | *Agrobacterium* sp. |
| SBP00109 | Squash gourd | *Agrobacterium* sp. |
| SBP00109 | Squash gourd | *Agrobacterium* sp. |
| SBP00109 | Squash gourd | *Agrobacterium* sp. |
| SBP00109 | Squash gourd | *Agrobacterium tumefaciens* |
| SBP00109 | Squash gourd | *Agrobacterium tumefaciens* |
| SBP00109 | Squash gourd | *Agrobacterium tumefaciens* |
| SBP00109 | Squash gourd | *Agrobacterium tumefaciens* |
| SBP00109 | Squash gourd | *Agrobacterium tumefaciens* |
| SBP00109 | Squash gourd | *Agrobacterium tumefaciens* |
| SBP00109 | Squash gourd | *Agrococcus jejuensis* |
| SBP00109 | Squash gourd | *Agrococcus jejuensis* |
| SBP00109 | Squash gourd | *Agrococcus jejuensis* |
| SBP00109 | Squash gourd | *Agrococcus jejuensis* |
| SBP00109 | Squash gourd | *Agrococcus jejuensis* |
| SBP00109 | Squash gourd | *Agromyces* sp. 30A |
| SBP00109 | Squash gourd | *Agromyces* sp. 30A |
| SBP00109 | Squash gourd | *Agromyces* sp. 30A |
| SBP00109 | Squash gourd | *Agromyces* sp. 30A |
| SBP00109 | Squash gourd | *Agromyces* sp. 30A |
| SBP00109 | Squash gourd | *Agromyces* sp. 30A |
| SBP00109 | Squash gourd | *Alcanivorax* sp. N3-2A |
| SBP00109 | Squash gourd | *Alcanivorax* sp. N3-2A |
| SBP00109 | Squash gourd | *Alcanivorax* sp. N3-2A |
| SBP00109 | Squash gourd | *Alcanivorax* sp. N3-2A |
| SBP00109 | Squash gourd | *Alcanivorax* sp. N3-2A |
| SBP00109 | Squash gourd | *Alcanivorax* sp. N3-2A |
| SBP00109 | Squash gourd | *Alicycliphilus denitrificans* |
| SBP00109 | Squash gourd | *Alicycliphilus denitrificans* |
| SBP00109 | Squash gourd | *Alicycliphilus denitrificans* |
| SBP00109 | Squash gourd | *Alicycliphilus denitrificans* |
| SBP00109 | Squash gourd | *Alicycliphilus denitrificans* |
| SBP00109 | Squash gourd | *Alicycliphilus denitrificans* |
| SBP00109 | Squash gourd | *Allokutzneria albata* |
| SBP00109 | Squash gourd | *Allokutzneria albata* |
| SBP00109 | Squash gourd | *Allokutzneria albata* |
| SBP00109 | Squash gourd | *Allokutzneria albata* |
| SBP00109 | Squash gourd | *Allokutzneria albata* |
| SBP00109 | Squash gourd | *Allokutzneria albata* |
| SBP00109 | Squash gourd | *Aminobacter aminovorans* |
| SBP00109 | Squash gourd | *Aminobacter aminovorans* |
| SBP00109 | Squash gourd | *Aminobacter aminovorans* |
| SBP00109 | Squash gourd | *Aminobacter aminovorans* |
| SBP00109 | Squash gourd | *Aminobacter aminovorans* |
| SBP00109 | Squash gourd | *Aminobacter aminovorans* |
| SBP00109 | Squash gourd | *Aminobacter* sp. MSH1 |
| SBP00109 | Squash gourd | *Aminobacter* sp. MSH1 |
| SBP00109 | Squash gourd | *Aminobacter* sp. MSH1 |
| SBP00109 | Squash gourd | *Aminobacter* sp. MSH1 |
| SBP00109 | Squash gourd | *Aminobacter* sp. MSH1 |
| SBP00109 | Squash gourd | *Aminobacter* sp. MSH1 |
| SBP00109 | Squash gourd | *Anaeromyxobacter dehalogenans* |
| SBP00109 | Squash gourd | *Anaeromyxobacter dehalogenans* |
| SBP00109 | Squash gourd | *Anaeromyxobacter dehalogenans* |
| SBP00109 | Squash gourd | *Anaeromyxobacter dehalogenans* |
| SBP00109 | Squash gourd | *Anaeromyxobacter dehalogenans* |
| SBP00109 | Squash gourd | *Anaeromyxobacter dehalogenans* |
| SBP00109 | Squash gourd | *Aquabacterium olei* |
| SBP00109 | Squash gourd | *Aquabacterium olei* |
| SBP00109 | Squash gourd | *Aquabacterium olei* |
| SBP00109 | Squash gourd | *Aquabacterium olei* |
| SBP00109 | Squash gourd | *Aquabacterium olei* |
| SBP00109 | Squash gourd | *Aquabacterium olei* |
| SBP00109 | Squash gourd | *Aquitalea magnusonii* |
| SBP00109 | Squash gourd | *Aquitalea magnusonii* |
| SBP00109 | Squash gourd | *Aquitalea magnusonii* |
| SBP00109 | Squash gourd | *Aquitalea magnusonii* |
| SBP00109 | Squash gourd | *Aquitalea magnusonii* |
| SBP00109 | Squash gourd | *Arthrobacter* sp. ERGS1:01 |
| SBP00109 | Squash gourd | *Arthrobacter* sp. ERGS1:01 |
| SBP00109 | Squash gourd | *Arthrobacter* sp. ERGS1:01 |

TABLE 3-continued

List of species identified in each metagenomic sample of each SBP Sample

| SBP ID | SBP Host Common Name | Genus sp. |
|---|---|---|
| SBP00109 | Squash gourd | *Arthrobacter* sp. ERGS1:01 |
| SBP00109 | Squash gourd | *Arthrobacter* sp. ERGS1:01 |
| SBP00109 | Squash gourd | *Arthrobacter* sp. ERGS1:01 |
| SBP00109 | Squash gourd | *Arthrobacter* sp. U41 |
| SBP00109 | Squash gourd | *Arthrobacter* sp. U41 |
| SBP00109 | Squash gourd | *Arthrobacter* sp. U41 |
| SBP00109 | Squash gourd | *Arthrobacter* sp. U41 |
| SBP00109 | Squash gourd | *Arthrobacter* sp. U41 |
| SBP00109 | Squash gourd | *Arthrobacter* sp. U41 |
| SBP00109 | Squash gourd | *Auraticoccus monumenti* |
| SBP00109 | Squash gourd | *Auraticoccus monumenti* |
| SBP00109 | Squash gourd | *Auraticoccus monumenti* |
| SBP00109 | Squash gourd | *Auraticoccus monumenti* |
| SBP00109 | Squash gourd | *Auraticoccus monumenti* |
| SBP00109 | Squash gourd | *Auraticoccus monumenti* |
| SBP00109 | Squash gourd | *Azoarcus* sp. DN11 |
| SBP00109 | Squash gourd | *Azoarcus* sp. DN11 |
| SBP00109 | Squash gourd | *Azoarcus* sp. DN11 |
| SBP00109 | Squash gourd | *Azoarcus* sp. DN11 |
| SBP00109 | Squash gourd | *Azoarcus* sp. DN11 |
| SBP00109 | Squash gourd | *Azoarcus* sp. DN11 |
| SBP00109 | Squash gourd | *Azorhizobium caulinodans* |
| SBP00109 | Squash gourd | *Azorhizobium caulinodans* |
| SBP00109 | Squash gourd | *Azorhizobium caulinodans* |
| SBP00109 | Squash gourd | *Azorhizobium caulinodans* |
| SBP00109 | Squash gourd | *Azorhizobium caulinodans* |
| SBP00109 | Squash gourd | *Azorhizobium caulinodans* |
| SBP00109 | Squash gourd | *Azospirillum brasilense* |
| SBP00109 | Squash gourd | *Azospirillum brasilense* |
| SBP00109 | Squash gourd | *Azospirillum brasilense* |
| SBP00109 | Squash gourd | *Azospirillum brasilense* |
| SBP00109 | Squash gourd | *Azospirillum brasilense* |
| SBP00109 | Squash gourd | *Azospirillum* sp. TSH100 |
| SBP00109 | Squash gourd | *Azospirillum* sp. TSH100 |
| SBP00109 | Squash gourd | *Azospirillum* sp. TSH100 |
| SBP00109 | Squash gourd | *Azospirillum* sp. TSH100 |
| SBP00109 | Squash gourd | *Azospirillum* sp. TSH100 |
| SBP00109 | Squash gourd | *Azospirillum* sp. TSH100 |
| SBP00109 | Squash gourd | *Bacillus cereus* |
| SBP00109 | Squash gourd | *Bacillus cereus* |
| SBP00109 | Squash gourd | *Bacillus cereus* |
| SBP00109 | Squash gourd | *Bacillus cereus* |
| SBP00109 | Squash gourd | *Bacillus cereus* |
| SBP00109 | Squash gourd | *Bacillus cereus* |
| SBP00109 | Squash gourd | *Bacillus megaterium* |
| SBP00109 | Squash gourd | *Bacillus megaterium* |
| SBP00109 | Squash gourd | *Bacillus megaterium* |
| SBP00109 | Squash gourd | *Bacillus megaterium* |
| SBP00109 | Squash gourd | *Bacillus megaterium* |
| SBP00109 | Squash gourd | *Bacillus megaterium* |
| SBP00109 | Squash gourd | *Bacillus paralicheniformis* |
| SBP00109 | Squash gourd | *Bacillus paralicheniformis* |
| SBP00109 | Squash gourd | *Bacillus paralicheniformis* |
| SBP00109 | Squash gourd | *Bacillus paralicheniformis* |
| SBP00109 | Squash gourd | *Bacillus paralicheniformis* |
| SBP00109 | Squash gourd | *Bacillus paralicheniformis* |
| SBP00109 | Squash gourd | *Bacillus safensis* |
| SBP00109 | Squash gourd | *Bacillus safensis* |
| SBP00109 | Squash gourd | *Bacillus safensis* |
| SBP00109 | Squash gourd | *Bacillus safensis* |
| SBP00109 | Squash gourd | *Bacillus safensis* |
| SBP00109 | Squash gourd | *Bacillus safensis* |
| SBP00109 | Squash gourd | *Bacillus* sp. (in: Bacteria) |
| SBP00109 | Squash gourd | *Bacillus* sp. (in: Bacteria) |
| SBP00109 | Squash gourd | *Bacillus* sp. (in: Bacteria) |
| SBP00109 | Squash gourd | *Bacillus* sp. (in: Bacteria) |
| SBP00109 | Squash gourd | *Bacillus* sp. (in: Bacteria) |
| SBP00109 | Squash gourd | *Bacillus* sp. (in: Bacteria) |
| SBP00109 | Squash gourd | *Beutenbergia cavernae* |
| SBP00109 | Squash gourd | *Beutenbergia cavernae* |
| SBP00109 | Squash gourd | *Beutenbergia cavernae* |
| SBP00109 | Squash gourd | *Beutenbergia cavernae* |
| SBP00109 | Squash gourd | *Beutenbergia cavernae* |
| SBP00109 | Squash gourd | *Beutenbergia cavernae* |
| SBP00109 | Squash gourd | *Bifidobacterium pseudolongum* |

TABLE 3-continued

List of species identified in each metagenomic sample of each SBP Sample

| SBP ID | SBP Host Common Name | Genus sp. |
|---|---|---|
| SBP00109 | Squash gourd | Bifidobacterium pseudolongum |
| SBP00109 | Squash gourd | Bifidobacterium pseudolongum |
| SBP00109 | Squash gourd | Bifidobacterium pseudolongum |
| SBP00109 | Squash gourd | Bifidobacterium pseudolongum |
| SBP00109 | Squash gourd | Bifidobacterium pseudolongum |
| SBP00109 | Squash gourd | Blastococcus saxobsidens |
| SBP00109 | Squash gourd | Blastococcus saxobsidens |
| SBP00109 | Squash gourd | Blastococcus saxobsidens |
| SBP00109 | Squash gourd | Blastococcus saxobsidens |
| SBP00109 | Squash gourd | Blastococcus saxobsidens |
| SBP00109 | Squash gourd | Blastococcus saxobsidens |
| SBP00109 | Squash gourd | Bordetella hinzii |
| SBP00109 | Squash gourd | Bordetella hinzii |
| SBP00109 | Squash gourd | Bordetella hinzii |
| SBP00109 | Squash gourd | Bordetella hinzii |
| SBP00109 | Squash gourd | Bordetella hinzii |
| SBP00109 | Squash gourd | Bordetella hinzii |
| SBP00109 | Squash gourd | Bosea sp. AS-1 |
| SBP00109 | Squash gourd | Bosea sp. AS-1 |
| SBP00109 | Squash gourd | Bosea sp. AS-1 |
| SBP00109 | Squash gourd | Bosea sp. AS-1 |
| SBP00109 | Squash gourd | Bosea sp. AS-1 |
| SBP00109 | Squash gourd | Bosea sp. AS-1 |
| SBP00109 | Squash gourd | Bosea sp. PAMC 26642 |
| SBP00109 | Squash gourd | Bosea sp. PAMC 26642 |
| SBP00109 | Squash gourd | Bosea sp. PAMC 26642 |
| SBP00109 | Squash gourd | Bosea sp. PAMC 26642 |
| SBP00109 | Squash gourd | Bosea sp. PAMC 26642 |
| SBP00109 | Squash gourd | Bosea sp. PAMC 26642 |
| SBP00109 | Squash gourd | Bosea sp. RAC05 |
| SBP00109 | Squash gourd | Bosea sp. RAC05 |
| SBP00109 | Squash gourd | Bosea sp. RAC05 |
| SBP00109 | Squash gourd | Bosea sp. RAC05 |
| SBP00109 | Squash gourd | Bosea sp. RAC05 |
| SBP00109 | Squash gourd | Bosea sp. RAC05 |
| SBP00109 | Squash gourd | Bosea sp. Tri-49 |
| SBP00109 | Squash gourd | Bosea sp. Tri-49 |
| SBP00109 | Squash gourd | Bosea sp. Tri-49 |
| SBP00109 | Squash gourd | Bosea sp. Tri-49 |
| SBP00109 | Squash gourd | Bosea sp. Tri-49 |
| SBP00109 | Squash gourd | Bosea sp. Tri-49 |
| SBP00109 | Squash gourd | Bosea vaviloviae |
| SBP00109 | Squash gourd | Bosea vaviloviae |
| SBP00109 | Squash gourd | Bosea vaviloviae |
| SBP00109 | Squash gourd | Bosea vaviloviae |
| SBP00109 | Squash gourd | Bosea vaviloviae |
| SBP00109 | Squash gourd | Bosea vaviloviae |
| SBP00109 | Squash gourd | Brachybacterium faecium |
| SBP00109 | Squash gourd | Brachybacterium faecium |
| SBP00109 | Squash gourd | Brachybacterium faecium |
| SBP00109 | Squash gourd | Brachybacterium faecium |
| SBP00109 | Squash gourd | Brachybacterium faecium |
| SBP00109 | Squash gourd | Brachybacterium faecium |
| SBP00109 | Squash gourd | Brachybacterium ginsengisoli |
| SBP00109 | Squash gourd | Brachybacterium ginsengisoli |
| SBP00109 | Squash gourd | Brachybacterium ginsengisoli |
| SBP00109 | Squash gourd | Brachybacterium ginsengisoli |
| SBP00109 | Squash gourd | Brachybacterium ginsengisoli |
| SBP00109 | Squash gourd | Brachybacterium ginsengisoli |
| SBP00109 | Squash gourd | Brachybacterium saurashtrense |
| SBP00109 | Squash gourd | Brachybacterium saurashtrense |
| SBP00109 | Squash gourd | Brachybacterium saurashtrense |
| SBP00109 | Squash gourd | Brachybacterium saurashtrense |
| SBP00109 | Squash gourd | Brachybacterium saurashtrense |
| SBP00109 | Squash gourd | Brachybacterium saurashtrense |
| SBP00109 | Squash gourd | Brachybacterium sp. P6-10-X1 |
| SBP00109 | Squash gourd | Brachybacterium sp. P6-10-X1 |
| SBP00109 | Squash gourd | Brachybacterium sp. P6-10-X1 |
| SBP00109 | Squash gourd | Brachybacterium sp. P6-10-X1 |
| SBP00109 | Squash gourd | Brachybacterium sp. P6-10-X1 |
| SBP00109 | Squash gourd | Brachybacterium sp. P6-10-X1 |
| SBP00109 | Squash gourd | Brachybacterium sp. VM2412 |
| SBP00109 | Squash gourd | Brachybacterium sp. VM2412 |
| SBP00109 | Squash gourd | Brachybacterium sp. VM2412 |
| SBP00109 | Squash gourd | Brachybacterium sp. VM2412 |
| SBP00109 | Squash gourd | Brachybacterium sp. VM2412 |

TABLE 3-continued

List of species identified in each metagenomic sample of each SBP Sample

| SBP ID | SBP Host Common Name | Genus sp. |
|---|---|---|
| SBP00109 | Squash gourd | *Brachybacterium* sp. VM2412 |
| SBP00109 | Squash gourd | *Brachybacterium* sp. VR2415 |
| SBP00109 | Squash gourd | *Brachybacterium* sp. VR2415 |
| SBP00109 | Squash gourd | *Brachybacterium* sp. VR2415 |
| SBP00109 | Squash gourd | *Brachybacterium* sp. VR2415 |
| SBP00109 | Squash gourd | *Brachybacterium* sp. VR2415 |
| SBP00109 | Squash gourd | *Brachybacterium* sp. VR2415 |
| SBP00109 | Squash gourd | *Bradyrhizobiaceae bacterium* SG-6C |
| SBP00109 | Squash gourd | *Bradyrhizobiaceae bacterium* SG-6C |
| SBP00109 | Squash gourd | *Bradyrhizobiaceae bacterium* SG-6C |
| SBP00109 | Squash gourd | *Bradyrhizobiaceae bacterium* SG-6C |
| SBP00109 | Squash gourd | *Bradyrhizobiaceae bacterium* SG-6C |
| SBP00109 | Squash gourd | *Bradyrhizobiaceae bacterium* SG-6C |
| SBP00109 | Squash gourd | *Bradyrhizobium diazoefficiens* |
| SBP00109 | Squash gourd | *Bradyrhizobium diazoefficiens* |
| SBP00109 | Squash gourd | *Bradyrhizobium diazoefficiens* |
| SBP00109 | Squash gourd | *Bradyrhizobium diazoefficiens* |
| SBP00109 | Squash gourd | *Bradyrhizobium diazoefficiens* |
| SBP00109 | Squash gourd | *Bradyrhizobium diazoefficiens* |
| SBP00109 | Squash gourd | *Bradyrhizobium erythrophlei* |
| SBP00109 | Squash gourd | *Bradyrhizobium erythrophlei* |
| SBP00109 | Squash gourd | *Bradyrhizobium erythrophlei* |
| SBP00109 | Squash gourd | *Bradyrhizobium erythrophlei* |
| SBP00109 | Squash gourd | *Bradyrhizobium erythrophlei* |
| SBP00109 | Squash gourd | *Bradyrhizobium erythrophlei* |
| SBP00109 | Squash gourd | *Bradyrhizobium guangdongense* |
| SBP00109 | Squash gourd | *Bradyrhizobium guangdongense* |
| SBP00109 | Squash gourd | *Bradyrhizobium guangdongense* |
| SBP00109 | Squash gourd | *Bradyrhizobium guangdongense* |
| SBP00109 | Squash gourd | *Bradyrhizobium guangdongense* |
| SBP00109 | Squash gourd | *Bradyrhizobium guangdongense* |
| SBP00109 | Squash gourd | *Bradyrhizobium guangxiense* |
| SBP00109 | Squash gourd | *Bradyrhizobium guangxiense* |
| SBP00109 | Squash gourd | *Bradyrhizobium guangxiense* |
| SBP00109 | Squash gourd | *Bradyrhizobium guangxiense* |
| SBP00109 | Squash gourd | *Bradyrhizobium guangxiense* |
| SBP00109 | Squash gourd | *Bradyrhizobium guangxiense* |
| SBP00109 | Squash gourd | *Bradyrhizobium icense* |
| SBP00109 | Squash gourd | *Bradyrhizobium icense* |
| SBP00109 | Squash gourd | *Bradyrhizobium icense* |
| SBP00109 | Squash gourd | *Bradyrhizobium icense* |
| SBP00109 | Squash gourd | *Bradyrhizobium icense* |
| SBP00109 | Squash gourd | *Bradyrhizobium icense* |
| SBP00109 | Squash gourd | *Bradyrhizobium japonicum* |
| SBP00109 | Squash gourd | *Bradyrhizobium japonicum* |
| SBP00109 | Squash gourd | *Bradyrhizobium japonicum* |
| SBP00109 | Squash gourd | *Bradyrhizobium japonicum* |
| SBP00109 | Squash gourd | *Bradyrhizobium japonicum* |
| SBP00109 | Squash gourd | *Bradyrhizobium japonicum* |
| SBP00109 | Squash gourd | *Bradyrhizobium lablabi* |
| SBP00109 | Squash gourd | *Bradyrhizobium lablabi* |
| SBP00109 | Squash gourd | *Bradyrhizobium lablabi* |
| SBP00109 | Squash gourd | *Bradyrhizobium lablabi* |
| SBP00109 | Squash gourd | *Bradyrhizobium lablabi* |
| SBP00109 | Squash gourd | *Bradyrhizobium lablabi* |
| SBP00109 | Squash gourd | *Bradyrhizobium oligotrophicum* |
| SBP00109 | Squash gourd | *Bradyrhizobium oligotrophicum* |
| SBP00109 | Squash gourd | *Bradyrhizobium oligotrophicum* |
| SBP00109 | Squash gourd | *Bradyrhizobium oligotrophicum* |
| SBP00109 | Squash gourd | *Bradyrhizobium oligotrophicum* |
| SBP00109 | Squash gourd | *Bradyrhizobium oligotrophicum* |
| SBP00109 | Squash gourd | *Bradyrhizobium ottawaense* |
| SBP00109 | Squash gourd | *Bradyrhizobium ottawaense* |
| SBP00109 | Squash gourd | *Bradyrhizobium ottawaense* |
| SBP00109 | Squash gourd | *Bradyrhizobium ottawaense* |
| SBP00109 | Squash gourd | *Bradyrhizobium ottawaense* |
| SBP00109 | Squash gourd | *Bradyrhizobium ottawaense* |
| SBP00109 | Squash gourd | *Bradyrhizobium* sp. |
| SBP00109 | Squash gourd | *Bradyrhizobium* sp. |
| SBP00109 | Squash gourd | *Bradyrhizobium* sp. |
| SBP00109 | Squash gourd | *Bradyrhizobium* sp. |
| SBP00109 | Squash gourd | *Bradyrhizobium* sp. |
| SBP00109 | Squash gourd | *Bradyrhizobium* sp. 2 3951MB |
| SBP00109 | Squash gourd | *Bradyrhizobium* sp. 2 3951MB |
| SBP00109 | Squash gourd | *Bradyrhizobium* sp. 2 3951MB |

TABLE 3-continued

List of species identified in each metagenomic sample of each SBP Sample

| SBP ID | SBP Host Common Name | Genus sp. |
|---|---|---|
| SBP00109 | Squash gourd | *Bradyrhizobium* sp. 2 3951MB |
| SBP00109 | Squash gourd | *Bradyrhizobium* sp. 2 3951MB |
| SBP00109 | Squash gourd | *Bradyrhizobium* sp. 2 3951MB |
| SBP00109 | Squash gourd | *Bradyrhizobium* sp. 3 |
| SBP00109 | Squash gourd | *Bradyrhizobium* sp. 3 |
| SBP00109 | Squash gourd | *Bradyrhizobium* sp. 3 |
| SBP00109 | Squash gourd | *Bradyrhizobium* sp. 3 |
| SBP00109 | Squash gourd | *Bradyrhizobium* sp. 3 |
| SBP00109 | Squash gourd | *Bradyrhizobium* sp. 3 |
| SBP00109 | Squash gourd | *Bradyrhizobium* sp. 3 8551MB |
| SBP00109 | Squash gourd | *Bradyrhizobium* sp. 3 8551MB |
| SBP00109 | Squash gourd | *Bradyrhizobium* sp. 3 8551MB |
| SBP00109 | Squash gourd | *Bradyrhizobium* sp. 3 8551MB |
| SBP00109 | Squash gourd | *Bradyrhizobium* sp. 3 8551MB |
| SBP00109 | Squash gourd | *Bradyrhizobium* sp. 3 8551MB |
| SBP00109 | Squash gourd | *Bradyrhizobium* sp. BTAi1 |
| SBP00109 | Squash gourd | *Bradyrhizobium* sp. BTAi1 |
| SBP00109 | Squash gourd | *Bradyrhizobium* sp. BTAi1 |
| SBP00109 | Squash gourd | *Bradyrhizobium* sp. BTAi1 |
| SBP00109 | Squash gourd | *Bradyrhizobium* sp. BTAi1 |
| SBP00109 | Squash gourd | *Bradyrhizobium* sp. BTAi1 |
| SBP00109 | Squash gourd | *Bradyrhizobium* sp. CCBAU 51670 |
| SBP00109 | Squash gourd | *Bradyrhizobium* sp. CCBAU 51670 |
| SBP00109 | Squash gourd | *Bradyrhizobium* sp. CCBAU 51670 |
| SBP00109 | Squash gourd | *Bradyrhizobium* sp. CCBAU 51670 |
| SBP00109 | Squash gourd | *Bradyrhizobium* sp. CCBAU 51670 |
| SBP00109 | Squash gourd | *Bradyrhizobium* sp. CCBAU 51670 |
| SBP00109 | Squash gourd | *Bradyrhizobium* sp. CCBAU 51778 |
| SBP00109 | Squash gourd | *Bradyrhizobium* sp. CCBAU S1778 |
| SBP00109 | Squash gourd | *Bradyrhizobium* sp. CCBAU 51778 |
| SBP00109 | Squash gourd | *Bradyrhizobium* sp. CCBAU 51778 |
| SBP00109 | Squash gourd | *Bradyrhizobium* sp. CCBAU 51778 |
| SBP00109 | Squash gourd | *Bradyrhizobium* sp. CCBAU 51778 |
| SBP00109 | Squash gourd | *Bradyrhizobium* sp. CCGE-LA001 |
| SBP00109 | Squash gourd | *Bradyrhizobium* sp. CCGE-LA001 |
| SBP00109 | Squash gourd | *Bradyrhizobium* sp. CCGE-LA001 |
| SBP00109 | Squash gourd | *Bradyrhizobium* sp. CCGE-LA001 |
| SBP00109 | Squash gourd | *Bradyrhizobium* sp. CCGE-LA001 |
| SBP00109 | Squash gourd | *Bradyrhizobium* sp. CCGE-LA001 |
| SBP00109 | Squash gourd | *Bradyrhizobium* sp. ORS 278 |
| SBP00109 | Squash gourd | *Bradyrhizobium* sp. ORS 278 |
| SBP00109 | Squash gourd | *Bradyrhizobium* sp. ORS 278 |
| SBP00109 | Squash gourd | *Bradyrhizobium* sp. ORS 278 |
| SBP00109 | Squash gourd | *Bradyrhizobium* sp. ORS 278 |
| SBP00109 | Squash gourd | *Bradyrhizobium* sp. ORS 278 |
| SBP00109 | Squash gourd | *Bradyrhizobium* sp. ORS 285 |
| SBP00109 | Squash gourd | *Bradyrhizobium* sp. ORS 285 |
| SBP00109 | Squash gourd | *Bradyrhizobium* sp. ORS 285 |
| SBP00109 | Squash gourd | *Bradyrhizobium* sp. ORS 285 |
| SBP00109 | Squash gourd | *Bradyrhizobium* sp. ORS 285 |
| SBP00109 | Squash gourd | *Bradyrhizobium* sp. ORS 285 |
| SBP00109 | Squash gourd | *Bradyrhizobium* sp. ORS 3257 |
| SBP00109 | Squash gourd | *Bradyrhizobium* sp. ORS 3257 |
| SBP00109 | Squash gourd | *Bradyrhizobium* sp. ORS 3257 |
| SBP00109 | Squash gourd | *Bradyrhizobium* sp. ORS 3257 |
| SBP00109 | Squash gourd | *Bradyrhizobium* sp. ORS 3257 |
| SBP00109 | Squash gourd | *Bradyrhizobium* sp. ORS 3257 |
| SBP00109 | Squash gourd | *Bradyrhizobium* sp. S23321 |
| SBP00109 | Squash gourd | *Bradyrhizobium* sp. S23321 |
| SBP00109 | Squash gourd | *Bradyrhizobium* sp. S23321 |
| SBP00109 | Squash gourd | *Bradyrhizobium* sp. S23321 |
| SBP00109 | Squash gourd | *Bradyrhizobium* sp. S23321 |
| SBP00109 | Squash gourd | *Bradyrhizobium* sp. S23321 |
| SBP00109 | Squash gourd | *Bradyrhizobium* sp. SK17 |
| SBP00109 | Squash gourd | *Bradyrhizobium* sp. SK17 |
| SBP00109 | Squash gourd | *Bradyrhizobium* sp. SK17 |
| SBP00109 | Squash gourd | *Bradyrhizobium* sp. SK17 |
| SBP00109 | Squash gourd | *Bradyrhizobium* sp. SK17 |
| SBP00109 | Squash gourd | *Bradyrhizobium* sp. SK17 |
| SBP00109 | Squash gourd | *Bradyrhizobium* sp. WSM471 |
| SBP00109 | Squash gourd | *Bradyrhizobium* sp. WSM471 |
| SBP00109 | Squash gourd | *Bradyrhizobium* sp. WSM471 |
| SBP00109 | Squash gourd | *Bradyrhizobium* sp. WSM471 |
| SBP00109 | Squash gourd | *Bradyrhizobium* sp. WSM471 |
| SBP00109 | Squash gourd | *Bradyrhizobium* sp. WSM471 |
| SBP00109 | Squash gourd | *Brevibacterium aurantiacum* |

TABLE 3-continued

List of species identified in each metagenomic sample of each SBP Sample

| SBP ID | SBP Host Common Name | Genus sp. |
|---|---|---|
| SBP00109 | Squash gourd | *Brevibacterium aurantiacum* |
| SBP00109 | Squash gourd | *Brevibacterium aurantiacum* |
| SBP00109 | Squash gourd | *Brevibacterium aurantiacum* |
| SBP00109 | Squash gourd | *Brevibacterium aurantiacum* |
| SBP00109 | Squash gourd | *Brevibacterium aurantiacum* |
| SBP00109 | Squash gourd | *Brevibacterium linens* |
| SBP00109 | Squash gourd | *Brevibacterium linens* |
| SBP00109 | Squash gourd | *Brevibacterium linens* |
| SBP00109 | Squash gourd | *Brevibacterium linens* |
| SBP00109 | Squash gourd | *Brevibacterium linens* |
| SBP00109 | Squash gourd | *Brevibacterium sandarakinum* |
| SBP00109 | Squash gourd | *Brevibacterium sandarakinum* |
| SBP00109 | Squash gourd | *Brevibacterium sandarakinum* |
| SBP00109 | Squash gourd | *Brevibacterium sandarakinum* |
| SBP00109 | Squash gourd | *Brevibacterium sandarakinum* |
| SBP00109 | Squash gourd | *Brevibacterium sandarakinum* |
| SBP00109 | Squash gourd | *Brevibacterium siliguriense* |
| SBP00109 | Squash gourd | *Brevibacterium siliguriense* |
| SBP00109 | Squash gourd | *Brevibacterium siliguriense* |
| SBP00109 | Squash gourd | *Brevibacterium siliguriense* |
| SBP00109 | Squash gourd | *Brevibacterium siliguriense* |
| SBP00109 | Squash gourd | *Brevibacterium siliguriense* |
| SBP00109 | Squash gourd | *Brochothrix phage* NF5 |
| SBP00109 | Squash gourd | *Brochothrix phage* NF5 |
| SBP00109 | Squash gourd | *Brochothrix phage* NF5 |
| SBP00109 | Squash gourd | *Brochothrix phage* NF5 |
| SBP00109 | Squash gourd | *Brochothrix phage* NF5 |
| SBP00109 | Squash gourd | *Burkholderia ambifaria* |
| SBP00109 | Squash gourd | *Burkholderia ambifaria* |
| SBP00109 | Squash gourd | *Burkholderia ambifaria* |
| SBP00109 | Squash gourd | *Burkholderia ambifaria* |
| SBP00109 | Squash gourd | *Burkholderia ambifaria* |
| SBP00109 | Squash gourd | *Burkholderia ambifaria* |
| SBP00109 | Squash gourd | *Burkholderia cenocepacia* |
| SBP00109 | Squash gourd | *Burkholderia cenocepacia* |
| SBP00109 | Squash gourd | *Burkholderia cenocepacia* |
| SBP00109 | Squash gourd | *Burkholderia cenocepacia* |
| SBP00109 | Squash gourd | *Burkholderia cenocepacia* |
| SBP00109 | Squash gourd | *Burkholderia cenocepacia* |
| SBP00109 | Squash gourd | *Burkholderia cepacia* |
| SBP00109 | Squash gourd | *Burkholderia cepacia* |
| SBP00109 | Squash gourd | *Burkholderia cepacia* |
| SBP00109 | Squash gourd | *Burkholderia cepacia* |
| SBP00109 | Squash gourd | *Burkholderia cepacia* |
| SBP00109 | Squash gourd | *Burkholderia cepacia* |
| SBP00109 | Squash gourd | *Burkholderia contaminans* |
| SBP00109 | Squash gourd | *Burkholderia contaminans* |
| SBP00109 | Squash gourd | *Burkholderia contaminans* |
| SBP00109 | Squash gourd | *Burkholderia contaminans* |
| SBP00109 | Squash gourd | *Burkholderia contaminans* |
| SBP00109 | Squash gourd | *Burkholderia contaminans* |
| SBP00109 | Squash gourd | *Burkholderia gladioli* |
| SBP00109 | Squash gourd | *Burkholderia gladioli* |
| SBP00109 | Squash gourd | *Burkholderia gladioli* |
| SBP00109 | Squash gourd | *Burkholderia gladioli* |
| SBP00109 | Squash gourd | *Burkholderia gladioli* |
| SBP00109 | Squash gourd | *Burkholderia gladioli* |
| SBP00109 | Squash gourd | *Burkholderia glumae* |
| SBP00109 | Squash gourd | *Burkholderia glumae* |
| SBP00109 | Squash gourd | *Burkholderia glumae* |
| SBP00109 | Squash gourd | *Burkholderia glumae* |
| SBP00109 | Squash gourd | *Burkholderia glumae* |
| SBP00109 | Squash gourd | *Burkholderia glumae* |
| SBP00109 | Squash gourd | *Burkholderia lata* |
| SBP00109 | Squash gourd | *Burkholderia lata* |
| SBP00109 | Squash gourd | *Burkholderia lata* |
| SBP00109 | Squash gourd | *Burkholderia lata* |
| SBP00109 | Squash gourd | *Burkholderia lata* |
| SBP00109 | Squash gourd | *Burkholderia lata* |
| SBP00109 | Squash gourd | *Burkholderia plantarii* |
| SBP00109 | Squash gourd | *Burkholderia plantarii* |
| SBP00109 | Squash gourd | *Burkholderia plantarii* |
| SBP00109 | Squash gourd | *Burkholderia plantarii* |
| SBP00109 | Squash gourd | *Burkholderia plantarii* |

TABLE 3-continued

List of species identified in each metagenomic sample of each SBP Sample

| SBP ID | SBP Host Common Name | Genus sp. |
|---|---|---|
| SBP00109 | Squash gourd | *Burkholderia plantarii* |
| SBP00109 | Squash gourd | *Burkholderia pseudomallei* |
| SBP00109 | Squash gourd | *Burkholderia pseudomallei* |
| SBP00109 | Squash gourd | *Burkholderia pseudomallei* |
| SBP00109 | Squash gourd | *Burkholderia pseudomallei* |
| SBP00109 | Squash gourd | *Burkholderia pseudomallei* |
| SBP00109 | Squash gourd | *Burkholderia pseudomallei* |
| SBP00109 | Squash gourd | *Burkholderia pyrrocinia* |
| SBP00109 | Squash gourd | *Burkholderia pyrrocinia* |
| SBP00109 | Squash gourd | *Burkholderia pyrrocinia* |
| SBP00109 | Squash gourd | *Burkholderia pyrrocinia* |
| SBP00109 | Squash gourd | *Burkholderia pyrrocinia* |
| SBP00109 | Squash gourd | *Burkholderia pyrrocinia* |
| SBP00109 | Squash gourd | *Burkholderia* sp. AD24 |
| SBP00109 | Squash gourd | *Burkholderia* sp. AD24 |
| SBP00109 | Squash gourd | *Burkholderia* sp. AD24 |
| SBP00109 | Squash gourd | *Burkholderia* sp. AD24 |
| SBP00109 | Squash gourd | *Burkholderia* sp. AD24 |
| SBP00109 | Squash gourd | *Burkholderia* sp. AD24 |
| SBP00109 | Squash gourd | *Burkholderia* sp. BDU6 |
| SBP00109 | Squash gourd | *Burkholderia* sp. BDU6 |
| SBP00109 | Squash gourd | *Burkholderia* sp. BDU6 |
| SBP00109 | Squash gourd | *Burkholderia* sp. BDU6 |
| SBP00109 | Squash gourd | *Burkholderia* sp. BDU6 |
| SBP00109 | Squash gourd | *Burkholderia* sp. BDU6 |
| SBP00109 | Squash gourd | *Burkholderia* sp. OLGA172 |
| SBP00109 | Squash gourd | *Burkholderia* sp. OLGA172 |
| SBP00109 | Squash gourd | *Burkholderia* sp. OLGA172 |
| SBP00109 | Squash gourd | *Burkholderia* sp. OLGA172 |
| SBP00109 | Squash gourd | *Burkholderia* sp. OLGA172 |
| SBP00109 | Squash gourd | *Burkholderia* sp. OLGA172 |
| SBP00109 | Squash gourd | *Burkholderia stabilis* |
| SBP00109 | Squash gourd | *Burkholderia stabilis* |
| SBP00109 | Squash gourd | *Burkholderia stabilis* |
| SBP00109 | Squash gourd | *Burkholderia stabilis* |
| SBP00109 | Squash gourd | *Burkholderia stabilis* |
| SBP00109 | Squash gourd | *Burkholderia stabilis* |
| SBP00109 | Squash gourd | *Burkholderia stagnalis* |
| SBP00109 | Squash gourd | *Burkholderia stagnalis* |
| SBP00109 | Squash gourd | *Burkholderia stagnalis* |
| SBP00109 | Squash gourd | *Burkholderia stagnalis* |
| SBP00109 | Squash gourd | *Burkholderia stagnalis* |
| SBP00109 | Squash gourd | *Burkholderia stagnalis* |
| SBP00109 | Squash gourd | *Burkholderia thailandensis* |
| SBP00109 | Squash gourd | *Burkholderia thailandensis* |
| SBP00109 | Squash gourd | *Burkholderia thailandensis* |
| SBP00109 | Squash gourd | *Burkholderia thailandensis* |
| SBP00109 | Squash gourd | *Burkholderia thailandensis* |
| SBP00109 | Squash gourd | *Burkholderia thailandensis* |
| SBP00109 | Squash gourd | *Burkholderia ubonensis* |
| SBP00109 | Squash gourd | *Burkholderia ubonensis* |
| SBP00109 | Squash gourd | *Burkholderia ubonensis* |
| SBP00109 | Squash gourd | *Burkholderia ubonensis* |
| SBP00109 | Squash gourd | *Burkholderia ubonensis* |
| SBP00109 | Squash gourd | *Burkholderia ubonensis* |
| SBP00109 | Squash gourd | *Burkholderia vietnamiensis* |
| SBP00109 | Squash gourd | *Burkholderia vietnamiensis* |
| SBP00109 | Squash gourd | *Burkholderia vietnamiensis* |
| SBP00109 | Squash gourd | *Burkholderia vietnamiensis* |
| SBP00109 | Squash gourd | *Burkholderia vietnamiensis* |
| SBP00109 | Squash gourd | *Burkholderia vietnamiensis* |
| SBP00109 | Squash gourd | *Burkholderiales bacterium* JOSHI_001 |
| SBP00109 | Squash gourd | *Burkholderiales bacterium* JOSHI_001 |
| SBP00109 | Squash gourd | *Burkholderiales bacterium* JOSHI_001 |
| SBP00109 | Squash gourd | *Burkholderiales bacterium* JOSHI_001 |
| SBP00109 | Squash gourd | *Burkholderiales bacterium* JOSHI_001 |
| SBP00109 | Squash gourd | *Burkholderiales bacterium* JOSHI_001 |
| SBP00109 | Squash gourd | *Castellaniella defragrans* |
| SBP00109 | Squash gourd | *Castellaniella defragrans* |
| SBP00109 | Squash gourd | *Castellaniella defragrans* |
| SBP00109 | Squash gourd | *Castellaniella defragrans* |
| SBP00109 | Squash gourd | *Castellaniella defragrans* |
| SBP00109 | Squash gourd | *Castellaniella defragrans* |
| SBP00109 | Squash gourd | *Catenulispora acidiphila* |
| SBP00109 | Squash gourd | *Catenulispora acidiphila* |
| SBP00109 | Squash gourd | *Catenulispora acidiphila* |

TABLE 3-continued

List of species identified in each metagenomic sample of each SBP Sample

| SBP ID | SBP Host Common Name | Genus sp. |
|---|---|---|
| SBP00109 | Squash gourd | *Catenulispora acidiphila* |
| SBP00109 | Squash gourd | *Catenulispora acidiphila* |
| SBP00109 | Squash gourd | *Catenulispora acidiphila* |
| SBP00109 | Squash gourd | *Cellulomonas fimi* |
| SBP00109 | Squash gourd | *Cellulomonas fimi* |
| SBP00109 | Squash gourd | *Cellulomonas fimi* |
| SBP00109 | Squash gourd | *Cellulomonas fimi* |
| SBP00109 | Squash gourd | *Cellulomonas fimi* |
| SBP00109 | Squash gourd | *Cellulomonas fimi* |
| SBP00109 | Squash gourd | *Cellulomonas flavigena* |
| SBP00109 | Squash gourd | *Cellulomonas flavigena* |
| SBP00109 | Squash gourd | *Cellulomonas flavigena* |
| SBP00109 | Squash gourd | *Cellulomonas flavigena* |
| SBP00109 | Squash gourd | *Cellulomonas flavigena* |
| SBP00109 | Squash gourd | *Cellulomonas flavigena* |
| SBP00109 | Squash gourd | *Cellulomonas gilvus* |
| SBP00109 | Squash gourd | *Cellulomonas gilvus* |
| SBP00109 | Squash gourd | *Cellulomonas gilvus* |
| SBP00109 | Squash gourd | *Cellulomonas gilvus* |
| SBP00109 | Squash gourd | *Cellulomonas gilvus* |
| SBP00109 | Squash gourd | *Cellulomonas gilvus* |
| SBP00109 | Squash gourd | *Cellulomonas* sp. PSBB021 |
| SBP00109 | Squash gourd | *Cellulomonas* sp. PSBB021 |
| SBP00109 | Squash gourd | *Cellulomonas* sp. PSBB021 |
| SBP00109 | Squash gourd | *Cellulomonas* sp. PSBB021 |
| SBP00109 | Squash gourd | *Cellulomonas* sp. PSBB021 |
| SBP00109 | Squash gourd | *Cellulomonas* sp. PSBB021 |
| SBP00109 | Squash gourd | *Cellulosimicrobium cellulans* |
| SBP00109 | Squash gourd | *Cellulosimicrobium cellulans* |
| SBP00109 | Squash gourd | *Cellulosimicrobium cellulans* |
| SBP00109 | Squash gourd | *Cellulosimicrobium cellulans* |
| SBP00109 | Squash gourd | *Cellulosimicrobium cellulans* |
| SBP00109 | Squash gourd | *Cellulosimicrobium cellulans* |
| SBP00109 | Squash gourd | *Cellulosimicrobium* sp. TH-20 |
| SBP00109 | Squash gourd | *Cellulosimicrobium* sp. TH-20 |
| SBP00109 | Squash gourd | *Cellulosimicrobium* sp. TH-20 |
| SBP00109 | Squash gourd | *Cellulosimicrobium* sp. TH-20 |
| SBP00109 | Squash gourd | *Cellulosimicrobium* sp. TH-20 |
| SBP00109 | Squash gourd | *Cellulosimicrobium* sp. TH-20 |
| SBP00109 | Squash gourd | *Chelativorans* sp. BNC1 |
| SBP00109 | Squash gourd | *Chelativorans* sp. BNC1 |
| SBP00109 | Squash gourd | *Chelativorans* sp. BNC1 |
| SBP00109 | Squash gourd | *Chelativorans* sp. BNC1 |
| SBP00109 | Squash gourd | *Chelativorans* sp. BNC1 |
| SBP00109 | Squash gourd | *Chelativorans* sp. BNC1 |
| SBP00109 | Squash gourd | *Chelatococcus daeguensis* |
| SBP00109 | Squash gourd | *Chelatococcus daeguensis* |
| SBP00109 | Squash gourd | *Chelatococcus daeguensis* |
| SBP00109 | Squash gourd | *Chelatococcus daeguensis* |
| SBP00109 | Squash gourd | *Chelatococcus daeguensis* |
| SBP00109 | Squash gourd | *Chelatococcus daeguensis* |
| SBP00109 | Squash gourd | *Clavibacter michiganensis* |
| SBP00109 | Squash gourd | *Clavibacter michiganensis* |
| SBP00109 | Squash gourd | *Clavibacter michiganensis* |
| SBP00109 | Squash gourd | *Clavibacter michiganensis* |
| SBP00109 | Squash gourd | *Clavibacter michiganensis* |
| SBP00109 | Squash gourd | *Clavibacter michiganensis* |
| SBP00109 | Squash gourd | *Clostridioides difficile* |
| SBP00109 | Squash gourd | *Clostridioides difficile* |
| SBP00109 | Squash gourd | *Clostridioides difficile* |
| SBP00109 | Squash gourd | *Clostridioides difficile* |
| SBP00109 | Squash gourd | *Clostridioides difficile* |
| SBP00109 | Squash gourd | *Clostridioides difficile* |
| SBP00109 | Squash gourd | *Comamonas aquatica* |
| SBP00109 | Squash gourd | *Comamonas aquatica* |
| SBP00109 | Squash gourd | *Comamonas aquatica* |
| SBP00109 | Squash gourd | *Comamonas aquatica* |
| SBP00109 | Squash gourd | *Comamonas aquatica* |
| SBP00109 | Squash gourd | *Comamonas aquatica* |
| SBP00109 | Squash gourd | *Comamonas serinivorans* |
| SBP00109 | Squash gourd | *Comamonas serinivorans* |
| SBP00109 | Squash gourd | *Comamonas serinivorans* |
| SBP00109 | Squash gourd | *Comamonas serinivorans* |
| SBP00109 | Squash gourd | *Comamonas serinivorans* |
| SBP00109 | Squash gourd | *Comamonas serinivorans* |
| SBP00109 | Squash gourd | *Comamonas terrigena* |

TABLE 3-continued

List of species identified in each metagenomic sample of each SBP Sample

| SBP ID | SBP Host Common Name | Genus sp. |
|---|---|---|
| SBP00109 | Squash gourd | Comamonas terrigena |
| SBP00109 | Squash gourd | Comamonas terrigena |
| SBP00109 | Squash gourd | Comamonas terrigena |
| SBP00109 | Squash gourd | Comamonas terrigena |
| SBP00109 | Squash gourd | Comamonas terrigena |
| SBP00109 | Squash gourd | Comamonas testosteroni |
| SBP00109 | Squash gourd | Comamonas testosteroni |
| SBP00109 | Squash gourd | Comamonas testosteroni |
| SBP00109 | Squash gourd | Comamonas testosteroni |
| SBP00109 | Squash gourd | Comamonas testosteroni |
| SBP00109 | Squash gourd | Corallococcus coralloides |
| SBP00109 | Squash gourd | Corallococcus coralloides |
| SBP00109 | Squash gourd | Corallococcus coralloides |
| SBP00109 | Squash gourd | Corallococcus coralloides |
| SBP00109 | Squash gourd | Corallococcus coralloides |
| SBP00109 | Squash gourd | Corynebacterium casei |
| SBP00109 | Squash gourd | Corynebacterium casei |
| SBP00109 | Squash gourd | Corynebacterium casei |
| SBP00109 | Squash gourd | Corynebacterium casei |
| SBP00109 | Squash gourd | Corynebacterium casei |
| SBP00109 | Squash gourd | Corynebacterium jeikeium |
| SBP00109 | Squash gourd | Corynebacterium jeikeium |
| SBP00109 | Squash gourd | Corynebacterium jeikeium |
| SBP00109 | Squash gourd | Corynebacterium jeikeium |
| SBP00109 | Squash gourd | Corynebacterium jeikeium |
| SBP00109 | Squash gourd | Corynebacterium jeikeium |
| SBP00109 | Squash gourd | Corynebacterium sp. L2-79-05 |
| SBP00109 | Squash gourd | Corynebacterium sp. L2-79-05 |
| SBP00109 | Squash gourd | Corynebacterium sp. L2-79-05 |
| SBP00109 | Squash gourd | Corynebacterium sp. L2-79-05 |
| SBP00109 | Squash gourd | Corynebacterium sp. L2-79-05 |
| SBP00109 | Squash gourd | Corynebacterium sp. L2-79-05 |
| SBP00109 | Squash gourd | Corynebacterium variabile |
| SBP00109 | Squash gourd | Corynebacterium variabile |
| SBP00109 | Squash gourd | Corynebacterium variabile |
| SBP00109 | Squash gourd | Corynebacterium variabile |
| SBP00109 | Squash gourd | Corynebacterium variabile |
| SBP00109 | Squash gourd | Corynebacterium variabile |
| SBP00109 | Squash gourd | Cupriavidus basilensis |
| SBP00109 | Squash gourd | Cupriavidus basilensis |
| SBP00109 | Squash gourd | Cupriavidus basilensis |
| SBP00109 | Squash gourd | Cupriavidus basilensis |
| SBP00109 | Squash gourd | Cupriavidus basilensis |
| SBP00109 | Squash gourd | Cupriavidus basilensis |
| SBP00109 | Squash gourd | Cupriavidus gilardii |
| SBP00109 | Squash gourd | Cupriavidus gilardii |
| SBP00109 | Squash gourd | Cupriavidus gilardii |
| SBP00109 | Squash gourd | Cupriavidus gilardii |
| SBP00109 | Squash gourd | Cupriavidus gilardii |
| SBP00109 | Squash gourd | Cupriavidus gilardii |
| SBP00109 | Squash gourd | Cupriavidus metallidurans |
| SBP00109 | Squash gourd | Cupriavidus metallidurans |
| SBP00109 | Squash gourd | Cupriavidus metallidurans |
| SBP00109 | Squash gourd | Cupriavidus metallidurans |
| SBP00109 | Squash gourd | Cupriavidus metallidurans |
| SBP00109 | Squash gourd | Cupriavidus metallidurans |
| SBP00109 | Squash gourd | Cupriavidus nantongensis |
| SBP00109 | Squash gourd | Cupriavidus nantongensis |
| SBP00109 | Squash gourd | Cupriavidus nantongensis |
| SBP00109 | Squash gourd | Cupriavidus nantongensis |
| SBP00109 | Squash gourd | Cupriavidus nantongensis |
| SBP00109 | Squash gourd | Cupriavidus nantongensis |
| SBP00109 | Squash gourd | Cupriavidus necator |
| SBP00109 | Squash gourd | Cupriavidus necator |
| SBP00109 | Squash gourd | Cupriavidus necator |
| SBP00109 | Squash gourd | Cupriavidus necator |
| SBP00109 | Squash gourd | Cupriavidus necator |
| SBP00109 | Squash gourd | Cupriavidus necator |
| SBP00109 | Squash gourd | Cupriavidus oxalaticus |
| SBP00109 | Squash gourd | Cupriavidus oxalaticus |
| SBP00109 | Squash gourd | Cupriavidus oxalaticus |
| SBP00109 | Squash gourd | Cupriavidus oxalaticus |
| SBP00109 | Squash gourd | Cupriavidus oxalaticus |

TABLE 3-continued

List of species identified in each metagenomic sample of each SBP Sample

| SBP ID | SBP Host Common Name | Genus sp. |
|---|---|---|
| SBP00109 | Squash gourd | *Cupriavidus oxalaticus* |
| SBP00109 | Squash gourd | *Cupriavidus pauculus* |
| SBP00109 | Squash gourd | *Cupriavidus pauculus* |
| SBP00109 | Squash gourd | *Cupriavidus pauculus* |
| SBP00109 | Squash gourd | *Cupriavidus pauculus* |
| SBP00109 | Squash gourd | *Cupriavidus pauculus* |
| SBP00109 | Squash gourd | *Cupriavidus pauculus* |
| SBP00109 | Squash gourd | *Cupriavidus pinatubonensis* |
| SBP00109 | Squash gourd | *Cupriavidus pinatubonensis* |
| SBP00109 | Squash gourd | *Cupriavidus pinatubonensis* |
| SBP00109 | Squash gourd | *Cupriavidus pinatubonensis* |
| SBP00109 | Squash gourd | *Cupriavidus pinatubonensis* |
| SBP00109 | Squash gourd | *Cupriavidus pinatubonensis* |
| SBP00109 | Squash gourd | *Cupriavidus taiwanensis* |
| SBP00109 | Squash gourd | *Cupriavidus taiwanensis* |
| SBP00109 | Squash gourd | *Cupriavidus taiwanensis* |
| SBP00109 | Squash gourd | *Cupriavidus taiwanensis* |
| SBP00109 | Squash gourd | *Cupriavidus taiwanensis* |
| SBP00109 | Squash gourd | *Cupriavidus taiwanensis* |
| SBP00109 | Squash gourd | *Cutibacterium acnes* |
| SBP00109 | Squash gourd | *Cutibacterium acnes* |
| SBP00109 | Squash gourd | *Cutibacterium acnes* |
| SBP00109 | Squash gourd | *Cutibacterium acnes* |
| SBP00109 | Squash gourd | *Cutibacterium acnes* |
| SBP00109 | Squash gourd | *Cutibacterium acnes* |
| SBP00109 | Squash gourd | *Deinococcus geothermalis* |
| SBP00109 | Squash gourd | *Deinococcus geothermalis* |
| SBP00109 | Squash gourd | *Deinococcus geothermalis* |
| SBP00109 | Squash gourd | *Deinococcus geothermalis* |
| SBP00109 | Squash gourd | *Deinococcus geothermalis* |
| SBP00109 | Squash gourd | *Deinococcus geothermalis* |
| SBP00109 | Squash gourd | *Delftia tsuruhatensis* |
| SBP00109 | Squash gourd | *Delftia tsuruhatensis* |
| SBP00109 | Squash gourd | *Delftia tsuruhatensis* |
| SBP00109 | Squash gourd | *Delftia tsuruhatensis* |
| SBP00109 | Squash gourd | *Delftia tsuruhatensis* |
| SBP00109 | Squash gourd | *Delftia tsuruhatensis* |
| SBP00109 | Squash gourd | *Devosia* sp. H5989 |
| SBP00109 | Squash gourd | *Devosia* sp. H5989 |
| SBP00109 | Squash gourd | *Devosia* sp. H5989 |
| SBP00109 | Squash gourd | *Devosia* sp. H5989 |
| SBP00109 | Squash gourd | *Devosia* sp. H5989 |
| SBP00109 | Squash gourd | *Devosia* sp. H5989 |
| SBP00109 | Squash gourd | *Ensifer adhaerens* |
| SBP00109 | Squash gourd | *Ensifer adhaerens* |
| SBP00109 | Squash gourd | *Ensifer adhaerens* |
| SBP00109 | Squash gourd | *Ensifer adhaerens* |
| SBP00109 | Squash gourd | *Ensifer adhaerens* |
| SBP00109 | Squash gourd | *Ensifer adhaerens* |
| SBP00109 | Squash gourd | *Ensifer sojae* |
| SBP00109 | Squash gourd | *Ensifer sojae* |
| SBP00109 | Squash gourd | *Ensifer sojae* |
| SBP00109 | Squash gourd | *Ensifer sojae* |
| SBP00109 | Squash gourd | *Ensifer sojae* |
| SBP00109 | Squash gourd | *Ensifer sojae* |
| SBP00109 | Squash gourd | *Enterobacter cloacae* |
| SBP00109 | Squash gourd | *Enterobacter cloacae* |
| SBP00109 | Squash gourd | *Enterobacter cloacae* |
| SBP00109 | Squash gourd | *Enterobacter cloacae* |
| SBP00109 | Squash gourd | *Enterobacter cloacae* |
| SBP00109 | Squash gourd | *Enterobacter cloacae* |
| SBP00109 | Squash gourd | *Enterococcus faecium* |
| SBP00109 | Squash gourd | *Enterococcus faecium* |
| SBP00109 | Squash gourd | *Enterococcus faecium* |
| SBP00109 | Squash gourd | *Enterococcus faecium* |
| SBP00109 | Squash gourd | *Enterococcus faecium* |
| SBP00109 | Squash gourd | *Enterococcus faecium* |
| SBP00109 | Squash gourd | *Finegoldia magna* |
| SBP00109 | Squash gourd | *Finegoldia magna* |
| SBP00109 | Squash gourd | *Finegoldia magna* |
| SBP00109 | Squash gourd | *Finegoldia magna* |
| SBP00109 | Squash gourd | *Finegoldia magna* |
| SBP00109 | Squash gourd | *Finegoldia magna* |
| SBP00109 | Squash gourd | *Friedmanniella luteola* |
| SBP00109 | Squash gourd | *Friedmanniella luteola* |
| SBP00109 | Squash gourd | *Friedmanniella luteola* |

TABLE 3-continued

List of species identified in each metagenomic sample of each SBP Sample

| SBP ID | SBP Host Common Name | Genus sp. |
|---|---|---|
| SBP00109 | Squash gourd | *Friedmanniella luteola* |
| SBP00109 | Squash gourd | *Friedmanniella luteola* |
| SBP00109 | Squash gourd | *Friedmanniella luteola* |
| SBP00109 | Squash gourd | *Friedmanniella sagamiharensis* |
| SBP00109 | Squash gourd | *Friedmanniella sagamiharensis* |
| SBP00109 | Squash gourd | *Friedmanniella sagamiharensis* |
| SBP00109 | Squash gourd | *Friedmanniella sagamiharensis* |
| SBP00109 | Squash gourd | *Friedmanniella sagamiharensis* |
| SBP00109 | Squash gourd | *Friedmanniella sagamiharensis* |
| SBP00109 | Squash gourd | *Gardnerella vaginalis* |
| SBP00109 | Squash gourd | *Gardnerella vaginalis* |
| SBP00109 | Squash gourd | *Gardnerella vaginalis* |
| SBP00109 | Squash gourd | *Gardnerella vaginalis* |
| SBP00109 | Squash gourd | *Gardnerella vaginalis* |
| SBP00109 | Squash gourd | *Gardnerella vaginalis* |
| SBP00109 | Squash gourd | *Geodermatophilus obscurus* |
| SBP00109 | Squash gourd | *Geodermatophilus obscurus* |
| SBP00109 | Squash gourd | *Geodermatophilus obscurus* |
| SBP00109 | Squash gourd | *Geodermatophilus obscurus* |
| SBP00109 | Squash gourd | *Geodermatophilus obscurus* |
| SBP00109 | Squash gourd | *Geodermatophilus obscurus* |
| SBP00109 | Squash gourd | *Georgenia* sp. ZLJ0423 |
| SBP00109 | Squash gourd | *Georgenia* sp. ZLJ0423 |
| SBP00109 | Squash gourd | *Georgenia* sp. ZLJ0423 |
| SBP00109 | Squash gourd | *Georgenia* sp. ZLJ0423 |
| SBP00109 | Squash gourd | *Georgenia* sp. ZLJ0423 |
| SBP00109 | Squash gourd | *Georgenia* sp. ZLJ0423 |
| SBP00109 | Squash gourd | *Gibbsiella quercinecans* |
| SBP00109 | Squash gourd | *Gibbsiella quercinecans* |
| SBP00109 | Squash gourd | *Gibbsiella quercinecans* |
| SBP00109 | Squash gourd | *Gibbsiella quercinecans* |
| SBP00109 | Squash gourd | *Gibbsiella quercinecans* |
| SBP00109 | Squash gourd | *Gibbsiella quercinecans* |
| SBP00109 | Squash gourd | *Halomonas aestuarii* |
| SBP00109 | Squash gourd | *Halomonas aestuarii* |
| SBP00109 | Squash gourd | *Halomonas aestuarii* |
| SBP00109 | Squash gourd | *Halomonas aestuarii* |
| SBP00109 | Squash gourd | *Halomonas aestuarii* |
| SBP00109 | Squash gourd | *Halomonas aestuarii* |
| SBP00109 | Squash gourd | *Halomonas* sp. JS92-SW72 |
| SBP00109 | Squash gourd | *Halomonas* sp. JS92-SW72 |
| SBP00109 | Squash gourd | *Halomonas* sp. JS92-SW72 |
| SBP00109 | Squash gourd | *Halomonas* sp. JS92-SW72 |
| SBP00109 | Squash gourd | *Halomonas* sp. JS92-SW72 |
| SBP00109 | Squash gourd | *Halomonas* sp. JS92-SW72 |
| SBP00109 | Squash gourd | *Halothece* sp. PCC 7418 |
| SBP00109 | Squash gourd | *Halothece* sp. PCC 7418 |
| SBP00109 | Squash gourd | *Halothece* sp. PCC 7418 |
| SBP00109 | Squash gourd | *Halothece* sp. PCC 7418 |
| SBP00109 | Squash gourd | *Halothece* sp. PCC 7418 |
| SBP00109 | Squash gourd | *Halothece* sp. PCC 7418 |
| SBP00109 | Squash gourd | *Herbaspirillum hiltneri* |
| SBP00109 | Squash gourd | *Herbaspirillum hiltneri* |
| SBP00109 | Squash gourd | *Herbaspirillum hiltneri* |
| SBP00109 | Squash gourd | *Herbaspirillum hiltneri* |
| SBP00109 | Squash gourd | *Herbaspirillum hiltneri* |
| SBP00109 | Squash gourd | *Herbaspirillum hiltneri* |
| SBP00109 | Squash gourd | *Herbaspirillum huttiense* |
| SBP00109 | Squash gourd | *Herbaspirillum huttiense* |
| SBP00109 | Squash gourd | *Herbaspirillum huttiense* |
| SBP00109 | Squash gourd | *Herbaspirillum huttiense* |
| SBP00109 | Squash gourd | *Herbaspirillum huttiense* |
| SBP00109 | Squash gourd | *Herbaspirillum huttiense* |
| SBP00109 | Squash gourd | *Herbaspirillum seropedicae* |
| SBP00109 | Squash gourd | *Herbaspirillum seropedicae* |
| SBP00109 | Squash gourd | *Herbaspirillum seropedicae* |
| SBP00109 | Squash gourd | *Herbaspirillum seropedicae* |
| SBP00109 | Squash gourd | *Herbaspirillum seropedicae* |
| SBP00109 | Squash gourd | *Herbaspirillum seropedicae* |
| SBP00109 | Squash gourd | *Hydrogenophaga crassostreae* |
| SBP00109 | Squash gourd | *Hydrogenophaga crassostreae* |
| SBP00109 | Squash gourd | *Hydrogenophaga crassostreae* |
| SBP00109 | Squash gourd | *Hydrogenophaga crassostreae* |
| SBP00109 | Squash gourd | *Hydrogenophaga crassostreae* |
| SBP00109 | Squash gourd | *Hydrogenophaga crassostreae* |
| SBP00109 | Squash gourd | *Hydrogenophaga* sp. NH-16 |

TABLE 3-continued

List of species identified in each metagenomic sample of each SBP Sample

| SBP ID | SBP Host Common Name | Genus sp. |
|---|---|---|
| SBP00109 | Squash gourd | Hydrogenophaga sp. NH-16 |
| SBP00109 | Squash gourd | Hydrogenophaga sp. NH-16 |
| SBP00109 | Squash gourd | Hydrogenophaga sp. NH-16 |
| SBP00109 | Squash gourd | Hydrogenophaga sp. NH-16 |
| SBP00109 | Squash gourd | Hydrogenophaga sp. NH-16 |
| SBP00109 | Squash gourd | Hydrogenophaga sp. PBC |
| SBP00109 | Squash gourd | Hydrogenophaga sp. PBC |
| SBP00109 | Squash gourd | Hydrogenophaga sp. PBC |
| SBP00109 | Squash gourd | Hydrogenophaga sp. PBC |
| SBP00109 | Squash gourd | Hydrogenophaga sp. PBC |
| SBP00109 | Squash gourd | Hydrogenophaga sp. PBC |
| SBP00109 | Squash gourd | Hydrogenophaga sp. RAC07 |
| SBP00109 | Squash gourd | Hydrogenophaga sp. RAC07 |
| SBP00109 | Squash gourd | Hydrogenophaga sp. RAC07 |
| SBP00109 | Squash gourd | Hydrogenophaga sp. RAC07 |
| SBP00109 | Squash gourd | Hydrogenophaga sp. RAC07 |
| SBP00109 | Squash gourd | Hydrogenophaga sp. RAC07 |
| SBP00109 | Squash gourd | Hylemonella gracilis |
| SBP00109 | Squash gourd | Hylemonella gracilis |
| SBP00109 | Squash gourd | Hylemonella gracilis |
| SBP00109 | Squash gourd | Hylemonella gracilis |
| SBP00109 | Squash gourd | Hylemonella gracilis |
| SBP00109 | Squash gourd | Inhella inkyongensis |
| SBP00109 | Squash gourd | Inhella inkyongensis |
| SBP00109 | Squash gourd | Inhella inkyongensis |
| SBP00109 | Squash gourd | Inhella inkyongensis |
| SBP00109 | Squash gourd | Inhella inkyongensis |
| SBP00109 | Squash gourd | Inhella inkyongensis |
| SBP00109 | Squash gourd | Isoptericola dokdonensis |
| SBP00109 | Squash gourd | isoptericola dokdonensis |
| SBP00109 | Squash gourd | Isoptericola dokdonensis |
| SBP00109 | Squash gourd | Isoptericola dokdonensis |
| SBP00109 | Squash gourd | Isoptericola dokdonensis |
| SBP00109 | Squash gourd | isoptericola dokdonensis |
| SBP00109 | Squash gourd | Isoptericola variabilis |
| SBP00109 | Squash gourd | Isoptericola variabilis |
| SBP00109 | Squash gourd | Isoptericola variabilis |
| SBP00109 | Squash gourd | Isoptericola variabilis |
| SBP00109 | Squash gourd | Isoptericola variabilis |
| SBP00109 | Squash gourd | Isoptericola variabilis |
| SBP00109 | Squash gourd | Janibacter indicus |
| SBP00109 | Squash gourd | Janibacter indicus |
| SBP00109 | Squash gourd | Janibacter indicus |
| SBP00109 | Squash gourd | Janibacter indicus |
| SBP00109 | Squash gourd | Janibacter indicus |
| SBP00109 | Squash gourd | Janibacter indicus |
| SBP00109 | Squash gourd | Janthinobacterium agaricidamnosum |
| SBP00109 | Squash gourd | Janthinobacterium agaricidamnosum |
| SBP00109 | Squash gourd | Janthinobacterium agaricidamnosum |
| SBP00109 | Squash gourd | Janthinobacterium agaricidamnosum |
| SBP00109 | Squash gourd | Janthinobacterium agaricidamnosum |
| SBP00109 | Squash gourd | Janthinobacterium agaricidamnosum |
| SBP00109 | Squash gourd | Janthinobacterium svalbardensis |
| SBP00109 | Squash gourd | Janthinobacterium svalbardensis |
| SBP00109 | Squash gourd | Janthinobacterium svalbardensis |
| SBP00109 | Squash gourd | Janthinobacterium svalbardensis |
| SBP00109 | Squash gourd | Janthinobacterium svalbardensis |
| SBP00109 | Squash gourd | Janthinobacterium svalbardensis |
| SBP00109 | Squash gourd | Kibdelosporangium phytohabitans |
| SBP00109 | Squash gourd | Kibdelosporangium phytohabitans |
| SBP00109 | Squash gourd | Kibdelosporangium phytohabitans |
| SBP00109 | Squash gourd | Kibdelosporangium phytohabitans |
| SBP00109 | Squash gourd | Kibdelosporangium phytohabitans |
| SBP00109 | Squash gourd | Kibdelosporangium phytohabitans |
| SBP00109 | Squash gourd | Klebsiella pneumoniae |
| SBP00109 | Squash gourd | Klebsiella pneumoniae |
| SBP00109 | Squash gourd | Klebsiella pneumoniae |
| SBP00109 | Squash gourd | Klebsiella pneumoniae |
| SBP00109 | Squash gourd | Klebsiella pneumoniae |
| SBP00109 | Squash gourd | Klebsiella pneumoniae |
| SBP00109 | Squash gourd | Kluyvera intermedia |
| SBP00109 | Squash gourd | Kluyvera intermedia |
| SBP00109 | Squash gourd | Kluyvera intermedia |
| SBP00109 | Squash gourd | Kluyvera intermedia |
| SBP00109 | Squash gourd | Kluyvera intermedia |

TABLE 3-continued

List of species identified in each metagenomic sample of each SBP Sample

| SBP ID | SBP Host Common Name | Genus sp. |
|---|---|---|
| SBP00109 | Squash gourd | *Kluyvera intermedia* |
| SBP00109 | Squash gourd | *Kocuria flava* |
| SBP00109 | Squash gourd | *Kocuria flava* |
| SBP00109 | Squash gourd | *Kocuria flava* |
| SBP00109 | Squash gourd | *Kocuria flava* |
| SBP00109 | Squash gourd | *Kocuria flava* |
| SBP00109 | Squash gourd | *Kocuria flava* |
| SBP00109 | Squash gourd | *Kocuria indica* |
| SBP00109 | Squash gourd | *Kocuria indica* |
| SBP00109 | Squash gourd | *Kocuria indica* |
| SBP00109 | Squash gourd | *Kocuria indica* |
| SBP00109 | Squash gourd | *Kocuria indica* |
| SBP00109 | Squash gourd | *Kocuria indica* |
| SBP00109 | Squash gourd | *Kocuria palustris* |
| SBP00109 | Squash gourd | *Kocuria palustris* |
| SBP00109 | Squash gourd | *Kocuria palustris* |
| SBP00109 | Squash gourd | *Kocuria palustris* |
| SBP00109 | Squash gourd | *Kocuria palustris* |
| SBP00109 | Squash gourd | *Kocuria palustris* |
| SBP00109 | Squash gourd | *Kocuria rosea* |
| SBP00109 | Squash gourd | *Kocuria rosea* |
| SBP00109 | Squash gourd | *Kocuria rosea* |
| SBP00109 | Squash gourd | *Kocuria rosea* |
| SBP00109 | Squash gourd | *Kocuria rosea* |
| SBP00109 | Squash gourd | *Kocuria rosea* |
| SBP00109 | Squash gourd | *Kocuria turfanensis* |
| SBP00109 | Squash gourd | *Kocuria turfanensis* |
| SBP00109 | Squash gourd | *Kocuria turfanensis* |
| SBP00109 | Squash gourd | *Kocuria turfanensis* |
| SBP00109 | Squash gourd | *Kocuria turfanensis* |
| SBP00109 | Squash gourd | *Kocuria turfanensis* |
| SBP00109 | Squash gourd | *Kytococcus sedentarius* |
| SBP00109 | Squash gourd | *Kytococcus sedentarius* |
| SBP00109 | Squash gourd | *Kytococcus sedentarius* |
| SBP00109 | Squash gourd | *Kytococcus sedentarius* |
| SBP00109 | Squash gourd | *Kytococcus sedentarius* |
| SBP00109 | Squash gourd | *Kytococcus sedentarius* |
| SBP00109 | Squash gourd | *Lactobacillus brevis* |
| SBP00109 | Squash gourd | *Lactobacillus brevis* |
| SBP00109 | Squash gourd | *Lactobacillus brevis* |
| SBP00109 | Squash gourd | *Lactobacillus brevis* |
| SBP00109 | Squash gourd | *Lactobacillus brevis* |
| SBP00109 | Squash gourd | *Lactobacillus brevis* |
| SBP00109 | Squash gourd | *Lactobacillus curvatus* |
| SBP00109 | Squash gourd | *Lactobacillus curvatus* |
| SBP00109 | Squash gourd | *Lactobacillus curvatus* |
| SBP00109 | Squash gourd | *Lactobacillus curvatus* |
| SBP00109 | Squash gourd | *Lactobacillus curvatus* |
| SBP00109 | Squash gourd | *Lactobacillus curvatus* |
| SBP00109 | Squash gourd | *Lactobacillus delbrueckii* |
| SBP00109 | Squash gourd | *Lactobacillus delbrueckii* |
| SBP00109 | Squash gourd | *Lactobacillus delbrueckii* |
| SBP00109 | Squash gourd | *Lactobacillus delbrueckii* |
| SBP00109 | Squash gourd | *Lactobacillus delbrueckii* |
| SBP00109 | Squash gourd | *Lactobacillus delbrueckii* |
| SBP00109 | Squash gourd | *Lactobacillus fermentum* |
| SBP00109 | Squash gourd | *Lactobacillus fermentum* |
| SBP00109 | Squash gourd | *Lactobacillus fermentum* |
| SBP00109 | Squash gourd | *Lactobacillus fermentum* |
| SBP00109 | Squash gourd | *Lactobacillus fermentum* |
| SBP00109 | Squash gourd | *Lactobacillus fermentum* |
| SBP00109 | Squash gourd | *Lactobacillus helveticus* |
| SBP00109 | Squash gourd | *Lactobacillus helveticus* |
| SBP00109 | Squash gourd | *Lactobacillus helveticus* |
| SBP00109 | Squash gourd | *Lactobacillus helveticus* |
| SBP00109 | Squash gourd | *Lactobacillus helveticus* |
| SBP00109 | Squash gourd | *Lactobacillus helveticus* |
| SBP00109 | Squash gourd | *Lactobacillus johnsonii* |
| SBP00109 | Squash gourd | *Lactobacillus johnsonii* |
| SBP00109 | Squash gourd | *Lactobacillus johnsonii* |
| SBP00109 | Squash gourd | *Lactobacillus johnsonii* |
| SBP00109 | Squash gourd | *Lactobacillus johnsonii* |
| SBP00109 | Squash gourd | *Lactobacillus johnsonii* |
| SBP00109 | Squash gourd | *Lactobacillus koreensis* |
| SBP00109 | Squash gourd | *Lactobacillus koreensis* |
| SBP00109 | Squash gourd | *Lactobacillus koreensis* |

TABLE 3-continued

List of species identified in each metagenomic sample of each SBP Sample

| SBP ID | SBP Host Common Name | Genus sp. |
|---|---|---|
| SBP00109 | Squash gourd | *Lactobacillus koreensis* |
| SBP00109 | Squash gourd | *Lactobacillus koreensis* |
| SBP00109 | Squash gourd | *Lactobacillus koreensis* |
| SBP00109 | Squash gourd | *Lactobacillus paracasei* |
| SBP00109 | Squash gourd | *Lactobacillus paracasei* |
| SBP00109 | Squash gourd | *Lactobacillus paracasei* |
| SBP00109 | Squash gourd | *Lactobacillus paracasei* |
| SBP00109 | Squash gourd | *Lactobacillus paracasei* |
| SBP00109 | Squash gourd | *Lactobacillus paracasei* |
| SBP00109 | Squash gourd | *Lactobacillus plantarum* |
| SBP00109 | Squash gourd | *Lactobacillus plantarum* |
| SBP00109 | Squash gourd | *Lactobacillus plantarum* |
| SBP00109 | Squash gourd | *Lactobacillus plantarum* |
| SBP00109 | Squash gourd | *Lactobacillus plantarum* |
| SBP00109 | Squash gourd | *Lactobacillus plantarum* |
| SBP00109 | Squash gourd | *Lactobacillus sakei* |
| SBP00109 | Squash gourd | *Lactobacillus sakei* |
| SBP00109 | Squash gourd | *Lactobacillus sakei* |
| SBP00109 | Squash gourd | *Lactobacillus sakei* |
| SBP00109 | Squash gourd | *Lactobacillus sakei* |
| SBP00109 | Squash gourd | *Lactobacillus sakei* |
| SBP00109 | Squash gourd | *Lactobacillus sanfranciscensis* |
| SBP00109 | Squash gourd | *Lactobacillus sanfranciscensis* |
| SBP00109 | Squash gourd | *Lactobacillus sanfranciscensis* |
| SBP00109 | Squash gourd | *Lactobacillus sanfranciscensis* |
| SBP00109 | Squash gourd | *Lactobacillus sanfranciscensis* |
| SBP00109 | Squash gourd | *Lactobacillus sanfranciscensis* |
| SBP00109 | Squash gourd | *Lactococcus garvieae* |
| SBP00109 | Squash gourd | *Lactococcus garvieae* |
| SBP00109 | Squash gourd | *Lactococcus garvieae* |
| SBP00109 | Squash gourd | *Lactococcus garvieae* |
| SBP00109 | Squash gourd | *Lactococcus garvieae* |
| SBP00109 | Squash gourd | *Lactococcus garvieae* |
| SBP00109 | Squash gourd | *Lactococcus lactis* |
| SBP00109 | Squash gourd | *Lactococcus lactis* |
| SBP00109 | Squash gourd | *Lactococcus lactis* |
| SBP00109 | Squash gourd | *Lactococcus lactis* |
| SBP00109 | Squash gourd | *Lactococcus lactis* |
| SBP00109 | Squash gourd | *Lactococcus lactis* |
| SBP00109 | Squash gourd | *Lactococcus phage* 28201 |
| SBP00109 | Squash gourd | *Lactococcus phage* 28201 |
| SBP00109 | Squash gourd | *Lactococcus phage* 28201 |
| SBP00109 | Squash gourd | *Lactococcus phage* 28201 |
| SBP00109 | Squash gourd | *Lactococcus phage* 28201 |
| SBP00109 | Squash gourd | *Lactococcus phage* 28201 |
| SBP00109 | Squash gourd | *Lactococcus phage* BK5-T |
| SBP00109 | Squash gourd | *Lactococcus phage* BK5-T |
| SBP00109 | Squash gourd | *Lactococcus phage* BK5-T |
| SBP00109 | Squash gourd | *Lactococcus phage* BK5-T |
| SBP00109 | Squash gourd | *Lactococcus phage* BK5-T |
| SBP00109 | Squash gourd | *Lactococcus phage* BK5-T |
| SBP00109 | Squash gourd | *Lactococcus phage* BM13 |
| SBP00109 | Squash gourd | *Lactococcus phage* BM13 |
| SBP00109 | Squash gourd | *Lactococcus phage* BM13 |
| SBP00109 | Squash gourd | *Lactococcus phage* BM13 |
| SBP00109 | Squash gourd | *Lactococcus phage* BM13 |
| SBP00109 | Squash gourd | *Lactococcus phage* BM13 |
| SBP00109 | Squash gourd | *Lactococcus phage* P335 *sensu lato* |
| SBP00109 | Squash gourd | *Lactococcus phage* P335 *sensu lato* |
| SBP00109 | Squash gourd | *Lactococcus phage* P335 *sensu lato* |
| SBP00109 | Squash gourd | *Lactococcus phage* P335 *sensu lato* |
| SBP00109 | Squash gourd | *Lactococcus phage* P335 *sensu lato* |
| SBP00109 | Squash gourd | *Lactococcus phage* P335 *sensu lato* |
| SBP00109 | Squash gourd | *Lactococcus phage* phil47 |
| SBP00109 | Squash gourd | *Lactococcus phage* phil47 |
| SBP00109 | Squash gourd | *Lactococcus phage* phil47 |
| SBP00109 | Squash gourd | *Lactococcus phage* phil47 |
| SBP00109 | Squash gourd | *Lactococcus phage* phil47 |
| SBP00109 | Squash gourd | *Lactococcus phage* phil47 |
| SBP00109 | Squash gourd | *Lactococcus phage* r1t |
| SBP00109 | Squash gourd | *Lactococcus phage* r1t |
| SBP00109 | Squash gourd | *Lactococcus phage* r1t |
| SBP00109 | Squash gourd | *Lactococcus phage* r1t |
| SBP00109 | Squash gourd | *Lactococcus phage* r1t |
| SBP00109 | Squash gourd | *Lactococcus phage* r1t |
| SBP00109 | Squash gourd | *Lactococcus phage* Tuc2009 |

TABLE 3-continued

List of species identified in each metagenomic sample of each SBP Sample

| SBP ID | SBP Host Common Name | Genus sp. |
|---|---|---|
| SBP00109 | Squash gourd | *Lactococcus phage* Tuc2009 |
| SBP00109 | Squash gourd | *Lactococcus phage* Tuc2009 |
| SBP00109 | Squash gourd | *Lactococcus phage* Tuc2009 |
| SBP00109 | Squash gourd | *Lactococcus phage* Tuc2009 |
| SBP00109 | Squash gourd | *Lactococcus phage* Tuc2009 |
| SBP00109 | Squash gourd | *Lactococcus phage* ul36 |
| SBP00109 | Squash gourd | *Lactococcus phage* ul36 |
| SBP00109 | Squash gourd | *Lactococcus phage* ul36 |
| SBP00109 | Squash gourd | *Lactococcus phage* ul36 |
| SBP00109 | Squash gourd | *Lactococcus phage* ul36 |
| SBP00109 | Squash gourd | *Lactococcus piscium* |
| SBP00109 | Squash gourd | *Lactococcus piscium* |
| SBP00109 | Squash gourd | *Lactococcus piscium* |
| SBP00109 | Squash gourd | *Lactococcus piscium* |
| SBP00109 | Squash gourd | *Lactococcus piscium* |
| SBP00109 | Squash gourd | *Lactococcus raffinolactis* |
| SBP00109 | Squash gourd | *Lactococcus raffinolactis* |
| SBP00109 | Squash gourd | *Lactococcus raffinolactis* |
| SBP00109 | Squash gourd | *Lactococcus raffinolactis* |
| SBP00109 | Squash gourd | *Lactococcus raffinolactis* |
| SBP00109 | Squash gourd | *Lactococcus raffinolactis* |
| SBP00109 | Squash gourd | *Lactococcus* sp. 1JSPR-7 |
| SBP00109 | Squash gourd | *Lactococcus* sp. 1JSPR-7 |
| SBP00109 | Squash gourd | *Lactococcus* sp. 1JSPR-7 |
| SBP00109 | Squash gourd | *Lactococcus* sp. 1JSPR-7 |
| SBP00109 | Squash gourd | *Lactococcus* sp. 1JSPR-7 |
| SBP00109 | Squash gourd | *Lactococcus* sp. 1JSPR-7 |
| SBP00109 | Squash gourd | *Leifsonia xyli* |
| SBP00109 | Squash gourd | *Leifsonia xyli* |
| SBP00109 | Squash gourd | *Leifsonia xyli* |
| SBP00109 | Squash gourd | *Leifsonia xyli* |
| SBP00109 | Squash gourd | *Leifsonia xyli* |
| SBP00109 | Squash gourd | *Leifsonia xyli* |
| SBP00109 | Squash gourd | *Leptothrix cholodnii* |
| SBP00109 | Squash gourd | *Leptothrix cholodnii* |
| SBP00109 | Squash gourd | *Leptothrix cholodnii* |
| SBP00109 | Squash gourd | *Leptothrix cholodnii* |
| SBP00109 | Squash gourd | *Leptothrix cholodnii* |
| SBP00109 | Squash gourd | *Leptothrix cholodnii* |
| SBP00109 | Squash gourd | *Leucobacter* sp. DSM 101948 |
| SBP00109 | Squash gourd | *Leucobacter* sp. DSM 101948 |
| SBP00109 | Squash gourd | *Leucobacter* sp. DSM 101948 |
| SBP00109 | Squash gourd | *Leucobacter* sp. DSM 101948 |
| SBP00109 | Squash gourd | *Leucobacter* sp. DSM 101948 |
| SBP00109 | Squash gourd | *Leucobacter* sp. DSM 101948 |
| SBP00109 | Squash gourd | *Leuconostoc carnosum* |
| SBP00109 | Squash gourd | *Leuconostoc carnosum* |
| SBP00109 | Squash gourd | *Leuconostoc carnosum* |
| SBP00109 | Squash gourd | *Leuconostoc carnosum* |
| SBP00109 | Squash gourd | *Leuconostoc carnosum* |
| SBP00109 | Squash gourd | *Leuconostoc carnosum* |
| SBP00109 | Squash gourd | *Leuconostoc citreum* |
| SBP00109 | Squash gourd | *Leuconostoc citreum* |
| SBP00109 | Squash gourd | *Leuconostoc citreum* |
| SBP00109 | Squash gourd | *Leuconostoc citreum* |
| SBP00109 | Squash gourd | *Leuconostoc citreum* |
| SBP00109 | Squash gourd | *Leuconostoc citreum* |
| SBP00109 | Squash gourd | *Leuconostoc gelidum* |
| SBP00109 | Squash gourd | *Leuconostoc gelidum* |
| SBP00109 | Squash gourd | *Leuconostoc gelidum* |
| SBP00109 | Squash gourd | *Leuconostoc gelidum* |
| SBP00109 | Squash gourd | *Leuconostoc gelidum* |
| SBP00109 | Squash gourd | *Leuconostoc gelidum* |
| SBP00109 | Squash gourd | *Leuconostoc kimchii* |
| SBP00109 | Squash gourd | *Leuconostoc kimchii* |
| SBP00109 | Squash gourd | *Leuconostoc kimchii* |
| SBP00109 | Squash gourd | *Leuconostoc kimchii* |
| SBP00109 | Squash gourd | *Leuconostoc kimchii* |
| SBP00109 | Squash gourd | *Leuconostoc kimchii* |
| SBP00109 | Squash gourd | *Leuconostoc lactis* |
| SBP00109 | Squash gourd | *Leuconostoc lactis* |
| SBP00109 | Squash gourd | *Leuconostoc lactis* |
| SBP00109 | Squash gourd | *Leuconostoc lactis* |
| SBP00109 | Squash gourd | *Leuconostoc lactis* |

TABLE 3-continued

List of species identified in each metagenomic sample of each SBP Sample

| SBP ID | SBP Host Common Name | Genus sp. |
|---|---|---|
| SBP00109 | Squash gourd | *Leuconostoc lactis* |
| SBP00109 | Squash gourd | *Leuconostoc mesenteroides* |
| SBP00109 | Squash gourd | *Leuconostoc mesenteroides* |
| SBP00109 | Squash gourd | *Leuconostoc mesenteroides* |
| SBP00109 | Squash gourd | *Leuconostoc mesenteroides* |
| SBP00109 | Squash gourd | *Leuconostoc mesenteroides* |
| SBP00109 | Squash gourd | *Leuconostoc mesenteroides* |
| SBP00109 | Squash gourd | *Leuconostoc suionicum* |
| SBP00109 | Squash gourd | *Leuconostoc suionicum* |
| SBP00109 | Squash gourd | *Leuconostoc suionicum* |
| SBP00109 | Squash gourd | *Leuconostoc suionicum* |
| SBP00109 | Squash gourd | *Leuconostoc suionicum* |
| SBP00109 | Squash gourd | *Leuconostoc suionicum* |
| SBP00109 | Squash gourd | *Limnohabitans* sp. 63ED37-2 |
| SBP00109 | Squash gourd | *Limnohabitans* sp. 63ED37-2 |
| SBP00109 | Squash gourd | *Limnohabitans* sp. 63ED37-2 |
| SBP00109 | Squash gourd | *Limnohabitans* sp. 63ED37-2 |
| SBP00109 | Squash gourd | *Limnohabitans* sp. 63ED37-2 |
| SBP00109 | Squash gourd | *Limnohabitans* sp. 63ED37-2 |
| SBP00109 | Squash gourd | *Lysinimonas* sp. 2DFWR-13 |
| SBP00109 | Squash gourd | *Lysinimonas* sp. 2DFWR-13 |
| SBP00109 | Squash gourd | *Lysinimonas* sp. 2DFWR-13 |
| SBP00109 | Squash gourd | *Lysinimonas* sp. 2DFWR-13 |
| SBP00109 | Squash gourd | *Lysinimonas* sp. 2DFWR-13 |
| SBP00109 | Squash gourd | *Lysinimonas* sp. 2DFWR-13 |
| SBP00109 | Squash gourd | *Marmoricola scoriae* |
| SBP00109 | Squash gourd | *Marmoricola scoriae* |
| SBP00109 | Squash gourd | *Marmoricola scoriae* |
| SBP00109 | Squash gourd | *Marmoricola scoriae* |
| SBP00109 | Squash gourd | *Marmoricola scoriae* |
| SBP00109 | Squash gourd | *Massilia albidiflava* |
| SBP00109 | Squash gourd | *Massilia albidiflava* |
| SBP00109 | Squash gourd | *Massilia albidiflava* |
| SBP00109 | Squash gourd | *Massilia albidiflava* |
| SBP00109 | Squash gourd | *Massilia albidiflava* |
| SBP00109 | Squash gourd | *Massilia albidiflava* |
| SBP00109 | Squash gourd | *Massilia lutea* |
| SBP00109 | Squash gourd | *Massilia lutea* |
| SBP00109 | Squash gourd | *Massilia lutea* |
| SBP00109 | Squash gourd | *Massilia lutea* |
| SBP00109 | Squash gourd | *Massilia lutea* |
| SBP00109 | Squash gourd | *Massilia lutea* |
| SBP00109 | Squash gourd | *Massilia oculi* |
| SBP00109 | Squash gourd | *Massilia oculi* |
| SBP00109 | Squash gourd | *Massilia oculi* |
| SBP00109 | Squash gourd | *Massilia oculi* |
| SBP00109 | Squash gourd | *Massilia oculi* |
| SBP00109 | Squash gourd | *Massilia oculi* |
| SBP00109 | Squash gourd | *Massilia* sp. WG5 |
| SBP00109 | Squash gourd | *Massilia* sp. WG5 |
| SBP00109 | Squash gourd | *Massilia* sp. WG5 |
| SBP00109 | Squash gourd | *Massilia* sp. WG5 |
| SBP00109 | Squash gourd | *Massilia* sp. WG5 |
| SBP00109 | Squash gourd | *Massilia* sp. WG5 |
| SBP00109 | Squash gourd | *Massilia* sp. YMA4 |
| SBP00109 | Squash gourd | *Massilia* sp. YMA4 |
| SBP00109 | Squash gourd | *Massilia* sp. YMA4 |
| SBP00109 | Squash gourd | *Massilia* sp. YMA4 |
| SBP00109 | Squash gourd | *Massilia* sp. YMA4 |
| SBP00109 | Squash gourd | *Massilia* sp. YMA4 |
| SBP00109 | Squash gourd | *Massilia violaceinigra* |
| SBP00109 | Squash gourd | *Massilia violaceinigra* |
| SBP00109 | Squash gourd | *Massilia violaceinigra* |
| SBP00109 | Squash gourd | *Massilia violaceinigra* |
| SBP00109 | Squash gourd | *Massilia violaceinigra* |
| SBP00109 | Squash gourd | *Massilia violaceinigra* |
| SBP00109 | Squash gourd | *Melaminivora* sp. SC2-7 |
| SBP00109 | Squash gourd | *Melaminivora* sp. SC2-7 |
| SBP00109 | Squash gourd | *Melaminivora* sp. SC2-7 |
| SBP00109 | Squash gourd | *Melaminivora* sp. SC2-7 |
| SBP00109 | Squash gourd | *Melaminivora* sp. SC2-7 |
| SBP00109 | Squash gourd | *Melaminivora* sp. SC2-7 |
| SBP00109 | Squash gourd | *Melaminivora* sp. SC2-9 |
| SBP00109 | Squash gourd | *Melaminivora* sp. SC2-9 |
| SBP00109 | Squash gourd | *Melaminivora* sp. SC2-9 |

TABLE 3-continued

List of species identified in each metagenomic sample of each SBP Sample

| SBP ID | SBP Host Common Name | Genus sp. |
|---|---|---|
| SBP00109 | Squash gourd | *Melaminivora* sp. SC2-9 |
| SBP00109 | Squash gourd | *Melaminivora* sp. SC2-9 |
| SBP00109 | Squash gourd | *Melaminivora* sp. SC2-9 |
| SBP00109 | Squash gourd | *Mesorhizobium amorphae* |
| SBP00109 | Squash gourd | *Mesorhizobium amorphae* |
| SBP00109 | Squash gourd | *Mesorhizobium amorphae* |
| SBP00109 | Squash gourd | *Mesorhizobium amorphae* |
| SBP00109 | Squash gourd | *Mesorhizobium amorphae* |
| SBP00109 | Squash gourd | *Mesorhizobium amorphae* |
| SBP00109 | Squash gourd | *Mesorhizobium australicum* |
| SBP00109 | Squash gourd | *Mesorhizobium australicum* |
| SBP00109 | Squash gourd | *Mesorhizobium australicum* |
| SBP00109 | Squash gourd | *Mesorhizobium australicum* |
| SBP00109 | Squash gourd | *Mesorhizobium australicum* |
| SBP00109 | Squash gourd | *Mesorhizobium australicum* |
| SBP00109 | Squash gourd | *Mesorhizobium japonicum* |
| SBP00109 | Squash gourd | *Mesorhizobium japonicum* |
| SBP00109 | Squash gourd | *Mesorhizobium japonicum* |
| SBP00109 | Squash gourd | *Mesorhizobium japonicum* |
| SBP00109 | Squash gourd | *Mesorhizobium japonicum* |
| SBP00109 | Squash gourd | *Mesorhizobium loti* |
| SBP00109 | Squash gourd | *Mesorhizobium loti* |
| SBP00109 | Squash gourd | *Mesorhizobium loti* |
| SBP00109 | Squash gourd | *Mesorhizobium loti* |
| SBP00109 | Squash gourd | *Mesarhizobium loti* |
| SBP00109 | Squash gourd | *Mesorhizobium loti* |
| SBP00109 | Squash gourd | *Mesorhizobium oceanicum* |
| SBP00109 | Squash gourd | *Mesorhizobium oceanicum* |
| SBP00109 | Squash gourd | *Mesorhizobium oceanicum* |
| SBP00109 | Squash gourd | *Mesorhizobium oceanicum* |
| SBP00109 | Squash gourd | *Mesorhizobium oceanicum* |
| SBP00109 | Squash gourd | *Mesorhizobium oceanicum* |
| SBP00109 | Squash gourd | *Mesorhizobium* sp. DCY119 |
| SBP00109 | Squash gourd | *Mesorhizobium* sp. DCY119 |
| SBP00109 | Squash gourd | *Mesorhizobium* sp. DCY119 |
| SBP00109 | Squash gourd | *Mesorhizobium* sp. DCY119 |
| SBP00109 | Squash gourd | *Mesorhizobium* sp. DCY119 |
| SBP00109 | Squash gourd | *Mesorhizobium* sp. DCY119 |
| SBP00109 | Squash gourd | *Mesorhizobium* sp. M1B.F.Ca.ET.045.04.1.1 |
| SBP00109 | Squash gourd | *Mesorhizobium* sp. M1B.F.Ca.ET.045.04.1.1 |
| SBP00109 | Squash gourd | *Mesorhizobium* sp. M1B.F.Ca.ET.045.04.1.1 |
| SBP00109 | Squash gourd | *Mesorhizobium* sp. M1B.F.Ca.ET.045.04.1.1 |
| SBP00109 | Squash gourd | *Mesorhizobium* sp. M1B.F.Ca.ET.045.04.1.1 |
| SBP00109 | Squash gourd | *Mesorhizobium* sp. M1B.F.Ca.ET.045.04.1.1 |
| SBP00109 | Squash gourd | *Mesorhizobium* sp. M1D.F.Ca.ET.043.01.1.1 |
| SBP00109 | Squash gourd | *Mesorhizobium* sp. M1D.F.Ca.ET.043.01.1.1 |
| SBP00109 | Squash gourd | *Mesorhizobium* sp. M1D.F.Ca.ET.043.01.1.1 |
| SBP00109 | Squash gourd | *Mesorhizobium* sp. M1D.F.Ca.ET.043.01.1.1 |
| SBP00109 | Squash gourd | *Mesorhizobium* sp. M1D.F.Ca.ET.043.01.1.1 |
| SBP00109 | Squash gourd | *Mesorhizobium* sp. M1D.F.Ca.ET.043.01.1.1 |
| SBP00109 | Squash gourd | *Mesorhizobium* sp. M1E.F.Ca.ET.045.02.1.1 |
| SBP00109 | Squash gourd | *Mesorhizobium* sp. M1E.F.Ca.ET.045.02.1.1 |
| SBP00109 | Squash gourd | *Mesorhizobium* sp. M1E.F.Ca.ET.045.02.1.1 |
| SBP00109 | Squash gourd | *Mesorhizobium* sp. M1E.F.Ca.ET.045.02.1.1 |
| SBP00109 | Squash gourd | *Mesorhizobium* sp. M1E.F.Ca.ET.045.02.1.1 |
| SBP00109 | Squash gourd | *Mesorhizobium* sp. M1E.F.Ca.ET.045.02.1.1 |
| SBP00109 | Squash gourd | *Mesorhizobium* sp. M9A.F.Ca.ET.002.03.1.2 |
| SBP00109 | Squash gourd | *Mesorhizobium* sp. M9A.F.Ca.ET.002.03.1.2 |
| SBP00109 | Squash gourd | *Mesorhizobium* sp. M9A.F.Ca.ET.002.03.1.2 |
| SBP00109 | Squash gourd | *Mesorhizobium* sp. M9A.F.Ca.ET.002.03.1.2 |
| SBP00109 | Squash gourd | *Mesorhizobium* sp. M9A.F.Ca.ET.002.03.1.2 |
| SBP00109 | Squash gourd | *Mesorhizobium* sp. M9A.F.Ca.ET.002.03.1.2 |
| SBP00109 | Squash gourd | *Methylibium petroleiphilum* |
| SBP00109 | Squash gourd | *Methylibium petroleiphilum* |
| SBP00109 | Squash gourd | *Methylibium petroleiphilum* |
| SBP00109 | Squash gourd | *Methylibium petroleiphilum* |
| SBP00109 | Squash gourd | *Methylibium petroleiphilum* |
| SBP00109 | Squash gourd | *Methylibium petroleiphilum* |
| SBP00109 | Squash gourd | *Methylobacterium aquaticum* |
| SBP00109 | Squash gourd | *Methylobacterium aquaticum* |
| SBP00109 | Squash gourd | *Methylobacterium aquaticum* |
| SBP00109 | Squash gourd | *Methylobacterium aquaticum* |
| SBP00109 | Squash gourd | *Methylobacterium aquaticum* |
| SBP00109 | Squash gourd | *Methylobacterium aquaticum* |
| SBP00109 | Squash gourd | *Methylobacterium brachiatum* |

TABLE 3-continued

List of species identified in each metagenomic sample of each SBP Sample

| SBP ID | SBP Host Common Name | Genus sp. |
| --- | --- | --- |
| SBP00109 | Squash gourd | *Methylobacterium brachiatum* |
| SBP00109 | Squash gourd | *Methylobacterium brachiatum* |
| SBP00109 | Squash gourd | *Methylobacterium brachiatum* |
| SBP00109 | Squash gourd | *Methylobacterium brachiatum* |
| SBP00109 | Squash gourd | *Methylobacterium brachiatum* |
| SBP00109 | Squash gourd | *Methylobacterium currus* |
| SBP00109 | Squash gourd | *Methylobacterium currus* |
| SBP00109 | Squash gourd | *Methylobacterium currus* |
| SBP00109 | Squash gourd | *Methylobacterium currus* |
| SBP00109 | Squash gourd | *Methylobacterium currus* |
| SBP00109 | Squash gourd | *Methylobacterium nodulans* |
| SBP00109 | Squash gourd | *Methylobacterium nodulans* |
| SBP00109 | Squash gourd | *Methylobacterium nodulans* |
| SBP00109 | Squash gourd | *Methylobacterium nodulans* |
| SBP00109 | Squash gourd | *Methylobacterium nodulans* |
| SBP00109 | Squash gourd | *Methylobacterium nodulans* |
| SBP00109 | Squash gourd | *Methylobacterium phyllosphaerae* |
| SBP00109 | Squash gourd | *Methylobacterium phyllosphaerae* |
| SBP00109 | Squash gourd | *Methylobacterium phyllosphaerae* |
| SBP00109 | Squash gourd | *Methylobacterium phyllosphaerae* |
| SBP00109 | Squash gourd | *Methylobacterium phyllosphaerae* |
| SBP00109 | Squash gourd | *Methylobacterium phyllosphaerae* |
| SBP00109 | Squash gourd | *Methylobacterium radiotolerans* |
| SBP00109 | Squash gourd | *Methylobacterium radiotolerans* |
| SBP00109 | Squash gourd | *Methylobacterium radiotolerans* |
| SBP00109 | Squash gourd | *Methylobacterium radiotolerans* |
| SBP00109 | Squash gourd | *Methylobacterium radiotolerans* |
| SBP00109 | Squash gourd | *Methylobacterium radiotolerans* |
| SBP00109 | Squash gourd | *Methylobacterium* sp. 17SD2-17 |
| SBP00109 | Squash gourd | *Methylobacterium* sp. 17SD2-17 |
| SBP00109 | Squash gourd | *Methylobacterium* sp. 17SD2-17 |
| SBP00109 | Squash gourd | *Methylobacterium* sp. 17SD2-17 |
| SBP00109 | Squash gourd | *Methylobacterium* sp. 17SD2-17 |
| SBP00109 | Squash gourd | *Methylobacterium* sp. 17SD2-17 |
| SBP00109 | Squash gourd | *Methylobacterium* sp. 17Sr1-1 |
| SBP00109 | Squash gourd | *Methylobacterium* sp. 17Sr1-1 |
| SBP00109 | Squash gourd | *Methylobacterium* sp. 17Sr1-1 |
| SBP00109 | Squash gourd | *Methylobacterium* sp. 17Sr1-1 |
| SBP00109 | Squash gourd | *Methylobacterium* sp. 17Sr1-1 |
| SBP00109 | Squash gourd | *Methylobacterium* sp. 17Sr1-1 |
| SBP00109 | Squash gourd | *Methylobacterium* sp. 17Sr1-28 |
| SBP00109 | Squash gourd | *Methylobacterium* sp. 17Sr1-28 |
| SBP00109 | Squash gourd | *Methylobacterium* sp. 17Sr1-28 |
| SBP00109 | Squash gourd | *Methylobacterium* sp. 17Sr1-28 |
| SBP00109 | Squash gourd | *Methylobacterium* sp. 17Sr1-28 |
| SBP00109 | Squash gourd | *Methylobacterium* sp. 17Sr1-28 |
| SBP00109 | Squash gourd | *Methylobacterium* sp. 17Sr1-43 |
| SBP00109 | Squash gourd | *Methylobacterium* sp. 17Sr1-43 |
| SBP00109 | Squash gourd | *Methylobacterium* sp. 17Sr1-43 |
| SBP00109 | Squash gourd | *Methylobacterium* sp. 17Sr1-43 |
| SBP00109 | Squash gourd | *Methylobacterium* sp. 17Sr1-43 |
| SBP00109 | Squash gourd | *Methylobacterium* sp. 17Sr1-43 |
| SBP00109 | Squash gourd | *Methylobacterium* sp. 4-46 |
| SBP00109 | Squash gourd | *Methylobacterium* sp. 4-46 |
| SBP00109 | Squash gourd | *Methylobacterium* sp. 4-46 |
| SBP00109 | Squash gourd | *Methylobacterium* sp. 4-46 |
| SBP00109 | Squash gourd | *Methylobacterium* sp. 4-46 |
| SBP00109 | Squash gourd | *Methylobacterium* sp. 4-46 |
| SBP00109 | Squash gourd | *Methylobacterium* sp. C1 |
| SBP00109 | Squash gourd | *Methylobacterium* sp. C1 |
| SBP00109 | Squash gourd | *Methylobacterium* sp. C1 |
| SBP00109 | Squash gourd | *Methylobacterium* sp. C1 |
| SBP00109 | Squash gourd | *Methylobacterium* sp. C1 |
| SBP00109 | Squash gourd | *Methylobacterium* sp. C1 |
| SBP00109 | Squash gourd | *Methylobacterium* sp. DM1 |
| SBP00109 | Squash gourd | *Methylobacterium* sp. DM1 |
| SBP00109 | Squash gourd | *Methylobacterium* sp. DM1 |
| SBP00109 | Squash gourd | *Methylobacterium* sp. DM1 |
| SBP00109 | Squash gourd | *Methylobacterium* sp. DM1 |
| SBP00109 | Squash gourd | *Methylobacterium* sp. DM1 |
| SBP00109 | Squash gourd | *Methylobacterium* sp. XJLW |
| SBP00109 | Squash gourd | *Methylobacterium* sp. XJLW |
| SBP00109 | Squash gourd | *Methylobacterium* sp. XJLW |
| SBP00109 | Squash gourd | *Methylobacterium* sp. XJLW |
| SBP00109 | Squash gourd | *Methylobacterium* sp. XJLW |

TABLE 3-continued

List of species identified in each metagenomic sample of each SBP Sample

| SBP ID | SBP Host Common Name | Genus sp. |
|---|---|---|
| SBP00109 | Squash gourd | *Methylobacterium* sp. XJLW |
| SBP00109 | Squash gourd | *Methylocella silvestris* |
| SBP00109 | Squash gourd | *Methylocella silvestris* |
| SBP00109 | Squash gourd | *Methylocella silvestris* |
| SBP00109 | Squash gourd | *Methylocella silvestris* |
| SBP00109 | Squash gourd | *Methylocella silvestris* |
| SBP00109 | Squash gourd | *Methylocella silvestris* |
| SBP00109 | Squash gourd | *Methylorubrum extorquens* |
| SBP00109 | Squash gourd | *Methylorubrum extorquens* |
| SBP00109 | Squash gourd | *Methylorubrum extorquens* |
| SBP00109 | Squash gourd | *Methylorubrum extorquens* |
| SBP00109 | Squash gourd | *Methylorubrum extorquens* |
| SBP00109 | Squash gourd | *Methylorubrum extorquens* |
| SBP00109 | Squash gourd | *Methylorubrum populi* |
| SBP00109 | Squash gourd | *Methylorubrum populi* |
| SBP00109 | Squash gourd | *Methylorubrum populi* |
| SBP00109 | Squash gourd | *Methylorubrum populi* |
| SBP00109 | Squash gourd | *Methylorubrum populi* |
| SBP00109 | Squash gourd | *Methylorubrum populi* |
| SBP00109 | Squash gourd | *Methyloversatilis* sp. RAC08 |
| SBP00109 | Squash gourd | *Methyloversatilis* sp. RAC08 |
| SBP00109 | Squash gourd | *Methyloversatilis* sp. RAC08 |
| SBP00109 | Squash gourd | *Methyloversatilis* sp. RAC08 |
| SBP00109 | Squash gourd | *Methyloversatilis* sp. RAC08 |
| SBP00109 | Squash gourd | *Methyloversatilis* sp. RAC08 |
| SBP00109 | Squash gourd | *Microbacterium chocolatum* |
| SBP00109 | Squash gourd | *Microbacterium chocolatum* |
| SBP00109 | Squash gourd | *Microbacterium chocolatum* |
| SBP00109 | Squash gourd | *Microbacterium chocolatum* |
| SBP00109 | Squash gourd | *Microbacterium chocolatum* |
| SBP00109 | Squash gourd | *Microbacterium chocolatum* |
| SBP00109 | Squash gourd | *Microbacterium oxydans* |
| SBP00109 | Squash gourd | *Microbacterium oxydans* |
| SBP00109 | Squash gourd | *Microbacterium oxydans* |
| SBP00109 | Squash gourd | *Microbacterium oxydans* |
| SBP00109 | Squash gourd | *Microbacterium oxydans* |
| SBP00109 | Squash gourd | *Microbacterium oxydans* |
| SBP00109 | Squash gourd | *Microbacterium sediminis* |
| SBP00109 | Squash gourd | *Microbacterium sediminis* |
| SBP00109 | Squash gourd | *Microbacterium sediminis* |
| SBP00109 | Squash gourd | *Microbacterium sediminis* |
| SBP00109 | Squash gourd | *Microbacterium sediminis* |
| SBP00109 | Squash gourd | *Microbacterium sediminis* |
| SBP00109 | Squash gourd | *Microbacterium* sp. No. 7 |
| SBP00109 | Squash gourd | *Microbacterium* sp. No. 7 |
| SBP00109 | Squash gourd | *Microbacterium* sp. No. 7 |
| SBP00109 | Squash gourd | *Microbacterium* sp. No. 7 |
| SBP00109 | Squash gourd | *Microbacterium* sp. No. 7 |
| SBP00109 | Squash gourd | *Microbacterium* sp. No. 7 |
| SBP00109 | Squash gourd | *Microbacterium* sp. XT11 |
| SBP00109 | Squash gourd | *Microbacterium* sp. XT11 |
| SBP00109 | Squash gourd | *Microbacterium* sp. XT11 |
| SBP00109 | Squash gourd | *Microbacterium* sp. XT11 |
| SBP00109 | Squash gourd | *Microbacterium* sp. XT11 |
| SBP00109 | Squash gourd | *Microbacterium* sp. XT11 |
| SBP00109 | Squash gourd | *Micrococcus luteus* |
| SBP00109 | Squash gourd | *Micrococcus luteus* |
| SBP00109 | Squash gourd | *Micrococcus luteus* |
| SBP00109 | Squash gourd | *Micrococcus luteus* |
| SBP00109 | Squash gourd | *Micrococcus luteus* |
| SBP00109 | Squash gourd | *Micrococcus luteus* |
| SBP00109 | Squash gourd | *Microlunatus soli* |
| SBP00109 | Squash gourd | *Microlunatus soli* |
| SBP00109 | Squash gourd | *Microlunatus soli* |
| SBP00109 | Squash gourd | *Microlunatus soli* |
| SBP00109 | Squash gourd | *Microlunatus soli* |
| SBP00109 | Squash gourd | *Microlunatus soli* |
| SBP00109 | Squash gourd | *Micromonospora* sp. WMMA2032 |
| SBP00109 | Squash gourd | *Micromonospora* sp. WMMA2032 |
| SBP00109 | Squash gourd | *Micromonospora* sp. WMMA2032 |
| SBP00109 | Squash gourd | *Micromonospora* sp. WMMA2032 |
| SBP00109 | Squash gourd | *Micromonospora* sp. WMMA2032 |
| SBP00109 | Squash gourd | *Micromonospora* sp. WMMA2032 |
| SBP00109 | Squash gourd | *Microterricola viridarii* |
| SBP00109 | Squash gourd | *Microterricola viridarii* |
| SBP00109 | Squash gourd | *Microterricola viridarii* |

TABLE 3-continued

List of species identified in each metagenomic sample of each SBP Sample

| SBP ID | SBP Host Common Name | Genus sp. |
|---|---|---|
| SBP00109 | Squash gourd | *Microterricola viridarii* |
| SBP00109 | Squash gourd | *Microterricola viridarii* |
| SBP00109 | Squash gourd | *Microterricola viridarii* |
| SBP00109 | Squash gourd | *Microvirga ossetica* |
| SBP00109 | Squash gourd | *Microvirga ossetica* |
| SBP00109 | Squash gourd | *Microvirga ossetica* |
| SBP00109 | Squash gourd | *Microvirga ossetica* |
| SBP00109 | Squash gourd | *Microvirga ossetica* |
| SBP00109 | Squash gourd | *Microvirga ossetica* |
| SBP00109 | Squash gourd | *Miniimonas* sp. S16 |
| SBP00109 | Squash gourd | *Miniimonas* sp. S16 |
| SBP00109 | Squash gourd | *Miniimonas* sp. S16 |
| SBP00109 | Squash gourd | *Miniimonas* sp. S16 |
| SBP00109 | Squash gourd | *Miniimonas* sp. S16 |
| SBP00109 | Squash gourd | *Miniimonas* sp. S16 |
| SBP00109 | Squash gourd | *Mitsuaria* sp. 7 |
| SBP00109 | Squash gourd | *Mitsuaria* sp. 7 |
| SBP00109 | Squash gourd | *Mitsuaria* sp. 7 |
| SBP00109 | Squash gourd | *Mitsuaria* sp. 7 |
| SBP00109 | Squash gourd | *Mitsuaria* sp. 7 |
| SBP00109 | Squash gourd | *Mitsuaria* sp. 7 |
| SBP00109 | Squash gourd | *Moraxella osloensis* |
| SBP00109 | Squash gourd | *Moraxella osloensis* |
| SBP00109 | Squash gourd | *Moraxella osloensis* |
| SBP00109 | Squash gourd | *Moraxella osloensis* |
| SBP00109 | Squash gourd | *Moraxella osloensis* |
| SBP00109 | Squash gourd | *Moraxella osloensis* |
| SBP00109 | Squash gourd | *Mycobacterium avium* |
| SBP00109 | Squash gourd | *Mycobacterium avium* |
| SBP00109 | Squash gourd | *Mycobacterium avium* |
| SBP00109 | Squash gourd | *Mycobacterium avium* |
| SBP00109 | Squash gourd | *Mycobacterium avium* |
| SBP00109 | Squash gourd | *Mycobacterium avium* |
| SBP00109 | Squash gourd | *Mycobacterium* sp. djl-10 |
| SBP00109 | Squash gourd | *Mycobacterium* sp. djl-10 |
| SBP00109 | Squash gourd | *Mycobacterium* sp. djl-10 |
| SBP00109 | Squash gourd | *Mycobacterium* sp. djl-10 |
| SBP00109 | Squash gourd | *Mycobacterium* sp. djl-10 |
| SBP00109 | Squash gourd | *Mycobacterium* sp. djl-10 |
| SBP00109 | Squash gourd | *Nakamurella multipartita* |
| SBP00109 | Squash gourd | *Nakamurella multipartita* |
| SBP00109 | Squash gourd | *Nakamurella multipartita* |
| SBP00109 | Squash gourd | *Nakamurella multipartita* |
| SBP00109 | Squash gourd | *Nakamurella multipartita* |
| SBP00109 | Squash gourd | *Nakamurella multipartita* |
| SBP00109 | Squash gourd | *Neorhizobium galegae* |
| SBP00109 | Squash gourd | *Neorhizobium galegae* |
| SBP00109 | Squash gourd | *Neorhizobium galegae* |
| SBP00109 | Squash gourd | *Neorhizobium galegae* |
| SBP00109 | Squash gourd | *Neorhizobium galegae* |
| SBP00109 | Squash gourd | *Neorhizobium galegae* |
| SBP00109 | Squash gourd | *Nitrobacter hamburgensis* |
| SBP00109 | Squash gourd | *Nitrobacter hamburgensis* |
| SBP00109 | Squash gourd | *Nitrobacter hamburgensis* |
| SBP00109 | Squash gourd | *Nitrobacter hamburgensis* |
| SBP00109 | Squash gourd | *Nitrobacter hamburgensis* |
| SBP00109 | Squash gourd | *Nitrobacter hamburgensis* |
| SBP00109 | Squash gourd | *Nitrobacter winogradskyi* |
| SBP00109 | Squash gourd | *Nitrobacter winogradskyi* |
| SBP00109 | Squash gourd | *Nitrobacter winogradskyi* |
| SBP00109 | Squash gourd | *Nitrobacter winogradskyi* |
| SBP00109 | Squash gourd | *Nitrobacter winogradskyi* |
| SBP00109 | Squash gourd | *Nitrobacter winogradskyi* |
| SBP00109 | Squash gourd | *Nocardia nova* |
| SBP00109 | Squash gourd | *Nocardia nova* |
| SBP00109 | Squash gourd | *Nocardia nova* |
| SBP00109 | Squash gourd | *Nocardia nova* |
| SBP00109 | Squash gourd | *Nocardia nova* |
| SBP00109 | Squash gourd | *Nocardia nova* |
| SBP00109 | Squash gourd | *Nocardioides daphniae* |
| SBP00109 | Squash gourd | *Nocardioides daphniae* |
| SBP00109 | Squash gourd | *Nocardioides daphniae* |
| SBP00109 | Squash gourd | *Nocardioides daphniae* |
| SBP00109 | Squash gourd | *Nocardioides daphniae* |
| SBP00109 | Squash gourd | *Nocardioides daphniae* |
| SBP00109 | Squash gourd | *Nocardioides dokdonensis* |

TABLE 3-continued

List of species identified in each metagenomic sample of each SBP Sample

| SBP ID | SBP Host Common Name | Genus sp. |
|---|---|---|
| SBP00109 | Squash gourd | *Nocardioides dokdonensis* |
| SBP00109 | Squash gourd | *Nocardioides dokdonensis* |
| SBP00109 | Squash gourd | *Nocardioides dokdonensis* |
| SBP00109 | Squash gourd | *Nocardioides dokdonensis* |
| SBP00109 | Squash gourd | *Nocardioides dokdonensis* |
| SBP00109 | Squash gourd | *Nocardioides humi* |
| SBP00109 | Squash gourd | *Nocardioides humi* |
| SBP00109 | Squash gourd | *Nocardioides humi* |
| SBP00109 | Squash gourd | *Nocardioides humi* |
| SBP00109 | Squash gourd | *Nocardioides humi* |
| SBP00109 | Squash gourd | *Nocardioides humi* |
| SBP00109 | Squash gourd | *Nocardioides* sp. 603 |
| SBP00109 | Squash gourd | *Nocardioides* sp. 603 |
| SBP00109 | Squash gourd | *Nocardioides* sp. 603 |
| SBP00109 | Squash gourd | *Nocardioides* sp. 603 |
| SBP00109 | Squash gourd | *Nocardioides* sp. 603 |
| SBP00109 | Squash gourd | *Nocardioides* sp. 603 |
| SBP00109 | Squash gourd | *Nocardioides* sp. 78 |
| SBP00109 | Squash gourd | *Nocardioides* sp. 78 |
| SBP00109 | Squash gourd | *Nocardioides* sp. 78 |
| SBP00109 | Squash gourd | *Nocardioides* sp. 78 |
| SBP00109 | Squash gourd | *Nocardioides* sp. 78 |
| SBP00109 | Squash gourd | *Nocardioides* sp. 78 |
| SBP00109 | Squash gourd | *Nocardioides* sp. CF8 |
| SBP00109 | Squash gourd | *Nocardioides* sp. CF8 |
| SBP00109 | Squash gourd | *Nocardioides* sp. CF8 |
| SBP00109 | Squash gourd | *Nocardioides* sp. CF8 |
| SBP00109 | Squash gourd | *Nocardioides* sp. CF8 |
| SBP00109 | Squash gourd | *Nocardioides* sp. CF8 |
| SBP00109 | Squash gourd | *Nocardioides* sp. JS614 |
| SBP00109 | Squash gourd | *Nocardioides* sp. JS614 |
| SBP00109 | Squash gourd | *Nocardioides* sp. JS614 |
| SBP00109 | Squash gourd | *Nocardioides* sp. JS614 |
| SBP00109 | Squash gourd | *Nocardioides* sp. JS614 |
| SBP00109 | Squash gourd | *Nocardioides* sp. JS614 |
| SBP00109 | Squash gourd | *Nocardiopsis dassonvillei* |
| SBP00109 | Squash gourd | *Nocardiopsis dassonvillei* |
| SBP00109 | Squash gourd | *Nocardiopsis dassonvillei* |
| SBP00109 | Squash gourd | *Nocardiopsis dassonvillei* |
| SBP00109 | Squash gourd | *Nocardiopsis dassonvillei* |
| SBP00109 | Squash gourd | *Nocardiopsis dassonvillei* |
| SBP00109 | Squash gourd | *Novibacillus thermophilus* |
| SBP00109 | Squash gourd | *Novibacillus thermophilus* |
| SBP00109 | Squash gourd | *Novibacillus thermophilus* |
| SBP00109 | Squash gourd | *Novibacillus thermophilus* |
| SBP00109 | Squash gourd | *Novibacillus thermophilus* |
| SBP00109 | Squash gourd | *Novibacillus thermophilus* |
| SBP00109 | Squash gourd | *Ochrobactrum anthropi* |
| SBP00109 | Squash gourd | *Ochrobactrum anthropi* |
| SBP00109 | Squash gourd | *Ochrobactrum anthropi* |
| SBP00109 | Squash gourd | *Ochrobactrum anthropi* |
| SBP00109 | Squash gourd | *Ochrobactrum anthropi* |
| SBP00109 | Squash gourd | *Ochrobactrum anthropi* |
| SBP00109 | Squash gourd | *Oligotropha carboxidovorans* |
| SBP00109 | Squash gourd | *Oligotropha carboxidovorans* |
| SBP00109 | Squash gourd | *Oligotropha carboxidovorans* |
| SBP00109 | Squash gourd | *Oligotropha carboxidovorans* |
| SBP00109 | Squash gourd | *Oligotropha carboxidovorans* |
| SBP00109 | Squash gourd | *Oligotropha carboxidovorans* |
| SBP00109 | Squash gourd | *Ornithinimicrobium flavum* |
| SBP00109 | Squash gourd | *Ornithinimicrobium flavum* |
| SBP00109 | Squash gourd | *Ornithinimicrobium flavum* |
| SBP00109 | Squash gourd | *Ornithinimicrobium flavum* |
| SBP00109 | Squash gourd | *Ornithinimicrobium flavum* |
| SBP00109 | Squash gourd | *Ornithinimicrobium flavum* |
| SBP00109 | Squash gourd | *Ottowia oryzae* |
| SBP00109 | Squash gourd | *Ottowia oryzae* |
| SBP00109 | Squash gourd | *Ottowia oryzae* |
| SBP00109 | Squash gourd | *Ottowia oryzae* |
| SBP00109 | Squash gourd | *Ottowia oryzae* |
| SBP00109 | Squash gourd | *Ottowia oryzae* |
| SBP00109 | Squash gourd | *Pandoraea faecigallinarum* |
| SBP00109 | Squash gourd | *Pandoraea faecigallinarum* |
| SBP00109 | Squash gourd | *Pandoraea faecigallinarum* |
| SBP00109 | Squash gourd | *Pandoraea faecigallinarum* |
| SBP00109 | Squash gourd | *Pandoraea faecigallinarum* |

TABLE 3-continued

List of species identified in each metagenomic sample of each SBP Sample

| SBP ID | SBP Host Common Name | Genus sp. |
|---|---|---|
| SBP00109 | Squash gourd | *Pandoraea faecigallinarum* |
| SBP00109 | Squash gourd | *Pandoraea pnomenusa* |
| SBP00109 | Squash gourd | *Pandoraea pnomenusa* |
| SBP00109 | Squash gourd | *Pandoraea pnomenusa* |
| SBP00109 | Squash gourd | *Pandoraea pnomenusa* |
| SBP00109 | Squash gourd | *Pandoraea pnomenusa* |
| SBP00109 | Squash gourd | *Pandoraea sputorum* |
| SBP00109 | Squash gourd | *Pandoraea sputorum* |
| SBP00109 | Squash gourd | *Pandoraea sputorum* |
| SBP00109 | Squash gourd | *Pandoraea sputorum* |
| SBP00109 | Squash gourd | *Pandoraea sputorum* |
| SBP00109 | Squash gourd | *Pannonibacter phragmitetus* |
| SBP00109 | Squash gourd | *Pannonibacter phragmitetus* |
| SBP00109 | Squash gourd | *Pannonibacter phragmitetus* |
| SBP00109 | Squash gourd | *Pannonibacter phragmitetus* |
| SBP00109 | Squash gourd | *Pannonibacter phragmitetus* |
| SBP00109 | Squash gourd | *Pannonibacter phragmitetus* |
| SBP00109 | Squash gourd | *Pantoea agglomerans* |
| SBP00109 | Squash gourd | *Pantoea agglomerans* |
| SBP00109 | Squash gourd | *Pantoea agglomerans* |
| SBP00109 | Squash gourd | *Pantoea agglomerans* |
| SBP00109 | Squash gourd | *Pantoea agglomerans* |
| SBP00109 | Squash gourd | *Pantoea agglomerans* |
| SBP00109 | Squash gourd | *Pantoea vagans* |
| SBP00109 | Squash gourd | *Pantoea vagans* |
| SBP00109 | Squash gourd | *Pantoea vagans* |
| SBP00109 | Squash gourd | *Pantoea vagans* |
| SBP00109 | Squash gourd | *Pantoea vagans* |
| SBP00109 | Squash gourd | *Pantoea vagans* |
| SBP00109 | Squash gourd | *Paraburkholderia aromaticivorans* |
| SBP00109 | Squash gourd | *Paraburkholderia aromaticivorans* |
| SBP00109 | Squash gourd | *Paraburkholderia aromaticivorans* |
| SBP00109 | Squash gourd | *Paraburkholderia aromaticivorans* |
| SBP00109 | Squash gourd | *Paraburkholderia aromaticivorans* |
| SBP00109 | Squash gourd | *Paraburkholderia aromaticivorans* |
| SBP00109 | Squash gourd | *Paraburkholderia caribensis* |
| SBP00109 | Squash gourd | *Paraburkholderia caribensis* |
| SBP00109 | Squash gourd | *Paraburkholderia caribensis* |
| SBP00109 | Squash gourd | *Paraburkholderia caribensis* |
| SBP00109 | Squash gourd | *Paraburkholderia caribensis* |
| SBP00109 | Squash gourd | *Paraburkholderia caribensis* |
| SBP00109 | Squash gourd | *Paraburkholderia fungorum* |
| SBP00109 | Squash gourd | *Paraburkholderia fungorum* |
| SBP00109 | Squash gourd | *Paraburkholderia fungorum* |
| SBP00109 | Squash gourd | *Paraburkholderia fungorum* |
| SBP00109 | Squash gourd | *Paraburkholderia fungorum* |
| SBP00109 | Squash gourd | *Paraburkholderia fungorum* |
| SBP00109 | Squash gourd | *Paraburkholderia phymatum* |
| SBP00109 | Squash gourd | *Paraburkholderia phymatum* |
| SBP00109 | Squash gourd | *Paraburkholderia phymatum* |
| SBP00109 | Squash gourd | *Paraburkholderia phymatum* |
| SBP00109 | Squash gourd | *Paraburkholderia phymatum* |
| SBP00109 | Squash gourd | *Paraburkholderia phymatum* |
| SBP00109 | Squash gourd | *Paraburkholderia phytofirmans* |
| SBP00109 | Squash gourd | *Paraburkholderia phytofirmans* |
| SBP00109 | Squash gourd | *Paraburkholderia phytofirmans* |
| SBP00109 | Squash gourd | *Paraburkholderia phytofirmans* |
| SBP00109 | Squash gourd | *Paraburkholderia phytofirmans* |
| SBP00109 | Squash gourd | *Paraburkholderia phytofirmans* |
| SBP00109 | Squash gourd | *Paraburkholderia terrae* |
| SBP00109 | Squash gourd | *Paraburkholderia terrae* |
| SBP00109 | Squash gourd | *Paraburkholderia terrae* |
| SBP00109 | Squash gourd | *Paraburkholderia terrae* |
| SBP00109 | Squash gourd | *Paraburkholderia terrae* |
| SBP00109 | Squash gourd | *Paraburkholderia terrae* |
| SBP00109 | Squash gourd | *Paraburkholderia terricola* |
| SBP00109 | Squash gourd | *Paraburkholderia terricola* |
| SBP00109 | Squash gourd | *Paraburkholderia terricola* |
| SBP00109 | Squash gourd | *Paraburkholderia terricola* |
| SBP00109 | Squash gourd | *Paraburkholderia terricola* |
| SBP00109 | Squash gourd | *Paraburkholderia terricola* |
| SBP00109 | Squash gourd | *Paraoerskovia marina* |
| SBP00109 | Squash gourd | *Paraoerskovia marina* |
| SBP00109 | Squash gourd | *Paraoerskovia marina* |

TABLE 3-continued

List of species identified in each metagenomic sample of each SBP Sample

| SBP ID | SBP Host Common Name | Genus sp. |
|---|---|---|
| SBP00109 | Squash gourd | *Paraoerskovia marina* |
| SBP00109 | Squash gourd | *Paraoerskovia marina* |
| SBP00109 | Squash gourd | *Paraoerskovia marina* |
| SBP00109 | Squash gourd | *Pasteurella multocida* |
| SBP00109 | Squash gourd | *Pasteurella multocida* |
| SBP00109 | Squash gourd | *Pasteurella multocida* |
| SBP00109 | Squash gourd | *Pasteurella multocida* |
| SBP00109 | Squash gourd | *Pasteurella multocida* |
| SBP00109 | Squash gourd | *Pasteurella multocida* |
| SBP00109 | Squash gourd | *Paucibacter* sp. KCTC 42545 |
| SBP00109 | Squash gourd | *Paucibacter* sp. KCTC 42545 |
| SBP00109 | Squash gourd | *Paucibacter* sp. KCTC 42545 |
| SBP00109 | Squash gourd | *Paucibacter* sp. KCTC 42545 |
| SBP00109 | Squash gourd | *Paucibacter* sp. KCTC 42545 |
| SBP00109 | Squash gourd | *Paucibacter* sp. KCTC 42545 |
| SBP00109 | Squash gourd | *Pediococcus acidilactici* |
| SBP00109 | Squash gourd | *Pediococcus acidilactici* |
| SBP00109 | Squash gourd | *Pediococcus acidilactici* |
| SBP00109 | Squash gourd | *Pediococcus acidilactici* |
| SBP00109 | Squash gourd | *Pediococcus acidilactici* |
| SBP00109 | Squash gourd | *Pediococcus acidilactici* |
| SBP00109 | Squash gourd | *Pediococcus pentosaceus* |
| SBP00109 | Squash gourd | *Pediococcus pentosaceus* |
| SBP00109 | Squash gourd | *Pediococcus pentosaceus* |
| SBP00109 | Squash gourd | *Pediococcus pentosaceus* |
| SBP00109 | Squash gourd | *Pediococcus pentosaceus* |
| SBP00109 | Squash gourd | *Pediococcus pentosaceus* |
| SBP00109 | Squash gourd | *Phenylobacterium* sp. HYN0004 |
| SBP00109 | Squash gourd | *Phenylobacterium* sp. HYN0004 |
| SBP00109 | Squash gourd | *Phenylobacterium* sp. HYN0004 |
| SBP00109 | Squash gourd | *Phenylobacterium* sp. HYN0004 |
| SBP00109 | Squash gourd | *Phenylobacterium* sp. HYN0004 |
| SBP00109 | Squash gourd | *Phenylobacterium* sp. HYN0004 |
| SBP00109 | Squash gourd | *Phreatobacter cathodiphilus* |
| SBP00109 | Squash gourd | *Phreatobacter cathodiphilus* |
| SBP00109 | Squash gourd | *Phreatobacter cathodiphilus* |
| SBP00109 | Squash gourd | *Phreatobacter cathodiphilus* |
| SBP00109 | Squash gourd | *Phreatobacter cathodiphilus* |
| SBP00109 | Squash gourd | *Phreatobacter cathodiphilus* |
| SBP00109 | Squash gourd | *Phreatobacter stygius* |
| SBP00109 | Squash gourd | *Phreatobacter stygius* |
| SBP00109 | Squash gourd | *Phreatobacter stygius* |
| SBP00109 | Squash gourd | *Phreatobacter stygius* |
| SBP00109 | Squash gourd | *Phreatobacter stygius* |
| SBP00109 | Squash gourd | *Phreatobacter stygius* |
| SBP00109 | Squash gourd | *Phycisphaera mikurensis* |
| SBP00109 | Squash gourd | *Phycisphaera mikurensis* |
| SBP00109 | Squash gourd | *Phycisphaera mikurensis* |
| SBP00109 | Squash gourd | *Phycisphaera mikurensis* |
| SBP00109 | Squash gourd | *Phycisphaera mikurensis* |
| SBP00109 | Squash gourd | *Phycisphaera mikurensis* |
| SBP00109 | Squash gourd | *Pigmentiphaga* sp. H8 |
| SBP00109 | Squash gourd | *Pigmentiphaga* sp. H8 |
| SBP00109 | Squash gourd | *Pigmentiphaga* sp. H8 |
| SBP00109 | Squash gourd | *Pigmentiphaga* sp. H8 |
| SBP00109 | Squash gourd | *Pigmentiphaga* sp. H8 |
| SBP00109 | Squash gourd | *Pigmentiphaga* sp. H8 |
| SBP00109 | Squash gourd | *Pimelobacter simplex* |
| SBP00109 | Squash gourd | *Pimelobacter simplex* |
| SBP00109 | Squash gourd | *Pimelobacter simplex* |
| SBP00109 | Squash gourd | *Pimelobacter simplex* |
| SBP00109 | Squash gourd | *Pimelobacter simplex* |
| SBP00109 | Squash gourd | *Pimelobacter simplex* |
| SBP00109 | Squash gourd | *Plautia stali* |
| SBP00109 | Squash gourd | *Plautia stali* |
| SBP00109 | Squash gourd | *Plautia stali* |
| SBP00109 | Squash gourd | *Plautia stali* |
| SBP00109 | Squash gourd | *Plautia stali* |
| SBP00109 | Squash gourd | *Plautia stali* |
| SBP00109 | Squash gourd | *Pleomorphomonas* sp. SM30 |
| SBP00109 | Squash gourd | *Pleomorphomonas* sp. SM30 |
| SBP00109 | Squash gourd | *Pleomorphomonas* sp. SM30 |
| SBP00109 | Squash gourd | *Pleomorphomonas* sp. SM30 |
| SBP00109 | Squash gourd | *Pleomorphomonas* sp. SM30 |
| SBP00109 | Squash gourd | *Pleomorphomonas* sp. SM30 |
| SBP00109 | Squash gourd | *Polaromonas* sp. JS666 |

TABLE 3-continued

List of species identified in each metagenomic sample of each SBP Sample

| SBP ID | SBP Host Common Name | Genus sp. |
|---|---|---|
| SBP00109 | Squash gourd | *Polaromonas* sp. JS666 |
| SBP00109 | Squash gourd | *Polaromonas* sp. JS666 |
| SBP00109 | Squash gourd | *Polaromonas* sp. JS666 |
| SBP00109 | Squash gourd | *Polaromonas* sp. JS666 |
| SBP00109 | Squash gourd | *Polaromonas* sp. JS666 |
| SBP00109 | Squash gourd | *Propionibacterium freudenreichii* |
| SBP00109 | Squash gourd | *Propionibacterium freudenreichii* |
| SBP00109 | Squash gourd | *Propionibacterium freudenreichii* |
| SBP00109 | Squash gourd | *Propionibacterium freudenreichii* |
| SBP00109 | Squash gourd | *Propionibacterium freudenreichii* |
| SBP00109 | Squash gourd | *Propionibacterium* sp. oral taxon 193 |
| SBP00109 | Squash gourd | *Propionibacterium* sp. oral taxon 193 |
| SBP00109 | Squash gourd | *Propionibacterium* sp. oral taxon 193 |
| SBP00109 | Squash gourd | *Propionibacterium* sp. oral taxon 193 |
| SBP00109 | Squash gourd | *Propionibacterium* sp. oral taxon 193 |
| SBP00109 | Squash gourd | *Propionibacterium* sp. oral taxon 193 |
| SBP00109 | Squash gourd | *Pseudogulbenkiania* sp. NH88 |
| SBP00109 | Squash gourd | *Pseudogulbenkiania* sp. NH88 |
| SBP00109 | Squash gourd | *Pseudogulbenkiania* sp. NH88 |
| SBP00109 | Squash gourd | *Pseudogulbenkiania* sp. NH88 |
| SBP00109 | Squash gourd | *Pseudogulbenkiania* sp. NH88 |
| SBP00109 | Squash gourd | *Pseudolabrys taiwanensis* |
| SBP00109 | Squash gourd | *Pseudolabrys taiwanensis* |
| SBP00109 | Squash gourd | *Pseudolabrys taiwanensis* |
| SBP00109 | Squash gourd | *Pseudolabrys taiwanensis* |
| SBP00109 | Squash gourd | *Pseudolabrys taiwanensis* |
| SBP00109 | Squash gourd | *Pseudolabrys taiwanensis* |
| SBP00109 | Squash gourd | *Pseudomonas aeruginosa* |
| SBP00109 | Squash gourd | *Pseudomonas aeruginosa* |
| SBP00109 | Squash gourd | *Pseudomonas aeruginosa* |
| SBP00109 | Squash gourd | *Pseudomonas aeruginosa* |
| SBP00109 | Squash gourd | *Pseudomonas aeruginosa* |
| SBP00109 | Squash gourd | *Pseudomonas azotoformans* |
| SBP00109 | Squash gourd | *Pseudomonas azotoformans* |
| SBP00109 | Squash gourd | *Pseudomonas azotoformans* |
| SBP00109 | Squash gourd | *Pseudomonas azotoformans* |
| SBP00109 | Squash gourd | *Pseudomonas azotoformans* |
| SBP00109 | Squash gourd | *Pseudomonas azotoformans* |
| SBP00109 | Squash gourd | *Pseudomonas balearica* |
| SBP00109 | Squash gourd | *Pseudomonas balearica* |
| SBP00109 | Squash gourd | *Pseudomonas balearica* |
| SBP00109 | Squash gourd | *Pseudomonas balearica* |
| SBP00109 | Squash gourd | *Pseudomonas balearica* |
| SBP00109 | Squash gourd | *Pseudomonas brenneri* |
| SBP00109 | Squash gourd | *Pseudomonas brenneri* |
| SBP00109 | Squash gourd | *Pseudomonas brenneri* |
| SBP00109 | Squash gourd | *Pseudomonas brenneri* |
| SBP00109 | Squash gourd | *Pseudomonas brenneri* |
| SBP00109 | Squash gourd | *Pseudomonas chlororaphis* |
| SBP00109 | Squash gourd | *Pseudomonas chlororaphis* |
| SBP00109 | Squash gourd | *Pseudomonas chlororaphis* |
| SBP00109 | Squash gourd | *Pseudomonas chlororaphis* |
| SBP00109 | Squash gourd | *Pseudomonas chlororaphis* |
| SBP00109 | Squash gourd | *Pseudomonas chlororaphis* |
| SBP00109 | Squash gourd | *Pseudomonas citronellolis* |
| SBP00109 | Squash gourd | *Pseudomonas citronellolis* |
| SBP00109 | Squash gourd | *Pseudomonas citronellolis* |
| SBP00109 | Squash gourd | *Pseudomonas citronellolis* |
| SBP00109 | Squash gourd | *Pseudomonas citronellolis* |
| SBP00109 | Squash gourd | *Pseudomonas citronellolis* |
| SBP00109 | Squash gourd | *Pseudomonas fluorescens* |
| SBP00109 | Squash gourd | *Pseudomonas fluorescens* |
| SBP00109 | Squash gourd | *Pseudomonas fluorescens* |
| SBP00109 | Squash gourd | *Pseudomonas fluorescens* |
| SBP00109 | Squash gourd | *Pseudomonas fluorescens* |
| SBP00109 | Squash gourd | *Pseudomonas fluorescens* |
| SBP00109 | Squash gourd | *Pseudomonas frederiksbergensis* |
| SBP00109 | Squash gourd | *Pseudomonas frederiksbergensis* |
| SBP00109 | Squash gourd | *Pseudomonas frederiksbergensis* |
| SBP00109 | Squash gourd | *Pseudomonas frederiksbergensis* |
| SBP00109 | Squash gourd | *Pseudomonas frederiksbergensis* |

TABLE 3-continued

List of species identified in each metagenomic sample of each SBP Sample

| SBP ID | SBP Host Common Name | Genus sp. |
|---|---|---|
| SBP00109 | Squash gourd | *Pseudomonas frederiksbergensis* |
| SBP00109 | Squash gourd | *Pseudomonas koreensis* |
| SBP00109 | Squash gourd | *Pseudomonas koreensis* |
| SBP00109 | Squash gourd | *Pseudomonas koreensis* |
| SBP00109 | Squash gourd | *Pseudomonas koreensis* |
| SBP00109 | Squash gourd | *Pseudomonas koreensis* |
| SBP00109 | Squash gourd | *Pseudomonas poae* |
| SBP00109 | Squash gourd | *Pseudomonas poae* |
| SBP00109 | Squash gourd | *Pseudomonas poae* |
| SBP00109 | Squash gourd | *Pseudomonas poae* |
| SBP00109 | Squash gourd | *Pseudomonas poae* |
| SBP00109 | Squash gourd | *Pseudomonas poae* |
| SBP00109 | Squash gourd | *Pseudomonas putida* |
| SBP00109 | Squash gourd | *Pseudomonas putida* |
| SBP00109 | Squash gourd | *Pseudomonas putida* |
| SBP00109 | Squash gourd | *Pseudomonas putida* |
| SBP00109 | Squash gourd | *Pseudomonas putida* |
| SBP00109 | Squash gourd | *Pseudomonas putida* |
| SBP00109 | Squash gourd | *Pseudomonas sp.* |
| SBP00109 | Squash gourd | *Pseudomonas sp.* |
| SBP00109 | Squash gourd | *Pseudomonas sp.* |
| SBP00109 | Squash gourd | *Pseudomonas sp.* |
| SBP00109 | Squash gourd | *Pseudomonas sp.* |
| SBP00109 | Squash gourd | *Pseudomonas sp.* |
| SBP00109 | Squash gourd | *Pseudomonas stutzeri* |
| SBP00109 | Squash gourd | *Pseudomonas stutzeri* |
| SBP00109 | Squash gourd | *Pseudomonas stutzeri* |
| SBP00109 | Squash gourd | *Pseudomonas stutzeri* |
| SBP00109 | Squash gourd | *Pseudomonas stutzeri* |
| SBP00109 | Squash gourd | *Pseudomonas stutzeri* |
| SBP00109 | Squash gourd | *Pseudomonas synxantha* |
| SBP00109 | Squash gourd | *Pseudomonas synxantha* |
| SBP00109 | Squash gourd | *Pseudomonas synxantha* |
| SBP00109 | Squash gourd | *Pseudomonas synxantha* |
| SBP00109 | Squash gourd | *Pseudomonas synxantha* |
| SBP00109 | Squash gourd | *Pseudomonas synxantha* |
| SBP00109 | Squash gourd | *Pseudomonas vancouverensis* |
| SBP00109 | Squash gourd | *Pseudomonas vancouverensis* |
| SBP00109 | Squash gourd | *Pseudomonas vancouverensis* |
| SBP00109 | Squash gourd | *Pseudomonas vancouverensis* |
| SBP00109 | Squash gourd | *Pseudomonas vancouverensis* |
| SBP00109 | Squash gourd | *Pseudomonas vancouverensis* |
| SBP00109 | Squash gourd | *Pseudonocardia dioxanivorans* |
| SBP00109 | Squash gourd | *Pseudonocardia dioxanivorans* |
| SBP00109 | Squash gourd | *Pseudonocardia dioxanivorans* |
| SBP00109 | Squash gourd | *Pseudonocardia dioxanivorans* |
| SBP00109 | Squash gourd | *Pseudonocardia dioxanivorans* |
| SBP00109 | Squash gourd | *Pseudonocardia dioxanivorans* |
| SBP00109 | Squash gourd | *Pseudorhodoplanes sinuspersici* |
| SBP00109 | Squash gourd | *Pseudorhodoplanes sinuspersici* |
| SBP00109 | Squash gourd | *Pseudorhodoplanes sinuspersici* |
| SBP00109 | Squash gourd | *Pseudorhodoplanes sinuspersici* |
| SBP00109 | Squash gourd | *Pseudorhodoplanes sinuspersici* |
| SBP00109 | Squash gourd | *Pseudorhodoplanes sinuspersici* |
| SBP00109 | Squash gourd | *Ralstonia insidiosa* |
| SBP00109 | Squash gourd | *Ralstonia insidiosa* |
| SBP00109 | Squash gourd | *Ralstonia insidiosa* |
| SBP00109 | Squash gourd | *Ralstonia insidiosa* |
| SBP00109 | Squash gourd | *Ralstonia insidiosa* |
| SBP00109 | Squash gourd | *Ralstonia insidiosa* |
| SBP00109 | Squash gourd | *Ralstonia mannitolilytica* |
| SBP00109 | Squash gourd | *Ralstonia mannitolilytica* |
| SBP00109 | Squash gourd | *Ralstonia mannitolilytica* |
| SBP00109 | Squash gourd | *Ralstonia mannitolilytica* |
| SBP00109 | Squash gourd | *Ralstonia mannitolilytica* |
| SBP00109 | Squash gourd | *Raistonia mannitolilytica* |
| SBP00109 | Squash gourd | *Ralstonia pickettii* |
| SBP00109 | Squash gourd | *Ralstonia pickettii* |
| SBP00109 | Squash gourd | *Ralstonia pickettii* |
| SBP00109 | Squash gourd | *Ralstonia pickettii* |
| SBP00109 | Squash gourd | *Ralstonia pickettii* |
| SBP00109 | Squash gourd | *Ralstonia pickettii* |
| SBP00109 | Squash gourd | *Ralstonia solanacearum* |
| SBP00109 | Squash gourd | *Ralstonia solanacearum* |
| SBP00109 | Squash gourd | *Ralstonia solanacearum* |

TABLE 3-continued

List of species identified in each metagenomic sample of each SBP Sample

| SBP ID | SBP Host Common Name | Genus sp. |
|---|---|---|
| SBP00109 | Squash gourd | *Ralstonia solanacearum* |
| SBP00109 | Squash gourd | *Ralstonia solanacearum* |
| SBP00109 | Squash gourd | *Ralstonia solanacearum* |
| SBP00109 | Squash gourd | *Ramlibacter tataouinensis* |
| SBP00109 | Squash gourd | *Ramlibacter tataouinensis* |
| SBP00109 | Squash gourd | *Ramlibacter tataouinensis* |
| SBP00109 | Squash gourd | *Ramlibacter tataouinensis* |
| SBP00109 | Squash gourd | *Ramlibacter tataouinensis* |
| SBP00109 | Squash gourd | *Ramlibacter tataouinensis* |
| SBP00109 | Squash gourd | *Raoultella ornithinolytica* |
| SBP00109 | Squash gourd | *Raoultella ornithinolytica* |
| SBP00109 | Squash gourd | *Raoultella ornithinolytica* |
| SBP00109 | Squash gourd | *Raoultella ornithinolytica* |
| SBP00109 | Squash gourd | *Raoultella ornithinolytica* |
| SBP00109 | Squash gourd | *Raoultella ornithinolytica* |
| SBP00109 | Squash gourd | *Rathayibacter rathayi* |
| SBP00109 | Squash gourd | *Rathayibacter rathayi* |
| SBP00109 | Squash gourd | *Rathayibacter rathayi* |
| SBP00109 | Squash gourd | *Rathayibacter rathayi* |
| SBP00109 | Squash gourd | *Rathayibacter rathayi* |
| SBP00109 | Squash gourd | *Rathayibacter rathayi* |
| SBP00109 | Squash gourd | *Rhizobacter gummiphilus* |
| SBP00109 | Squash gourd | *Rhizobacter gummiphilus* |
| SBP00109 | Squash gourd | *Rhizobacter gummiphilus* |
| SBP00109 | Squash gourd | *Rhizobacter gummiphilus* |
| SBP00109 | Squash gourd | *Rhizobacter gummiphilus* |
| SBP00109 | Squash gourd | *Rhizobacter gummiphilus* |
| SBP00109 | Squash gourd | *Rhizobium leguminosarum* |
| SBP00109 | Squash gourd | *Rhizobium leguminosarum* |
| SBP00109 | Squash gourd | *Rhizobium leguminosarum* |
| SBP00109 | Squash gourd | *Rhizobium leguminosarum* |
| SBP00109 | Squash gourd | *Rhizobium leguminosarum* |
| SBP00109 | Squash gourd | *Rhizobium leguminosarum* |
| SBP00109 | Squash gourd | *Rhizobium* sp. NT-26 |
| SBP00109 | Squash gourd | *Rhizobium* sp. NT-26 |
| SBP00109 | Squash gourd | *Rhizobium* sp. NT-26 |
| SBP00109 | Squash gourd | *Rhizobium* sp. NT-26 |
| SBP00109 | Squash gourd | *Rhizobium* sp. NT-26 |
| SBP00109 | Squash gourd | *Rhizobium* sp. NT-26 |
| SBP00109 | Squash gourd | *Rhodobacter capsulatus* |
| SBP00109 | Squash gourd | *Rhodobacter capsulatus* |
| SBP00109 | Squash gourd | *Rhodobacter capsulatus* |
| SBP00109 | Squash gourd | *Rhodobacter capsulatus* |
| SBP00109 | Squash gourd | *Rhodobacter capsulatus* |
| SBP00109 | Squash gourd | *Rhodobacter capsulatus* |
| SBP00109 | Squash gourd | *Rhodococcus fascians* |
| SBP00109 | Squash gourd | *Rhodococcus fascians* |
| SBP00109 | Squash gourd | *Rhodococcus fascians* |
| SBP00109 | Squash gourd | *Rhodococcus fascians* |
| SBP00109 | Squash gourd | *Rhodococcus fascians* |
| SBP00109 | Squash gourd | *Rhodococcus fascians* |
| SBP00109 | Squash gourd | *Rhodococcus* sp. X156 |
| SBP00109 | Squash gourd | *Rhodococcus* sp. X156 |
| SBP00109 | Squash gourd | *Rhodococcus* sp. X156 |
| SBP00109 | Squash gourd | *Rhodococcus* sp. X156 |
| SBP00109 | Squash gourd | *Rhodococcus* sp. X156 |
| SBP00109 | Squash gourd | *Rhodococcus* sp. X156 |
| SBP00109 | Squash gourd | *Rhodoferax ferrireducens* |
| SBP00109 | Squash gourd | *Rhodoferax ferrireducens* |
| SBP00109 | Squash gourd | *Rhodoferax ferrireducens* |
| SBP00109 | Squash gourd | *Rhodoferax ferrireducens* |
| SBP00109 | Squash gourd | *Rhodoferax ferrireducens* |
| SBP00109 | Squash gourd | *Rhodoferax ferrireducens* |
| SBP00109 | Squash gourd | *Rhodoferax koreense* |
| SBP00109 | Squash gourd | *Rhodoferax koreense* |
| SBP00109 | Squash gourd | *Rhodoferax koreense* |
| SBP00109 | Squash gourd | *Rhodoferax koreense* |
| SBP00109 | Squash gourd | *Rhodoferax koreense* |
| SBP00109 | Squash gourd | *Rhodoferax koreense* |
| SBP00109 | Squash gourd | *Rhodoferax saidenbachensis* |
| SBP00109 | Squash gourd | *Rhodoferax saidenbachensis* |
| SBP00109 | Squash gourd | *Rhodoferax saidenbachensis* |
| SBP00109 | Squash gourd | *Rhodoferax saidenbachensis* |
| SBP00109 | Squash gourd | *Rhodoferax saidenbachensis* |
| SBP00109 | Squash gourd | *Rhodoferax saidenbachensis* |
| SBP00109 | Squash gourd | *Rhodoplanes* sp. Z2-YC6860 |

TABLE 3-continued

List of species identified in each metagenomic sample of each SBP Sample

| SBP ID | SBP Host Common Name | Genus sp. |
|---|---|---|
| SBP00109 | Squash gourd | *Rhodoplanes* sp. Z2-YC6860 |
| SBP00109 | Squash gourd | *Rhodoplanes* sp. Z2-YC6860 |
| SBP00109 | Squash gourd | *Rhodoplanes* sp. Z2-YC6860 |
| SBP00109 | Squash gourd | *Rhodoplanes* sp. Z2-YC6860 |
| SBP00109 | Squash gourd | *Rhodoplanes* sp. Z2-YC6860 |
| SBP00109 | Squash gourd | *Rhodopseudomonas palustris* |
| SBP00109 | Squash gourd | *Rhodopseudomonas palustris* |
| SBP00109 | Squash gourd | *Rhodopseudomonas palustris* |
| SBP00109 | Squash gourd | *Rhodopseudomonas palustris* |
| SBP00109 | Squash gourd | *Rhodopseudomonas palustris* |
| SBP00109 | Squash gourd | *Rhodopseudomonas palustris* |
| SBP00109 | Squash gourd | *Roseateles depolymerans* |
| SBP00109 | Squash gourd | *Roseateles depolymerans* |
| SBP00109 | Squash gourd | *Roseateles depolymerans* |
| SBP00109 | Squash gourd | *Roseateles depolymerans* |
| SBP00109 | Squash gourd | *Roseateles depolymerans* |
| SBP00109 | Squash gourd | *Roseateles depolymerans* |
| SBP00109 | Squash gourd | *Rothia mucilaginosa* |
| SBP00109 | Squash gourd | *Rothia mucilaginosa* |
| SBP00109 | Squash gourd | *Rothia mucilaginosa* |
| SBP00109 | Squash gourd | *Rothia mucilaginosa* |
| SBP00109 | Squash gourd | *Rothia mucilaginosa* |
| SBP00109 | Squash gourd | *Rothia mucilaginosa* |
| SBP00109 | Squash gourd | *Rubrivivax gelatinosus* |
| SBP00109 | Squash gourd | *Rubrivivax gelatinosus* |
| SBP00109 | Squash gourd | *Rubrivivax gelatinosus* |
| SBP00109 | Squash gourd | *Rubrivivax gelatinosus* |
| SBP00109 | Squash gourd | *Rubrivivax gelatinosus* |
| SBP00109 | Squash gourd | *Rubrivivax gelatinosus* |
| SBP00109 | Squash gourd | *Saccharothrix espanaensis* |
| SBP00109 | Squash gourd | *Saccharothrix espanaensis* |
| SBP00109 | Squash gourd | *Saccharothrix espanaensis* |
| SBP00109 | Squash gourd | *Saccharothrix espanaensis* |
| SBP00109 | Squash gourd | *Saccharothrix espanaensis* |
| SBP00109 | Squash gourd | *Saccharothrix espanaensis* |
| SBP00109 | Squash gourd | *Sandaracinus amylolyticus* |
| SBP00109 | Squash gourd | *Sandaracinus amylolyticus* |
| SBP00109 | Squash gourd | *Sandaracinus amylolyticus* |
| SBP00109 | Squash gourd | *Sandaracinus amylolyticus* |
| SBP00109 | Squash gourd | *Sandaracinus amylolyticus* |
| SBP00109 | Squash gourd | *Sandaracinus amylolyticus* |
| SBP00109 | Squash gourd | *Sanguibacter keddieii* |
| SBP00109 | Squash gourd | *Sanguibacter keddieii* |
| SBP00109 | Squash gourd | *Sanguibacter keddieii* |
| SBP00109 | Squash gourd | *Sanguibacter keddieii* |
| SBP00109 | Squash gourd | *Sanguibacter keddieii* |
| SBP00109 | Squash gourd | *Sanguibacter keddieii* |
| SBP00109 | Squash gourd | *Serinicoccus* sp. JLT9 |
| SBP00109 | Squash gourd | *Serinicoccus* sp. JLT9 |
| SBP00109 | Squash gourd | *Serinicoccus* sp. JLT9 |
| SBP00109 | Squash gourd | *Serinicoccus* sp. JLT9 |
| SBP00109 | Squash gourd | *Serinicoccus* sp. JLT9 |
| SBP00109 | Squash gourd | *Serinicoccus* sp. JLT9 |
| SBP00109 | Squash gourd | *Serratia fonticola* |
| SBP00109 | Squash gourd | *Serratia fonticola* |
| SBP00109 | Squash gourd | *Serratia fonticola* |
| SBP00109 | Squash gourd | *Serratia fonticola* |
| SBP00109 | Squash gourd | *Serratia fonticola* |
| SBP00109 | Squash gourd | *Serratia fonticola* |
| SBP00109 | Squash gourd | *Serratia marcescens* |
| SBP00109 | Squash gourd | *Serratia marcescens* |
| SBP00109 | Squash gourd | *Serratia marcescens* |
| SBP00109 | Squash gourd | *Serratia marcescens* |
| SBP00109 | Squash gourd | *Serratia marcescens* |
| SBP00109 | Squash gourd | *Serratia marcescens* |
| SBP00109 | Squash gourd | *Shinella* sp. HZN7 |
| SBP00109 | Squash gourd | *Shinella* sp. HZN7 |
| SBP00109 | Squash gourd | *Shinella* sp. HZN7 |
| SBP00109 | Squash gourd | *Shinella* sp. HZN7 |
| SBP00109 | Squash gourd | *Shinella* sp. HZN7 |
| SBP00109 | Squash gourd | *Shinella* sp. HZN7 |
| SBP00109 | Squash gourd | *Simplicispira suum* |
| SBP00109 | Squash gourd | *Simplicispira suum* |
| SBP00109 | Squash gourd | *Simplicispira suum* |
| SBP00109 | Squash gourd | *Simplicispira suum* |
| SBP00109 | Squash gourd | *Simplicispira suum* |
| SBP00109 | Squash gourd | *Simplicispira suum* |

TABLE 3-continued

List of species identified in each metagenomic sample of each SBP Sample

| SBP ID | SBP Host Common Name | Genus sp. |
|---|---|---|
| SBP00109 | Squash gourd | *Simplicispira suum* |
| SBP00109 | Squash gourd | *Sinorhizobium fredii* |
| SBP00109 | Squash gourd | *Sinorhizobium fredii* |
| SBP00109 | Squash gourd | *Sinorhizobium fredii* |
| SBP00109 | Squash gourd | *Sinorhizobium fredii* |
| SBP00109 | Squash gourd | *Sinorhizobium fredii* |
| SBP00109 | Squash gourd | *Sinorhizobium fredii* |
| SBP00109 | Squash gourd | *Sinorhizobium* sp. RAC02 |
| SBP00109 | Squash gourd | *Sinorhizobium* sp. RAC02 |
| SBP00109 | Squash gourd | *Sinorhizobium* sp. RAC02 |
| SBP00109 | Squash gourd | *Sinorhizobium* sp. RAC02 |
| SBP00109 | Squash gourd | *Sinorhizobium* sp. RAC02 |
| SBP00109 | Squash gourd | *Sinorhizobium* sp. RAC02 |
| SBP00109 | Squash gourd | *Solimonas* sp. K1W22B-7 |
| SBP00109 | Squash gourd | *Solimonas* sp. K1W22B-7 |
| SBP00109 | Squash gourd | *Solimonas* sp. K1W22B-7 |
| SBP00109 | Squash gourd | *Solimonas* sp. K1W22B-7 |
| SBP00109 | Squash gourd | *Solimonas* sp. K1W22B-7 |
| SBP00109 | Squash gourd | *Solimonas* sp. K1W22B-7 |
| SBP00109 | Squash gourd | *Sorangium cellulosum* |
| SBP00109 | Squash gourd | *Sorangium cellulosum* |
| SBP00109 | Squash gourd | *Sorangium cellulosum* |
| SBP00109 | Squash gourd | *Sorangium cellulosum* |
| SBP00109 | Squash gourd | *Sorangium cellulosum* |
| SBP00109 | Squash gourd | *Sorangium cellulosum* |
| SBP00109 | Squash gourd | *Sphingobacterium thalpophilum* |
| SBP00109 | Squash gourd | *Sphingobacterium thalpophilum* |
| SBP00109 | Squash gourd | *Sphingobacterium thalpophilum* |
| SBP00109 | Squash gourd | *Sphingobacterium thalpophilum* |
| SBP00109 | Squash gourd | *Sphingobacterium thalpophilum* |
| SBP00109 | Squash gourd | *Sphingobacterium thalpophilum* |
| SBP00109 | Squash gourd | *Sphingobium hydrophobicum* |
| SBP00109 | Squash gourd | *Sphingobium hydrophobicum* |
| SBP00109 | Squash gourd | *Sphingobium hydrophobicum* |
| SBP00109 | Squash gourd | *Sphingobium hydrophobicum* |
| SBP00109 | Squash gourd | *Sphingobium hydrophobicum* |
| SBP00109 | Squash gourd | *Sphingobium hydrophobicum* |
| SBP00109 | Squash gourd | *Sphingomonas panacis* |
| SBP00109 | Squash gourd | *Sphingomonas panacis* |
| SBP00109 | Squash gourd | *Sphingomonas panacis* |
| SBP00109 | Squash gourd | *Sphingomonas panacis* |
| SBP00109 | Squash gourd | *Sphingomonas panacis* |
| SBP00109 | Squash gourd | *Sphingomonas panacis* |
| SBP00109 | Squash gourd | *Sphingomonas sanxanigenens* |
| SBP00109 | Squash gourd | *Sphingomonas sanxanigenens* |
| SBP00109 | Squash gourd | *Sphingomonas sanxanigenens* |
| SBP00109 | Squash gourd | *Sphingomonas sanxanigenens* |
| SBP00109 | Squash gourd | *Sphingomonas sanxanigenens* |
| SBP00109 | Squash gourd | *Sphingomonas sanxanigenens* |
| SBP00109 | Squash gourd | *Sphingomonas* sp. AAP5 |
| SBP00109 | Squash gourd | *Sphingomonas* sp. AAP5 |
| SBP00109 | Squash gourd | *Sphingomonas* sp. AAP5 |
| SBP00109 | Squash gourd | *Sphingomonas* sp. AAP5 |
| SBP00109 | Squash gourd | *Sphingomonas* sp. AAP5 |
| SBP00109 | Squash gourd | *Sphingomonas* sp. AAP5 |
| SBP00109 | Squash gourd | *Sphingomonas* sp. FARSPH |
| SBP00109 | Squash gourd | *Sphingomonas* sp. FARSPH |
| SBP00109 | Squash gourd | *Sphingomonas* sp. FARSPH |
| SBP00109 | Squash gourd | *Sphingomonas* sp. FARSPH |
| SBP00109 | Squash gourd | *Sphingomonas* sp. FARSPH |
| SBP00109 | Squash gourd | *Sphingomonas* sp. FARSPH |
| SBP00109 | Squash gourd | *Sphingomonas wittichii* |
| SBP00109 | Squash gourd | *Sphingomonas wittichii* |
| SBP00109 | Squash gourd | *Sphingomonas wittichii* |
| SBP00109 | Squash gourd | *Sphingomonas wittichii* |
| SBP00109 | Squash gourd | *Sphingomonas wittichii* |
| SBP00109 | Squash gourd | *Sphingomonas wittichii* |
| SBP00109 | Squash gourd | *Staphylococcus aureus* |
| SBP00109 | Squash gourd | *Staphylococcus aureus* |
| SBP00109 | Squash gourd | *Staphylococcus aureus* |
| SBP00109 | Squash gourd | *Staphylococcus aureus* |
| SBP00109 | Squash gourd | *Staphylococcus aureus* |
| SBP00109 | Squash gourd | *Staphylococcus aureus* |
| SBP00109 | Squash gourd | *Staphylococcus equorum* |
| SBP00109 | Squash gourd | *Staphylococcus equorum* |
| SBP00109 | Squash gourd | *Staphylococcus equorum* |

TABLE 3-continued

List of species identified in each metagenomic sample of each SBP Sample

| SBP ID | SBP Host Common Name | Genus sp. |
|---|---|---|
| SBP00109 | Squash gourd | *Staphylococcus equorum* |
| SBP00109 | Squash gourd | *Staphylococcus equorum* |
| SBP00109 | Squash gourd | *Staphylococcus equorum* |
| SBP00109 | Squash gourd | *Stenotrophomonas acidaminiphila* |
| SBP00109 | Squash gourd | *Stenotrophomonas acidaminiphila* |
| SBP00109 | Squash gourd | *Stenotrophomonas acidaminiphila* |
| SBP00109 | Squash gourd | *Stenotrophomonas acidaminiphila* |
| SBP00109 | Squash gourd | *Stenotrophomonas acidaminiphila* |
| SBP00109 | Squash gourd | *Stenotrophomonas acidaminiphila* |
| SBP00109 | Squash gourd | *Stenotrophomonas maltophilia* |
| SBP00109 | Squash gourd | *Stenotrophomonas maltophilia* |
| SBP00109 | Squash gourd | *Stenotrophomonas maltophilia* |
| SBP00109 | Squash gourd | *Stenotrophomonas maltophilia* |
| SBP00109 | Squash gourd | *Stenotrophomonas maltophilia* |
| SBP00109 | Squash gourd | *Stenotrophomonas maltophilia* |
| SBP00109 | Squash gourd | *Streptococcus anginosus* |
| SBP00109 | Squash gourd | *Streptococcus anginosus* |
| SBP00109 | Squash gourd | *Streptococcus anginosus* |
| SBP00109 | Squash gourd | *Streptococcus anginosus* |
| SBP00109 | Squash gourd | *Streptococcus anginosus* |
| SBP00109 | Squash gourd | *Streptococcus anginosus* |
| SBP00109 | Squash gourd | *Streptococcus cristatus* |
| SBP00109 | Squash gourd | *Streptococcus cristatus* |
| SBP00109 | Squash gourd | *Streptococcus cristatus* |
| SBP00109 | Squash gourd | *Streptococcus cristatus* |
| SBP00109 | Squash gourd | *Streptococcus cristatus* |
| SBP00109 | Squash gourd | *Streptococcus cristatus* |
| SBP00109 | Squash gourd | *Streptococcus macedonicus* |
| SBP00109 | Squash gourd | *Streptococcus macedonicus* |
| SBP00109 | Squash gourd | *Streptococcus macedonicus* |
| SBP00109 | Squash gourd | *Streptococcus macedonicus* |
| SBP00109 | Squash gourd | *Streptococcus macedonicus* |
| SBP00109 | Squash gourd | *Streptococcus macedonicus* |
| SBP00109 | Squash gourd | *Streptococcus parauberis* |
| SBP00109 | Squash gourd | *Streptococcus parauberis* |
| SBP00109 | Squash gourd | *Streptococcus parauberis* |
| SBP00109 | Squash gourd | *Streptococcus parauberis* |
| SBP00109 | Squash gourd | *Streptococcus parauberis* |
| SBP00109 | Squash gourd | *Streptococcus parauberis* |
| SBP00109 | Squash gourd | *Streptococcus salivarius* |
| SBP00109 | Squash gourd | *Streptococcus salivarius* |
| SBP00109 | Squash gourd | *Streptococcus salivarius* |
| SBP00109 | Squash gourd | *Streptococcus salivarius* |
| SBP00109 | Squash gourd | *Streptococcus salivarius* |
| SBP00109 | Squash gourd | *Streptococcus salivarius* |
| SBP00109 | Squash gourd | *Streptococcus* sp. FDAARGOS_192 |
| SBP00109 | Squash gourd | *Streptococcus* sp. FDAARGOS_192 |
| SBP00109 | Squash gourd | *Streptococcus* sp. FDAARGOS_192 |
| SBP00109 | Squash gourd | *Streptococcus* sp. FDAARGOS_192 |
| SBP00109 | Squash gourd | *Streptococcus* sp. FDAARGOS_192 |
| SBP00109 | Squash gourd | *Streptococcus* sp. FDAARGOS_192 |
| SBP00109 | Squash gourd | *Streptococcus* sp. HSISM1 |
| SBP00109 | Squash gourd | *Streptococcus* sp. HSISM1 |
| SBP00109 | Squash gourd | *Streptococcus* sp. HSISM1 |
| SBP00109 | Squash gourd | *Streptococcus* sp. HSISM1 |
| SBP00109 | Squash gourd | *Streptococcus* sp. HSISM1 |
| SBP00109 | Squash gourd | *Streptococcus* sp. HSISM1 |
| SBP00109 | Squash gourd | *Streptococcus thermophilus* |
| SBP00109 | Squash gourd | *Streptococcus thermophilus* |
| SBP00109 | Squash gourd | *Streptococcus thermophilus* |
| SBP00109 | Squash gourd | *Streptococcus thermophilus* |
| SBP00109 | Squash gourd | *Streptococcus thermophilus* |
| SBP00109 | Squash gourd | *Streptococcus thermophilus* |
| SBP00109 | Squash gourd | *Streptomyces lincolnensis* |
| SBP00109 | Squash gourd | *Streptomyces lincolnensis* |
| SBP00109 | Squash gourd | *Streptomyces lincolnensis* |
| SBP00109 | Squash gourd | *Streptomyces lincolnensis* |
| SBP00109 | Squash gourd | *Streptomyces lincolnensis* |
| SBP00109 | Squash gourd | *Streptomyces lincolnensis* |
| SBP00109 | Squash gourd | *Streptomyces pactum* |
| SBP00109 | Squash gourd | *Streptomyces pactum* |
| SBP00109 | Squash gourd | *Streptomyces pactum* |
| SBP00109 | Squash gourd | *Streptomyces pactum* |
| SBP00109 | Squash gourd | *Streptomyces pactum* |
| SBP00109 | Squash gourd | *Streptomyces pactum* |
| SBP00109 | Squash gourd | *Streptomyces* sp. CdTB01 |

TABLE 3-continued

List of species identified in each metagenomic sample of each SBP Sample

| SBP ID | SBP Host Common Name | Genus sp. |
|---|---|---|
| SBP00109 | Squash gourd | *Streptomyces* sp. CdTB01 |
| SBP00109 | Squash gourd | *Streptomyces* sp. CdTB01 |
| SBP00109 | Squash gourd | *Streptomyces* sp. CdTB01 |
| SBP00109 | Squash gourd | *Streptomyces* sp. CdTB01 |
| SBP00109 | Squash gourd | *Streptomyces* sp. CdTB01 |
| SBP00109 | Squash gourd | *Streptomyces* sp. W1SF4 |
| SBP00109 | Squash gourd | *Streptomyces* sp. W1SF4 |
| SBP00109 | Squash gourd | *Streptomyces* sp. W1SF4 |
| SBP00109 | Squash gourd | *Streptomyces* sp. W1SF4 |
| SBP00109 | Squash gourd | *Streptomyces* sp. W1SF4 |
| SBP00109 | Squash gourd | *Streptomyces xiamenensis* |
| SBP00109 | Squash gourd | *Streptomyces xiamenensis* |
| SBP00109 | Squash gourd | *Streptomyces xiamenensis* |
| SBP00109 | Squash gourd | *Streptomyces xiamenensis* |
| SBP00109 | Squash gourd | *Streptomyces xiamenensis* |
| SBP00109 | Squash gourd | *Sulfuriferula* sp. AH1 |
| SBP00109 | Squash gourd | *Sulfuriferula* sp. AH1 |
| SBP00109 | Squash gourd | *Sulfuriferula* sp. AH1 |
| SBP00109 | Squash gourd | *Sulfuriferula* sp. AH1 |
| SBP00109 | Squash gourd | *Sulfuriferula* sp. AH1 |
| SBP00109 | Squash gourd | *Sulfuriferula* sp. AH1 |
| SBP00109 | Squash gourd | *Thauera aromatica* |
| SBP00109 | Squash gourd | *Thauera aromatica* |
| SBP00109 | Squash gourd | *Thauera aromatica* |
| SBP00109 | Squash gourd | *Thauera aromatica* |
| SBP00109 | Squash gourd | *Thauera aromatica* |
| SBP00109 | Squash gourd | *Thauera aromatica* |
| SBP00109 | Squash gourd | *Thauera* sp. K11 |
| SBP00109 | Squash gourd | *Thauera* sp. K11 |
| SBP00109 | Squash gourd | *Thauera* sp. K11 |
| SBP00109 | Squash gourd | *Thauera* sp. K11 |
| SBP00109 | Squash gourd | *Thauera* sp. K11 |
| SBP00109 | Squash gourd | *Thauera* sp. K11 |
| SBP00109 | Squash gourd | *Thermomonospora curvata* |
| SBP00109 | Squash gourd | *Thermomonospora curvata* |
| SBP00109 | Squash gourd | *Thermomonospora curvata* |
| SBP00109 | Squash gourd | *Thermomonospora curvata* |
| SBP00109 | Squash gourd | *Thermomonospora curvata* |
| SBP00109 | Squash gourd | *Thermomonospora curvata* |
| SBP00109 | Squash gourd | *Thiomonas intermedia* |
| SBP00109 | Squash gourd | *Thiomonas intermedia* |
| SBP00109 | Squash gourd | *Thiomonas intermedia* |
| SBP00109 | Squash gourd | *Thiomonas intermedia* |
| SBP00109 | Squash gourd | *Thiomonas intermedia* |
| SBP00109 | Squash gourd | *Thiomonas intermedia* |
| SBP00109 | Squash gourd | *Thiomonas* sp. X19 |
| SBP00109 | Squash gourd | *Thiomonas* sp. X19 |
| SBP00109 | Squash gourd | *Thiomonas* sp. X19 |
| SBP00109 | Squash gourd | *Thiomonas* sp. X19 |
| SBP00109 | Squash gourd | *Thiomonas* sp. X19 |
| SBP00109 | Squash gourd | *Thiomonas* sp. X19 |
| SBP00109 | Squash gourd | *Variovorax boronicumulans* |
| SBP00109 | Squash gourd | *Variovorax boronicumulans* |
| SBP00109 | Squash gourd | *Variovorax boronicumulans* |
| SBP00109 | Squash gourd | *Variovorax boronicumulans* |
| SBP00109 | Squash gourd | *Variovorax boronicumulans* |
| SBP00109 | Squash gourd | *Variovorax boronicumulans* |
| SBP00109 | Squash gourd | *Variovorax paradoxus* |
| SBP00109 | Squash gourd | *Variovorax paradoxus* |
| SBP00109 | Squash gourd | *Variovorax paradoxus* |
| SBP00109 | Squash gourd | *Variovorax paradoxus* |
| SBP00109 | Squash gourd | *Variovorax paradoxus* |
| SBP00109 | Squash gourd | *Variovorax paradoxus* |
| SBP00109 | Squash gourd | *Variovorax* sp. HW608 |
| SBP00109 | Squash gourd | *Variovorax* sp. HW608 |
| SBP00109 | Squash gourd | *Variovorax* sp. HW608 |
| SBP00109 | Squash gourd | *Variovorax* sp. HW608 |
| SBP00109 | Squash gourd | *Variovorax* sp. HW608 |
| SBP00109 | Squash gourd | *Variovorax* sp. HW608 |
| SBP00109 | Squash gourd | *Variovorax* sp. PAMC 28711 |
| SBP00109 | Squash gourd | *Variovorax* sp. PAMC 28711 |
| SBP00109 | Squash gourd | *Variovorax* sp. PAMC 28711 |
| SBP00109 | Squash gourd | *Variovorax* sp. PAMC 28711 |
| SBP00109 | Squash gourd | *Variovorax* sp. PAMC 28711 |

TABLE 3-continued

List of species identified in each metagenomic sample of each SBP Sample

| SBP ID | SBP Host Common Name | Genus sp. |
|---|---|---|
| SBP00109 | Squash gourd | *Variovorax* sp. PAMC 28711 |
| SBP00109 | Squash gourd | *Verminephrobacter eiseniae* |
| SBP00109 | Squash gourd | *Verminephrobacter eiseniae* |
| SBP00109 | Squash gourd | *Verminephrobacter eiseniae* |
| SBP00109 | Squash gourd | *Verminephrobacter eiseniae* |
| SBP00109 | Squash gourd | *Verminephrobacter eiseniae* |
| SBP00109 | Squash gourd | *Verminephrobacter eiseniae* |
| SBP00109 | Squash gourd | *Vitreoscilla filiformis* |
| SBP00109 | Squash gourd | *Vitreoscilla filiformis* |
| SBP00109 | Squash gourd | *Vitreoscilla filiformis* |
| SBP00109 | Squash gourd | *Vitreoscilla filiformis* |
| SBP00109 | Squash gourd | *Vitreoscilla filiformis* |
| SBP00109 | Squash gourd | *Vitreoscilla filiformis* |
| SBP00109 | Squash gourd | *Weissella cibaria* |
| SBP00109 | Squash gourd | *Weissella cibaria* |
| SBP00109 | Squash gourd | *Weissella cibaria* |
| SBP00109 | Squash gourd | *Weissella cibaria* |
| SBP00109 | Squash gourd | *Weissella cibaria* |
| SBP00109 | Squash gourd | *Weissella cibaria* |
| SBP00109 | Squash gourd | *Weissella confusa* |
| SBP00109 | Squash gourd | *Weissella confusa* |
| SBP00109 | Squash gourd | *Weissella confusa* |
| SBP00109 | Squash gourd | *Weissella confusa* |
| SBP00109 | Squash gourd | *Weissella confusa* |
| SBP00109 | Squash gourd | *Weissella confusa* |
| SBP00109 | Squash gourd | *Weissella hellenica* |
| SBP00109 | Squash gourd | *Weissella hellenica* |
| SBP00109 | Squash gourd | *Weissella hellenica* |
| SBP00109 | Squash gourd | *Weissella hellenica* |
| SBP00109 | Squash gourd | *Weissella hellenica* |
| SBP00109 | Squash gourd | *Weissella hellenica* |
| SBP00109 | Squash gourd | *Weissella jogaejeotgali* |
| SBP00109 | Squash gourd | *Weissella jogaejeotgali* |
| SBP00109 | Squash gourd | *Weissella jogaejeotgali* |
| SBP00109 | Squash gourd | *Weissella jogaejeotgali* |
| SBP00109 | Squash gourd | *Weissella jogaejeotgali* |
| SBP00109 | Squash gourd | *Weissella jogaejeotgali* |
| SBP00109 | Squash gourd | *Weissella koreensis* |
| SBP00109 | Squash gourd | *Weissella koreensis* |
| SBP00109 | Squash gourd | *Weissella koreensis* |
| SBP00109 | Squash gourd | *Weissella koreensis* |
| SBP00109 | Squash gourd | *Weissella koreensis* |
| SBP00109 | Squash gourd | *Weissella koreensis* |
| SBP00109 | Squash gourd | *Weissella paramesenteroides* |
| SBP00109 | Squash gourd | *Weissella paramesenteroides* |
| SBP00109 | Squash gourd | *Weissella paramesenteroides* |
| SBP00109 | Squash gourd | *Weissella paramesenteroides* |
| SBP00109 | Squash gourd | *Weissella paramesenteroides* |
| SBP00109 | Squash gourd | *Weissella paramesenteroides* |
| SBP00109 | Squash gourd | *Weissella viridescens* |
| SBP00109 | Squash gourd | *Weissella viridescens* |
| SBP00109 | Squash gourd | *Weissella viridescens* |
| SBP00109 | Squash gourd | *Weissella viridescens* |
| SBP00109 | Squash gourd | *Weissella viridescens* |
| SBP00109 | Squash gourd | *Weissella viridescens* |
| SBP00109 | Squash gourd | *Xanthobacter autotrophicus* |
| SBP00109 | Squash gourd | *Xanthobacter autotrophicus* |
| SBP00109 | Squash gourd | *Xanthobacter autotrophicus* |
| SBP00109 | Squash gourd | *Xanthobacter autotrophicus* |
| SBP00109 | Squash gourd | *Xanthobacter autotrophicus* |
| SBP00109 | Squash gourd | *Xanthobacter autotrophicus* |
| SBP00109 | Squash gourd | *Xanthomonas campestris* |
| SBP00109 | Squash gourd | *Xanthomonas campestris* |
| SBP00109 | Squash gourd | *Xanthomonas campestris* |
| SBP00109 | Squash gourd | *Xanthomonas campestris* |
| SBP00109 | Squash gourd | *Xanthomonas campestris* |
| SBP00109 | Squash gourd | *Xanthomonas campestris* |
| SBP00109 | Squash gourd | *Xanthomonas citri* |
| SBP00109 | Squash gourd | *Xanthomonas citri* |
| SBP00109 | Squash gourd | *Xanthomonas citri* |
| SBP00109 | Squash gourd | *Xanthomonas citri* |
| SBP00109 | Squash gourd | *Xanthomonas citri* |
| SBP00109 | Squash gourd | *Xylanimonas cellulosilytica* |
| SBP00109 | Squash gourd | *Xylanimonas cellulosilytica* |
| SBP00109 | Squash gourd | *Xylanimonas cellulosilytica* |

TABLE 3-continued

List of species identified in each metagenomic sample of each SBP Sample

| SBP ID | SBP Host Common Name | Genus sp. |
|---|---|---|
| SBP00109 | Squash gourd | Xylanimonas cellulosilytica |
| SBP00109 | Squash gourd | Xylanimonas cellulosilytica |
| SBP00109 | Squash gourd | Xylanimonas cellulosilytica |
| SBP00129 | Frescatrano Olives | [Bacillus] selenitireducens |
| SBP00129 | Frescatrano Olives | [Brevibacterium] frigoritolerans |
| SBP00129 | Frescatrano Olives | [Clostridium] saccharolyticum |
| SBP00129 | Frescatrano Olives | [Clostridium] sphenoides |
| SBP00129 | Frescatrano Olives | [Eubacterium] eligens |
| SBP00129 | Frescatrano Olives | [Eubacterium] hallii |
| SBP00129 | Frescatrano Olives | [Eubacterium] rectale |
| SBP00129 | Frescatrano Olives | [Eubacterium] sulci |
| SBP00129 | Frescatrano Olives | [Pasteurella] aerogenes |
| SBP00129 | Frescatrano Olives | [Polyangium] brachysporum |
| SBP00129 | Frescatrano Olives | Acetoanaerobium sticklandii |
| SBP00129 | Frescatrano Olives | Acetobacter pasteurianus |
| SBP00129 | Frescatrano Olives | Acetobacteraceae bacterium |
| SBP00129 | Frescatrano Olives | Acetobacterium sp. KB-1 |
| SBP00129 | Frescatrano Olives | Acetobacterium woodii |
| SBP00129 | Frescatrano Olives | Acetohalobium arabaticum |
| SBP00129 | Frescatrano Olives | Acholeplasma axanthum |
| SBP00129 | Frescatrano Olives | Acholeplasma hippikon |
| SBP00129 | Frescatrano Olives | Acholeplasma laidlawii |
| SBP00129 | Frescatrano Olives | Acholeplasma oculi |
| SBP00129 | Frescatrano Olives | Achromobacter denitrificans |
| SBP00129 | Frescatrano Olives | Achromobacter insolitus |
| SBP00129 | Frescatrano Olives | Achromobacter sp. AONIH1 |
| SBP00129 | Frescatrano Olives | Achromobacter sp. B7 |
| SBP00129 | Frescatrano Olives | Achromobacter sp. MFA1 R4 |
| SBP00129 | Frescatrano Olives | Achromobacter spanius |
| SBP00129 | Frescatrano Olives | Achromobacter xylosoxidans |
| SBP00129 | Frescatrano Olives | Acidimicrobium ferrooxidans |
| SBP00129 | Frescatrano Olives | Acidipropionibacterium acidipropionici |
| SBP00129 | Frescatrano Olives | Acidipropionibacterium jensenii |
| SBP00129 | Frescatrano Olives | Acidipropionibacterium virtanenii |
| SBP00129 | Frescatrano Olives | Acidobacteriaceae bacterium SBC82 |
| SBP00129 | Frescatrano Olives | Acidovorax avenae |
| SBP00129 | Frescatrano Olives | Acidovorax carolinensis |
| SBP00129 | Frescatrano Olives | Acidovorax ebreus |
| SBP00129 | Frescatrano Olives | Acidovorax sp. 1608163 |
| SBP00129 | Frescatrano Olives | Acidovorax sp. JS42 |
| SBP00129 | Frescatrano Olives | Acidovorax sp. KKS102 |
| SBP00129 | Frescatrano Olives | Acidovorax sp. RAC01 |
| SBP00129 | Frescatrano Olives | Acidovorax sp. T1 |
| SBP00129 | Frescatrano Olives | Acinetobacter calcoaceticus |
| SBP00129 | Frescatrano Olives | Acinetobacter haemolyticus |
| SBP00129 | Frescatrano Olives | Acinetobacter johnsonii |
| SBP00129 | Frescatrano Olives | Acinetobacter phage vB_AbaM_phiAbaA1 |
| SBP00129 | Frescatrano Olives | Acinetobacter radioresistens |
| SBP00129 | Frescatrano Olives | Acinetobacter soli |
| SBP00129 | Frescatrano Olives | Acinetobacter sp. ACNIH1 |
| SBP00129 | Frescatrano Olives | Acinetobacter sp. NCuZD-2 |
| SBP00129 | Frescatrano Olives | Acinetobacter sp. TGL-Y2 |
| SBP00129 | Frescatrano Olives | Acinetobacter sp. TTH0-4 |
| SBP00129 | Frescatrano Olives | Actinobacillus pleuropneumoniae |
| SBP00129 | Frescatrano Olives | Actinobacillus porcitonsillarum |
| SBP00129 | Frescatrano Olives | Actinobacteria bacterium IMCC19121 |
| SBP00129 | Frescatrano Olives | Actinomyces meyeri |
| SBP00129 | Frescatrano Olives | Actinomyces sp. 2129 |
| SBP00129 | Frescatrano Olives | Actinoplanes sp. ATCC 31351 |
| SBP00129 | Frescatrano Olives | Aequorivita sublithincola |
| SBP00129 | Frescatrano Olives | Aeribacillus pallidus |
| SBP00129 | Frescatrano Olives | Aerococcaceae bacterium ZY16052 |
| SBP00129 | Frescatrano Olives | Aerococcus christensenii |
| SBP00129 | Frescatrano Olives | Aerococcus sanguinicola |
| SBP00129 | Frescatrano Olives | Aerococcus urinae |
| SBP00129 | Frescatrano Olives | Aerococcus urinaeequi |
| SBP00129 | Frescatrano Olives | Aerococcus urinaehominis |
| SBP00129 | Frescatrano Olives | Aerococcus viridans |
| SBP00129 | Frescatrano Olives | Aeromonas veronii |
| SBP00129 | Frescatrano Olives | Afipia sp. GAS231 |
| SBP00129 | Frescatrano Olives | Agarilytica rhodophyticola |
| SBP00129 | Frescatrano Olives | Aggregatibacter actinomycetemcomitans |
| SBP00129 | Frescatrano Olives | Agrobacterium fabrum |
| SBP00129 | Frescatrano Olives | Agrobacterium sp. |
| SBP00129 | Frescatrano Olives | Agrobacterium tumefaciens |
| SBP00129 | Frescatrano Olives | Agrobacterium vitis |

TABLE 3-continued

List of species identified in each metagenomic sample of each SBP Sample

| SBP ID | SBP Host Common Name | Genus sp. |
|---|---|---|
| SBP00129 | Frescatrano Olives | *Agrotis segetum granulovirus* |
| SBP00129 | Frescatrano Olives | *Akkermansia muciniphila* |
| SBP00129 | Frescatrano Olives | *Alcaligenes faecalis* |
| SBP00129 | Frescatrano Olives | *Alicycliphilus denitrificans* |
| SBP00129 | Frescatrano Olives | *Aliivibrio fischeri* |
| SBP00129 | Frescatrano Olives | *Aliivibrio salmonicida* |
| SBP00129 | Frescatrano Olives | *Aliivibrio wodanis* |
| SBP00129 | Frescatrano Olives | *Alkaliphilus metalliredigens* |
| SBP00129 | Frescatrano Olives | *Alkaliphilus oremlandii* |
| SBP00129 | Frescatrano Olives | *Alkalitalea saponilacus* |
| SBP00129 | Frescatrano Olives | *Allofrancisella guangzhouensis* |
| SBP00129 | Frescatrano Olives | *Allokutzneria albata* |
| SBP00129 | Frescatrano Olives | *Altererythrobacter epoxidivorans* |
| SBP00129 | Frescatrano Olives | *Aminobacter aminovorans* |
| SBP00129 | Frescatrano Olives | *Aminobacter* sp. MSH1 |
| SBP00129 | Frescatrano Olives | *Amphibacillus xylanus* |
| SBP00129 | Frescatrano Olives | *Anabaena cylindrica* |
| SBP00129 | Frescatrano Olives | *Anaerococcus mediterraneensis* |
| SBP00129 | Frescatrano Olives | *Anaerostipes hadrus* |
| SBP00129 | Frescatrano Olives | *Anaerostipes rhamnosivorans* |
| SBP00129 | Frescatrano Olives | *Anderseniella* sp. Alg231-50 |
| SBP00129 | Frescatrano Olives | *Aneurinibacillus soli* |
| SBP00129 | Frescatrano Olives | *Aneurinibacillus* sp. XH2 |
| SBP00129 | Frescatrano Olives | *Anoxybacillus amylolyticus* |
| SBP00129 | Frescatrano Olives | *Anoxybacillus flavithermus* |
| SBP00129 | Frescatrano Olives | *Anoxybacillus gonensis* |
| SBP00129 | Frescatrano Olives | *Anoxybacillus kamchatkensis* |
| SBP00129 | Frescatrano Olives | *Antarcticibacterium flavum* |
| SBP00129 | Frescatrano Olives | *Antarctobacter heliothermus* |
| SBP00129 | Frescatrano Olives | *Aquabacterium olei* |
| SBP00129 | Frescatrano Olives | *Aquimarina* sp. AD1 |
| SBP00129 | Frescatrano Olives | *Aquimarina* sp. AD10 |
| SBP00129 | Frescatrano Olives | *Aquimarina* sp. BL5 |
| SBP00129 | Frescatrano Olives | *Aquitalea* sp. THG-DN7.12 |
| SBP00129 | Frescatrano Olives | *Aquitalea* sp. USM4 |
| SBP00129 | Frescatrano Olives | *Arcobacter molluscorum* |
| SBP00129 | Frescatrano Olives | *Arcobacter pacificus* |
| SBP00129 | Frescatrano Olives | *Arthrobacter alpinus* |
| SBP00129 | Frescatrano Olives | *Atlantibacter hermannii* |
| SBP00129 | Frescatrano Olives | *Auricoccus indicus* |
| SBP00129 | Frescatrano Olives | *Azoarcus olearius* |
| SBP00129 | Frescatrano Olives | *Azoarcus* sp. CIB |
| SBP00129 | Frescatrano Olives | *Azoarcus* sp. DN11 |
| SBP00129 | Frescatrano Olives | *Azoarcus* sp. KH32C |
| SBP00129 | Frescatrano Olives | *Azorhizobium caulinodans* |
| SBP00129 | Frescatrano Olives | *Azospira oryzae* |
| SBP00129 | Frescatrano Olives | *Azospirillum brasilense* |
| SBP00129 | Frescatrano Olives | *Azospirillum humicireducens* |
| SBP00129 | Frescatrano Olives | *Azospirillum lipoferum* |
| SBP00129 | Frescatrano Olives | *Azospirillum* sp. CFH 70021 |
| SBP00129 | Frescatrano Olives | *Azospirillum* sp. TSH100 |
| SBP00129 | Frescatrano Olives | *Azotobacter chroococcum* |
| SBP00129 | Frescatrano Olives | *Azotobacter vinelandii* |
| SBP00129 | Frescatrano Olives | *Bacillus albus* |
| SBP00129 | Frescatrano Olives | *Bacillus altitudinis* |
| SBP00129 | Frescatrano Olives | *Bacillus amyloliquefaciens* |
| SBP00129 | Frescatrano Olives | *Bacillus anthracis* |
| SBP00129 | Frescatrano Olives | *Bacillus asahii* |
| SBP00129 | Frescatrano Olives | *Bacillus atrophaeus* |
| SBP00129 | Frescatrano Olives | *Bacillus beveridgei* |
| SBP00129 | Frescatrano Olives | *Bacillus butanolivorans* |
| SBP00129 | Frescatrano Olives | *Bacillus cellulosilyticus* |
| SBP00129 | Frescatrano Olives | *Bacillus cereus* |
| SBP00129 | Frescatrano Olives | *Bacillus ciccensis* |
| SBP00129 | Frescatrano Olives | *Bacillus circulans* |
| SBP00129 | Frescatrano Olives | *Bacillus clausii* |
| SBP00129 | Frescatrano Olives | *Bacillus coagulans* |
| SBP00129 | Frescatrano Olives | *Bacillus cohnii* |
| SBP00129 | Frescatrano Olives | *Bacillus cytotoxicus* |
| SBP00129 | Frescatrano Olives | *Bacillus flexus* |
| SBP00129 | Frescatrano Olives | *Bacillus foraminis* |
| SBP00129 | Frescatrano Olives | *Bacillus freudenreichii* |
| SBP00129 | Frescatrano Olives | *Bacillus glycinifermentans* |
| SBP00129 | Frescatrano Olives | *Bacillus gobiensis* |
| SBP00129 | Frescatrano Olives | *Bacillus halodurans* |
| SBP00129 | Frescatrano Olives | *Bacillus halotolerans* |

TABLE 3-continued

List of species identified in each metagenomic sample of each SBP Sample

| SBP ID | SBP Host Common Name | Genus sp. |
|---|---|---|
| SBP00129 | Frescatrano Olives | Bacillus horikoshii |
| SBP00129 | Frescatrano Olives | Bacillus infantis |
| SBP00129 | Frescatrano Olives | Bacillus jeotgali |
| SBP00129 | Frescatrano Olives | Bacillus kochii |
| SBP00129 | Frescatrano Olives | Bacillus krulwichiae |
| SBP00129 | Frescatrano Olives | Bacillus lehensis |
| SBP00129 | Frescatrano Olives | Bacillus lentus |
| SBP00129 | Frescatrano Olives | Bacillus litoralis |
| SBP00129 | Frescatrano Olives | Bacillus marisflavi |
| SBP00129 | Frescatrano Olives | Bacillus megaterium |
| SBP00129 | Frescatrano Olives | Bacillus mesonae |
| SBP00129 | Frescatrano Olives | Bacillus methanolicus |
| SBP00129 | Frescatrano Olives | Bacillus muralis |
| SBP00129 | Frescatrano Olives | Bacillus mycoides |
| SBP00129 | Frescatrano Olives | Bacillus oceanisediminis |
| SBP00129 | Frescatrano Olives | Bacillus paralicheniformis |
| SBP00129 | Frescatrano Olives | Bacillus pseudofirmus |
| SBP00129 | Frescatrano Olives | Bacillus pseudomycoides |
| SBP00129 | Frescatrano Olives | Bacillus pumilus |
| SBP00129 | Frescatrano Olives | Bacillus safensis |
| SBP00129 | Frescatrano Olives | Bacillus simplex |
| SBP00129 | Frescatrano Olives | Bacillus smithii |
| SBP00129 | Frescatrano Olives | Bacillus sonorensis |
| SBP00129 | Frescatrano Olives | Bacillus sp. (in: Bacteria) |
| SBP00129 | Frescatrano Olives | Bacillus sp. 1NLA3E |
| SBP00129 | Frescatrano Olives | Bacillus sp. FJAT-18017 |
| SBP00129 | Frescatrano Olives | Bacillus sp. FJAT-22090 |
| SBP00129 | Frescatrano Olives | Bacillus sp. FJAT-42376 |
| SBP00129 | Frescatrano Olives | Bacillus sp. FJAT-45348 |
| SBP00129 | Frescatrano Olives | Bacillus sp. OxB-1 |
| SBP00129 | Frescatrano Olives | Bacillus sp. X1(2014) |
| SBP00129 | Frescatrano Olives | Bacillus sp. Y1 |
| SBP00129 | Frescatrano Olives | Bacillus subtilis |
| SBP00129 | Frescatrano Olives | Bacillus thermoamylovorans |
| SBP00129 | Frescatrano Olives | Bacillus thermocopriae |
| SBP00129 | Frescatrano Olives | Bacillus thuringiensis |
| SBP00129 | Frescatrano Olives | Bacillus toyonensis |
| SBP00129 | Frescatrano Olives | Bacillus vallismortis |
| SBP00129 | Frescatrano Olives | Bacillus velezensis |
| SBP00129 | Frescatrano Olives | Bacillus weihaiensis |
| SBP00129 | Frescatrano Olives | Bacillus wiedmannii |
| SBP00129 | Frescatrano Olives | Bacillus xiamenensis |
| SBP00129 | Frescatrano Olives | Bacteroidales bacterium CF |
| SBP00129 | Frescatrano Olives | Bacteroides cellulosilyticus |
| SBP00129 | Frescatrano Olives | Bacteroides fragilis |
| SBP00129 | Frescatrano Olives | Bacteroides helcogenes |
| SBP00129 | Frescatrano Olives | Bacteroides ovatus |
| SBP00129 | Frescatrano Olives | Bacteroides zoogleoformans |
| SBP00129 | Frescatrano Olives | Bartonella australis |
| SBP00129 | Frescatrano Olives | Bartonella quintana |
| SBP00129 | Frescatrano Olives | Bdellovibrio bacteriovorus |
| SBP00129 | Frescatrano Olives | Belliella baltica |
| SBP00129 | Frescatrano Olives | Bifidobacterium animalis |
| SBP00129 | Frescatrano Olives | Bifidobacterium longum |
| SBP00129 | Frescatrano Olives | Blastochloris sp. GI |
| SBP00129 | Frescatrano Olives | Blautia hansenii |
| SBP00129 | Frescatrano Olives | Blautia producta |
| SBP00129 | Frescatrano Olives | Blautia sp. N6H1-15 |
| SBP00129 | Frescatrano Olives | blood disease bacterium AZ-HR MARDI |
| SBP00129 | Frescatrano Olives | Bordetella avium |
| SBP00129 | Frescatrano Olives | Bordetella bronchialis |
| SBP00129 | Frescatrano Olives | Bordetella bronchiseptica |
| SBP00129 | Frescatrano Olives | Bordetella flabilis |
| SBP00129 | Frescatrano Olives | Bordetella genomosp. 13 |
| SBP00129 | Frescatrano Olives | Bordetella genomosp. 8 |
| SBP00129 | Frescatrano Olives | Bordetella hinzii |
| SBP00129 | Frescatrano Olives | Bordetella parapertussis |
| SBP00129 | Frescatrano Olives | Bordetella pseudohinzii |
| SBP00129 | Frescatrano Olives | Bordetella sp. N |
| SBP00129 | Frescatrano Olives | Borreliella valaisiana |
| SBP00129 | Frescatrano Olives | Bosea sp. AS-1 |
| SBP00129 | Frescatrano Olives | Bosea sp. PAMC 26642 |
| SBP00129 | Frescatrano Olives | Bosea sp. RAC05 |
| SBP00129 | Frescatrano Olives | Bosea sp. Tri-49 |
| SBP00129 | Frescatrano Olives | Bosea vaviloviae |
| SBP00129 | Frescatrano Olives | Brachyspira murdochii |

TABLE 3-continued

List of species identified in each metagenomic sample of each SBP Sample

| SBP ID | SBP Host Common Name | Genus sp. |
|---|---|---|
| SBP00129 | Frescatrano Olives | *Brachyspira pilosicoli* |
| SBP00129 | Frescatrano Olives | *Bradyrhizobiaceae bacterium* SG-6C |
| SBP00129 | Frescatrano Olives | *Bradyrhizobium diazoefficiens* |
| SBP00129 | Frescatrano Olives | *Bradyrhizobium erythrophlei* |
| SBP00129 | Frescatrano Olives | *Bradyrhizobium guangdongense* |
| SBP00129 | Frescatrano Olives | *Bradyrhizobium guangxiense* |
| SBP00129 | Frescatrano Olives | *Bradyrhizobium icense* |
| SBP00129 | Frescatrano Olives | *Bradyrhizobium japonicum* |
| SBP00129 | Frescatrano Olives | *Bradyrhizobium lablabi* |
| SBP00129 | Frescatrano Olives | *Bradyrhizobium oligotrophicum* |
| SBP00129 | Frescatrano Olives | *Bradyrhizobium ottawaense* |
| SBP00129 | Frescatrano Olives | *Bradyrhizobium* sp. |
| SBP00129 | Frescatrano Olives | *Bradyrhizobium* sp. 2 3951MB |
| SBP00129 | Frescatrano Olives | *Bradyrhizobium* sp. 3 |
| SBP00129 | Frescatrano Olives | *Bradyrhizobium* sp. 3 8551MB |
| SBP00129 | Frescatrano Olives | *Bradyrhizobium* sp. BTAi1 |
| SBP00129 | Frescatrano Olives | *Bradyrhizobium* sp. CCBAU 51670 |
| SBP00129 | Frescatrano Olives | *Bradyrhizobium* sp. CCBAU 51778 |
| SBP00129 | Frescatrano Olives | *Bradyrhizobium* sp. CCGE-LA001 |
| SBP00129 | Frescatrano Olives | *Bradyrhizobium* sp. ORS 278 |
| SBP00129 | Frescatrano Olives | *Bradyrhizobium* sp. ORS 285 |
| SBP00129 | Frescatrano Olives | *Bradyrhizobium* sp. ORS 3257 |
| SBP00129 | Frescatrano Olives | *Bradyrhizobium* sp. S23321 |
| SBP00129 | Frescatrano Olives | *Bradyrhizobium* sp. SK17 |
| SBP00129 | Frescatrano Olives | *Bradyrhizobium* sp. WSM471 |
| SBP00129 | Frescatrano Olives | *Brevibacillus agri* |
| SBP00129 | Frescatrano Olives | *Brevibacillus brevis* |
| SBP00129 | Frescatrano Olives | *Brevibacillus formosus* |
| SBP00129 | Frescatrano Olives | *Brevibacillus laterosporus* |
| SBP00129 | Frescatrano Olives | *Brevibacillus* sp. SCSIO 07484 |
| SBP00129 | Frescatrano Olives | *Brevirhabdus pacifica* |
| SBP00129 | Frescatrano Olives | *Brevundimonas vesicularis* |
| SBP00129 | Frescatrano Olives | *Brochothrix thermosphacta* |
| SBP00129 | Frescatrano Olives | *Buchnera aphidicola* |
| SBP00129 | Frescatrano Olives | *Burkholderia ambifaria* |
| SBP00129 | Frescatrano Olives | *Burkholderia cenocepacia* |
| SBP00129 | Frescatrano Olives | *Burkholderia cepacia* |
| SBP00129 | Frescatrano Olives | *Burkholderia contaminans* |
| SBP00129 | Frescatrano Olives | *Burkholderia gladioli* |
| SBP00129 | Frescatrano Olives | *Burkholderia lata* |
| SBP00129 | Frescatrano Olives | *Burkholderia multivorans* |
| SBP00129 | Frescatrano Olives | *Burkholderia plantarii* |
| SBP00129 | Frescatrano Olives | *Burkholderia* sp. CCGE1002 |
| SBP00129 | Frescatrano Olives | *Burkholderia* sp. CCGE1003 |
| SBP00129 | Frescatrano Olives | *Burkholderia* sp. JP2-270 |
| SBP00129 | Frescatrano Olives | *Burkholderia* sp. PAMC 26561 |
| SBP00129 | Frescatrano Olives | *Burkholderia stabilis* |
| SBP00129 | Frescatrano Olives | *Burkholderia thailandensis* |
| SBP00129 | Frescatrano Olives | *Burkholderia ubonensis* |
| SBP00129 | Frescatrano Olives | *Burkholderiales bacterium* JOSHI_001 |
| SBP00129 | Frescatrano Olives | *Buttiauxella* sp. 3AFRM03 |
| SBP00129 | Frescatrano Olives | *Butyrivibrio fibrisalvens* |
| SBP00129 | Frescatrano Olives | *Butyrivibrio hungatei* |
| SBP00129 | Frescatrano Olives | *Caldicellulosiruptor obsidiansis* |
| SBP00129 | Frescatrano Olives | *Caldilinea aerophila* |
| SBP00129 | Frescatrano Olives | *Calothrix parietina* |
| SBP00129 | Frescatrano Olives | *Campylobacter avium* |
| SBP00129 | Frescatrano Olives | *Campylobacter concisus* |
| SBP00129 | Frescatrano Olives | *Campylobacter jejuni* |
| SBP00129 | Frescatrano Olives | *Campylobacter lari* |
| SBP00129 | Frescatrano Olives | *Campylobacter pinnipediorum* |
| SBP00129 | Frescatrano Olives | *Campylobacter volucris* |
| SBP00129 | Frescatrano Olives | *Candidatus Gullanella endobia* |
| SBP00129 | Frescatrano Olives | *Candidatus Izimaplasma* sp. HR1 |
| SBP00129 | Frescatrano Olives | *Candidatus Kinetoplastibacterium oncopeltii* |
| SBP00129 | Frescatrano Olives | *Candidatus Kinetoplastibacterium sorsogonicusi* |
| SBP00129 | Frescatrano Olives | *Candidatus Kuenenia stuttgartiensis* |
| SBP00129 | Frescatrano Olives | *Candidatus Pelagibacter* sp. HIMB1321 |
| SBP00129 | Frescatrano Olives | *Candidatus Rickettsiella viridis* |
| SBP00129 | Frescatrano Olives | *Candidatus Ruthia magnifica* |
| SBP00129 | Frescatrano Olives | *Candidatus Sulcia muelleri* |
| SBP00129 | Frescatrano Olives | *Candidatus Symbiobacter mobilis* |
| SBP00129 | Frescatrano Olives | *Capnocytophaga gingivalis* |
| SBP00129 | Frescatrano Olives | *Capnocytophaga leadbetteri* |
| SBP00129 | Frescatrano Olives | *Capnocytophaga* sp. oral taxon 323 |
| SBP00129 | Frescatrano Olives | *Carboxydocella thermautotrophica* |

TABLE 3-continued

List of species identified in each metagenomic sample of each SBP Sample

| SBP ID | SBP Host Common Name | Genus sp. |
|---|---|---|
| SBP00129 | Frescatrano Olives | *Carnobacterium divergens* |
| SBP00129 | Frescatrano Olives | *Carnobacterium inhibens* |
| SBP00129 | Frescatrano Olives | *Carnobacterium maltaromaticum* |
| SBP00129 | Frescatrano Olives | *Carnobacterium* sp. 17-4 |
| SBP00129 | Frescatrano Olives | *Carnobacterium* sp. CP1 |
| SBP00129 | Frescatrano Olives | *Caulobacter flavus* |
| SBP00129 | Frescatrano Olives | *Caulobacter mirabilis* |
| SBP00129 | Frescatrano Olives | *Caulobacter segnis* |
| SBP00129 | Frescatrano Olives | *Caulobacter* sp. FWC26 |
| SBP00129 | Frescatrano Olives | *Caulobacter vibrioides* |
| SBP00129 | Frescatrano Olives | *Cedecea neteri* |
| SBP00129 | Frescatrano Olives | *Celeribacter baekdonensis* |
| SBP00129 | Frescatrano Olives | *Celeribacter ethanolicus* |
| SBP00129 | Frescatrano Olives | *Celeribacter indicus* |
| SBP00129 | Frescatrano Olives | *Celeribacter manganoxidans* |
| SBP00129 | Frescatrano Olives | *Cellulomonas flavigena* |
| SBP00129 | Frescatrano Olives | *Cellulophaga baltica* |
| SBP00129 | Frescatrano Olives | *Cellulosilyticum* sp. WCF-2 |
| SBP00129 | Frescatrano Olives | *Cellulosimicrobium cellulans* |
| SBP00129 | Frescatrano Olives | *Cellvibrio japonicus* |
| SBP00129 | Frescatrano Olives | *Chelativorans* sp. BNC1 |
| SBP00129 | Frescatrano Olives | *Chelatococcus* sp. CO-6 |
| SBP00129 | Frescatrano Olives | *Chlamydia caviae* |
| SBP00129 | Frescatrano Olives | *Chlamydia muridarum* |
| SBP00129 | Frescatrano Olives | *Chloroflexus aurantiacus* |
| SBP00129 | Frescatrano Olives | *Chondrocystis* sp. NIES-4102 |
| SBP00129 | Frescatrano Olives | *Christensenella minuta* |
| SBP00129 | Frescatrano Olives | *Chromobacterium vaccinii* |
| SBP00129 | Frescatrano Olives | *Chromohalobacter salexigens* |
| SBP00129 | Frescatrano Olives | *Chryseobacterium arthrosphaerae* |
| SBP00129 | Frescatrano Olives | *Chryseobacterium jeonii* |
| SBP00129 | Frescatrano Olives | *Chryseobacterium* sp. G0186 |
| SBP00129 | Frescatrano Olives | *Chryseolinea* sp. KIS68-18 |
| SBP00129 | Frescatrano Olives | *Citrobacter braakii* |
| SBP00129 | Frescatrano Olives | *Citrobacter freundii* |
| SBP00129 | Frescatrano Olives | *Citrobacter freundii* complex sp. CFNIH3 |
| SBP00129 | Frescatrano Olives | *Citrobacter koseri* |
| SBP00129 | Frescatrano Olives | *Citrobacter rodentium* |
| SBP00129 | Frescatrano Olives | *Citrobacter* sp. FDAARGOS_156 |
| SBP00129 | Frescatrano Olives | *Cloacibacterium normanense* |
| SBP00129 | Frescatrano Olives | *Clostridiaceae bacterium* 1450207 |
| SBP00129 | Frescatrano Olives | *Clostridioides difficile* |
| SBP00129 | Frescatrano Olives | *Clostridium aceticum* |
| SBP00129 | Frescatrano Olives | *Clostridium acetobutylicum* |
| SBP00129 | Frescatrano Olives | *Clostridium argentinense* |
| SBP00129 | Frescatrano Olives | *Clostridium baratii* |
| SBP00129 | Frescatrano Olives | *Clostridium beijerinckii* |
| SBP00129 | Frescatrano Olives | *Clostridium bornimense* |
| SBP00129 | Frescatrano Olives | *Clostridium botulinum* |
| SBP00129 | Frescatrano Olives | *Clostridium butyricum* |
| SBP00129 | Frescatrano Olives | *Clostridium carboxidivorans* |
| SBP00129 | Frescatrano Olives | *Clostridium cellulovorans* |
| SBP00129 | Frescatrano Olives | *Clostridium chauvoei* |
| SBP00129 | Frescatrano Olives | *Clostridium cochlearium* |
| SBP00129 | Frescatrano Olives | *Clostridium drakei* |
| SBP00129 | Frescatrano Olives | *Clostridium estertheticum* |
| SBP00129 | Frescatrano Olives | *Clostridium formicaceticum* |
| SBP00129 | Frescatrano Olives | *Clostridium isatidis* |
| SBP00129 | Frescatrano Olives | *Clostridium kluyveri* |
| SBP00129 | Frescatrano Olives | *Clostridium novyi* |
| SBP00129 | Frescatrano Olives | *Clostridium pasteurianum* |
| SBP00129 | Frescatrano Olives | *Clostridium perfringens* |
| SBP00129 | Frescatrano Olives | *Clostridium saccharoperbutylacetonicum* |
| SBP00129 | Frescatrano Olives | *Clostridium septicum* |
| SBP00129 | Frescatrano Olives | *Clostridium* sp. BNL1100 |
| SBP00129 | Frescatrano Olives | *Clostridium* sp. CT4 |
| SBP00129 | Frescatrano Olives | *Clostridium* sp. DL-VIJI |
| SBP00129 | Frescatrano Olives | *Clostridium* sp. SY8519 |
| SBP00129 | Frescatrano Olives | *Clostridium taeniosporum* |
| SBP00129 | Frescatrano Olives | *Clostridium tetani* |
| SBP00129 | Frescatrano Olives | *Clostridium tyrobutyricum* |
| SBP00129 | Frescatrano Olives | *Cohnella* sp. 18JY8-7 |
| SBP00129 | Frescatrano Olives | *Collimonas arenae* |
| SBP00129 | Frescatrano Olives | *Collimonas fungivorans* |
| SBP00129 | Frescatrano Olives | *Colwellia psychrerythraea* |
| SBP00129 | Frescatrano Olives | *Colwellia* sp. Arc7-D |

TABLE 3-continued

List of species identified in each metagenomic sample of each SBP Sample

| SBP ID | SBP Host Common Name | Genus sp. |
|---|---|---|
| SBP00129 | Frescatrano Olives | Colwellia sp. PAMC 21821 |
| SBP00129 | Frescatrano Olives | Comamonas aquatica |
| SBP00129 | Frescatrano Olives | Comamonas kerstersii |
| SBP00129 | Frescatrano Olives | Comamonas serinivorans |
| SBP00129 | Frescatrano Olives | Comamonas terrigena |
| SBP00129 | Frescatrano Olives | Comamonas testosteroni |
| SBP00129 | Frescatrano Olives | Confluentimicrobium sp. EMB200-NS6 |
| SBP00129 | Frescatrano Olives | Corynebacterium pelargi |
| SBP00129 | Frescatrano Olives | Corynebacterium xerosis |
| SBP00129 | Frescatrano Olives | Coxiella burnetii |
| SBP00129 | Frescatrano Olives | Crinalium epipsammum |
| SBP00129 | Frescatrano Olives | Croceicoccus marinus |
| SBP00129 | Frescatrano Olives | Cronobacter dublinensis |
| SBP00129 | Frescatrano Olives | Cronobacter sakazakii |
| SBP00129 | Frescatrano Olives | Cryobacterium sp. LW097 |
| SBP00129 | Frescatrano Olives | Cupriavidus basilensis |
| SBP00129 | Frescatrano Olives | Cupriavidus gilardii |
| SBP00129 | Frescatrano Olives | Cupriavidus metallidurans |
| SBP00129 | Frescatrano Olives | Cupriavidus nantongensis |
| SBP00129 | Frescatrano Olives | Cupriavidus necator |
| SBP00129 | Frescatrano Olives | Cupriavidus oxalaticus |
| SBP00129 | Frescatrano Olives | Cupriavidus pauculus |
| SBP00129 | Frescatrano Olives | Cupriavidus pinatubonensis |
| SBP00129 | Frescatrano Olives | Cupriavidus taiwanensis |
| SBP00129 | Frescatrano Olives | Curtobacterium pusillum |
| SBP00129 | Frescatrano Olives | Curvibacter sp. AEP1-3 |
| SBP00129 | Frescatrano Olives | Cutibacterium acnes |
| SBP00129 | Frescatrano Olives | Cyanobacterium aponinum |
| SBP00129 | Frescatrano Olives | Cyanothece sp. PCC 7424 |
| SBP00129 | Frescatrano Olives | Cyanothece sp. PCC 7425 |
| SBP00129 | Frescatrano Olives | Cyanothece sp. PCC 7822 |
| SBP00129 | Frescatrano Olives | Cyclobacterium amurskyense |
| SBP00129 | Frescatrano Olives | Cyclobacterium marinum |
| SBP00129 | Frescatrano Olives | Cystobacter fuscus |
| SBP00129 | Frescatrano Olives | Dactylococcopsis salina |
| SBP00129 | Frescatrano Olives | Dechloromonas sp. HYN0024 |
| SBP00129 | Frescatrano Olives | Deferribacter desulfuricans |
| SBP00129 | Frescatrano Olives | Defluviimonas alba |
| SBP00129 | Frescatrano Olives | Defluviitoga tunisiensis |
| SBP00129 | Frescatrano Olives | Delftia sp. |
| SBP00129 | Frescatrano Olives | Delftia sp. Cs1-4 |
| SBP00129 | Frescatrano Olives | Delftia tsuruhatensis |
| SBP00129 | Frescatrano Olives | Denitrovibrio acetiphilus |
| SBP00129 | Frescatrano Olives | Dermatophilus congolensis |
| SBP00129 | Frescatrano Olives | Desulfitobacterium hafniense |
| SBP00129 | Frescatrano Olives | Desulfobacter hydrogenophilus |
| SBP00129 | Frescatrano Olives | Desulfobacterium autotrophicum |
| SBP00129 | Frescatrano Olives | Desulfobacula toluolica |
| SBP00129 | Frescatrano Olives | Desulfocapsa sulfexigens |
| SBP00129 | Frescatrano Olives | Desulfococcus oleovorans |
| SBP00129 | Frescatrano Olives | Desulfosporosinus acidiphilus |
| SBP00129 | Frescatrano Olives | Desulfosporosinus meridiei |
| SBP00129 | Frescatrano Olives | Desulfosporosinus orientis |
| SBP00129 | Frescatrano Olives | Desulfotomaculum reducens |
| SBP00129 | Frescatrano Olives | Desulfotomaculum ruminis |
| SBP00129 | Frescatrano Olives | Desulfovibrio salexigens |
| SBP00129 | Frescatrano Olives | Desulfovibrio sp. FW1012B |
| SBP00129 | Frescatrano Olives | Devosia sp. A16 |
| SBP00129 | Frescatrano Olives | Devosia sp. H5989 |
| SBP00129 | Frescatrano Olives | Dialister sp. Marseille-P5638 |
| SBP00129 | Frescatrano Olives | Dickeya paradisiaca |
| SBP00129 | Frescatrano Olives | Dickeya sp. NCPPB 569 |
| SBP00129 | Frescatrano Olives | Dickeya zeae |
| SBP00129 | Frescatrano Olives | Dictyoglomus thermophilum |
| SBP00129 | Frescatrano Olives | Dinoroseobacter shibae |
| SBP00129 | Frescatrano Olives | Dokdonella koreensis |
| SBP00129 | Frescatrano Olives | Dyella japonica |
| SBP00129 | Frescatrano Olives | Echinicola strongylocentroti |
| SBP00129 | Frescatrano Olives | Edwardsiella tarda |
| SBP00129 | Frescatrano Olives | Egicoccus halophilus |
| SBP00129 | Frescatrano Olives | Endomicrobium proavitum |
| SBP00129 | Frescatrano Olives | endosymbiont 'TC1' of Trimyema compressum |
| SBP00129 | Frescatrano Olives | Endozoicomonas montiporae |
| SBP00129 | Frescatrano Olives | Enterobacter asburiae |
| SBP00129 | Frescatrano Olives | Enterobacter bugandensis |
| SBP00129 | Frescatrano Olives | Enterobacter cancerogenus |

TABLE 3-continued

List of species identified in each metagenomic sample of each SBP Sample

| SBP ID | SBP Host Common Name | Genus sp. |
|---|---|---|
| SBP00129 | Frescatrano Olives | *Enterobacter cloacae* |
| SBP00129 | Frescatrano Olives | *Enterobacter cloacae* complex sp. |
| SBP00129 | Frescatrano Olives | *Enterobacter hormaechei* |
| SBP00129 | Frescatrano Olives | *Enterobacter kobei* |
| SBP00129 | Frescatrano Olives | *Enterobacter ludwigii* |
| SBP00129 | Frescatrano Olives | *Enterobacter roggenkampii* |
| SBP00129 | Frescatrano Olives | *Enterobacter soli* |
| SBP00129 | Frescatrano Olives | *Enterobacter* sp. E20 |
| SBP00129 | Frescatrano Olives | *Enterobacter* sp. FY-07 |
| SBP00129 | Frescatrano Olives | *Enterobacteriaceae bacterium* strain FGI 57 |
| SBP00129 | Frescatrano Olives | *Enterococcus avium* |
| SBP00129 | Frescatrano Olives | *Enterococcus casseliflavus* |
| SBP00129 | Frescatrano Olives | *Enterococcus cecorum* |
| SBP00129 | Frescatrano Olives | *Enterococcus durans* |
| SBP00129 | Frescatrano Olives | *Enterococcus faecalis* |
| SBP00129 | Frescatrano Olives | *Enterococcus faecium* |
| SBP00129 | Frescatrano Olives | *Enterococcus gallinarum* |
| SBP00129 | Frescatrano Olives | *Enterococcus gilvus* |
| SBP00129 | Frescatrano Olives | *Enterococcus hirae* |
| SBP00129 | Frescatrano Olives | *Enterococcus mundtii* |
| SBP00129 | Frescatrano Olives | *Enterococcus* sp. CR-Ec1 |
| SBP00129 | Frescatrano Olives | *Enterococcus* sp. FDAARGOS_375 |
| SBP00129 | Frescatrano Olives | *Enterococcus* sp. FDAARGOS_553 |
| SBP00129 | Frescatrano Olives | *Enterococcus* sp. HSIEG1 |
| SBP00129 | Frescatrano Olives | *Enterococcus thailandicus* |
| SBP00129 | Frescatrano Olives | *Enterococcus wangshanyuanii* |
| SBP00129 | Frescatrano Olives | *Entomoplasma melaleucae* |
| SBP00129 | Frescatrano Olives | *Ereboglobus luteus* |
| SBP00129 | Frescatrano Olives | *Erysipelothrix larvae* |
| SBP00129 | Frescatrano Olives | *Erysipelothrix rhusiopathiae* |
| SBP00129 | Frescatrano Olives | *Erysipelothrix* sp. 15TAL0474 |
| SBP00129 | Frescatrano Olives | *Erysipelotrichaceae bacterium* GAM147 |
| SBP00129 | Frescatrano Olives | *Erysipelotrichaceae bacterium* SG0102 |
| SBP00129 | Frescatrano Olives | *Erythrobacter flavus* |
| SBP00129 | Frescatrano Olives | *Escherichia albertii* |
| SBP00129 | Frescatrano Olives | *Escherichia coli* |
| SBP00129 | Frescatrano Olives | *Eubacterium limosum* |
| SBP00129 | Frescatrano Olives | *Eubacterium maltosivorans* |
| SBP00129 | Frescatrano Olives | *Exiguobacterium antarcticum* |
| SBP00129 | Frescatrano Olives | *Exiguobacterium mexicanum* |
| SBP00129 | Frescatrano Olives | *Exiguobacterium sibiricum* |
| SBP00129 | Frescatrano Olives | *Exiguobacterium* sp. AT1b |
| SBP00129 | Frescatrano Olives | *Exiguobacterium* sp. MH3 |
| SBP00129 | Frescatrano Olives | *Exiguobacterium* sp. N4-1P |
| SBP00129 | Frescatrano Olives | *Ezakiella massiliensis* |
| SBP00129 | Frescatrano Olives | *Faecalibaculum rodentium* |
| SBP00129 | Frescatrano Olives | *Faecalitalea cylindroides* |
| SBP00129 | Frescatrano Olives | *Fastidiosipila sanguinis* |
| SBP00129 | Frescatrano Olives | *Fermentimonas caenicola* |
| SBP00129 | Frescatrano Olives | *Fictibacillus arsenicus* |
| SBP00129 | Frescatrano Olives | *Fictibacillus phosphorivorans* |
| SBP00129 | Frescatrano Olives | *Filifactor alocis* |
| SBP00129 | Frescatrano Olives | *Finegoldia magna* |
| SBP00129 | Frescatrano Olives | *Flammeovirga* sp. L12M1 |
| SBP00129 | Frescatrano Olives | *Flammeovirgaceae bacterium* 311 |
| SBP00129 | Frescatrano Olives | *Flavobacterium anhuiense* |
| SBP00129 | Frescatrano Olives | *Flavobacterium columnare* |
| SBP00129 | Frescatrano Olives | *Flavobacterium crocinum* |
| SBP00129 | Frescatrano Olives | *Flavobacterium gilvum* |
| SBP00129 | Frescatrano Olives | *Flavobacterium* sp. CJ74 |
| SBP00129 | Frescatrano Olives | *Formosa agariphila* |
| SBP00129 | Frescatrano Olives | *Francisella noatunensis* |
| SBP00129 | Frescatrano Olives | *Francisella* sp. FDC440 |
| SBP00129 | Frescatrano Olives | *Frateuria aurantia* |
| SBP00129 | Frescatrano Olives | *Fusobacterium gonidiaformans* |
| SBP00129 | Frescatrano Olives | *Fusobacterium hwasookii* |
| SBP00129 | Frescatrano Olives | *Fusobacterium necrophorum* |
| SBP00129 | Frescatrano Olives | *Fusobacterium nucleatum* |
| SBP00129 | Frescatrano Olives | *Fusobacterium ulcerans* |
| SBP00129 | Frescatrano Olives | *Fusobacterium varium* |
| SBP00129 | Frescatrano Olives | *Gallibacterium anatis* |
| SBP00129 | Frescatrano Olives | *Gammaproteobacteria bacterium* DM2 |
| SBP00129 | Frescatrano Olives | *Gardnerella vaginalis* |
| SBP00129 | Frescatrano Olives | *Gemella haemolysans* |
| SBP00129 | Frescatrano Olives | *Gemella morbillorum* |
| SBP00129 | Frescatrano Olives | *Geminocystis* sp. NIES-3708 |

TABLE 3-continued

List of species identified in each metagenomic sample of each SBP Sample

| SBP ID | SBP Host Common Name | Genus sp. |
|---|---|---|
| SBP00129 | Frescatrano Olives | *Geobacillus* genomosp. 3 |
| SBP00129 | Frescatrano Olives | *Geobacillus* sp. GHH01 |
| SBP00129 | Frescatrano Olives | *Geobacillus* sp. WCH70 |
| SBP00129 | Frescatrano Olives | *Geobacillus stearothermophilus* |
| SBP00129 | Frescatrano Olives | *Geobacillus subterraneus* |
| SBP00129 | Frescatrano Olives | *Geobacillus thermocatenulatus* |
| SBP00129 | Frescatrano Olives | *Geodermatophilus obscurus* |
| SBP00129 | Frescatrano Olives | *Geosporobacter ferrireducens* |
| SBP00129 | Frescatrano Olives | *Gibbsiella quercinecans* |
| SBP00129 | Frescatrano Olives | *Gilliamella apicola* |
| SBP00129 | Frescatrano Olives | *Gloeocapsa* sp. PCC 7428 |
| SBP00129 | Frescatrano Olives | *Gottschalkia acidurici* |
| SBP00129 | Frescatrano Olives | *Gramella forsetii* |
| SBP00129 | Frescatrano Olives | *Gramella salexigens* |
| SBP00129 | Frescatrano Olives | *Gramella* sp. SH35 |
| SBP00129 | Frescatrano Olives | *Haematobacter massiliensis* |
| SBP00129 | Frescatrano Olives | *Haemophilus influenzae* |
| SBP00129 | Frescatrano Olives | *Halanaerobium hydrogeniformans* |
| SBP00129 | Frescatrano Olives | *Halanaerobium praevalens* |
| SBP00129 | Frescatrano Olives | *Haloarcula taiwanensis* |
| SBP00129 | Frescatrano Olives | *Halobacillus halophilus* |
| SBP00129 | Frescatrano Olives | *Halobacillus litoralis* |
| SBP00129 | Frescatrano Olives | *Halobacillus mangrovi* |
| SBP00129 | Frescatrano Olives | *Halobacteroides halobius* |
| SBP00129 | Frescatrano Olives | *Halocella* sp. SP3-1 |
| SBP00129 | Frescatrano Olives | *Halocynthiibacter arcticus* |
| SBP00129 | Frescatrano Olives | *Halomonas alkaliphila* |
| SBP00129 | Frescatrano Olives | *Halomonas huangheensis* |
| SBP00129 | Frescatrano Olives | *Halomonas hydrothermalis* |
| SBP00129 | Frescatrano Olives | *Halomonas* sp. 1513 |
| SBP00129 | Frescatrano Olives | *Halomonas* sp. GFAJ-1 |
| SBP00129 | Frescatrano Olives | *Halomonas* sp. hl-4 |
| SBP00129 | Frescatrano Olives | *Halomonas* sp. JS92-SW72 |
| SBP00129 | Frescatrano Olives | *Halomonas* sp. SF2003 |
| SBP00129 | Frescatrano Olives | *Halomonas subglaciescola* |
| SBP00129 | Frescatrano Olives | *Haloplanus* sp. CBA1112 |
| SBP00129 | Frescatrano Olives | *Halorhodospira halophila* |
| SBP00129 | Frescatrano Olives | *Halothermothrix orenii* |
| SBP00129 | Frescatrano Olives | *Hathewaya histolytica* |
| SBP00129 | Frescatrano Olives | *Helicobacter cinaedi* |
| SBP00129 | Frescatrano Olives | *Helicobacter pylori* |
| SBP00129 | Frescatrano Olives | *Heliobacterium modesticaldum* |
| SBP00129 | Frescatrano Olives | *Herbaspirillum huttiense* |
| SBP00129 | Frescatrano Olives | *Herbaspirillum rubrisubalbicans* |
| SBP00129 | Frescatrano Olives | *Herbinix luporum* |
| SBP00129 | Frescatrano Olives | *Hungateiclostridium clariflavum* |
| SBP00129 | Frescatrano Olives | *Hungateiclostridium thermocellum* |
| SBP00129 | Frescatrano Olives | *Hungatella hathewayi* |
| SBP00129 | Frescatrano Olives | *Hydrogenophaga crassostreae* |
| SBP00129 | Frescatrano Olives | *Hydrogenophaga pseudoflava* |
| SBP00129 | Frescatrano Olives | *Hydrogenophaga* sp. PBC |
| SBP00129 | Frescatrano Olives | *Hydrogenophaga* sp. RAC07 |
| SBP00129 | Frescatrano Olives | *Hydrogenovibrio crunogenus* |
| SBP00129 | Frescatrano Olives | *Hylemonella gracilis* |
| SBP00129 | Frescatrano Olives | *Hyphomicrobium nitrativorans* |
| SBP00129 | Frescatrano Olives | *Ignavibacterium album* |
| SBP00129 | Frescatrano Olives | *Inhella inkyongensis* |
| SBP00129 | Frescatrano Olives | *Janthinobacterium agaricidamnosum* |
| SBP00129 | Frescatrano Olives | *Janthinobacterium* sp. B9-8 |
| SBP00129 | Frescatrano Olives | *Janthinobacterium svalbardensis* |
| SBP00129 | Frescatrano Olives | *Jeangeupia* sp. USM3 |
| SBP00129 | Frescatrano Olives | *Jeotgalibaca dankookensis* |
| SBP00129 | Frescatrano Olives | *Jeotgalibaca* sp. H21T32 |
| SBP00129 | Frescatrano Olives | *Jeotgalibaca* sp. PTS2502 |
| SBP00129 | Frescatrano Olives | *Jeotgalibacillus malaysiensis* |
| SBP00129 | Frescatrano Olives | *Jeotgalicoccus saudimassiliensis* |
| SBP00129 | Frescatrano Olives | *Jiangella alkaliphila* |
| SBP00129 | Frescatrano Olives | *Ketogulonicigenium robustum* |
| SBP00129 | Frescatrano Olives | *Ketogulonicigenium vulgare* |
| SBP00129 | Frescatrano Olives | *Klebsiella aerogenes* |
| SBP00129 | Frescatrano Olives | *Klebsiella michiganensis* |
| SBP00129 | Frescatrano Olives | *Klebsiella oxytoca* |
| SBP00129 | Frescatrano Olives | *Klebsiella pneumoniae* |
| SBP00129 | Frescatrano Olives | *Klebsiella variicola* |
| SBP00129 | Frescatrano Olives | *Kluyvera intermedia* |
| SBP00129 | Frescatrano Olives | *Kocuria rosea* |

TABLE 3-continued

List of species identified in each metagenomic sample of each SBP Sample

| SBP ID | SBP Host Common Name | Genus sp. |
|---|---|---|
| SBP00129 | Frescatrano Olives | *Kosakonia cowanii* |
| SBP00129 | Frescatrano Olives | *Kozakia baliensis* |
| SBP00129 | Frescatrano Olives | *Kurthia* sp. 11kri321 |
| SBP00129 | Frescatrano Olives | *Kurthia zopfii* |
| SBP00129 | Frescatrano Olives | *Kushneria konosiri* |
| SBP00129 | Frescatrano Olives | *Kyrpidia spormannii* |
| SBP00129 | Frescatrano Olives | *Laceyella sacchari* |
| SBP00129 | Frescatrano Olives | *Lachnoclostridium phytofermentans* |
| SBP00129 | Frescatrano Olives | *Lachnoclostridium* sp. YL32 |
| SBP00129 | Frescatrano Olives | *Lachnospiraceae bacterium* Choco86 |
| SBP00129 | Frescatrano Olives | *Lachnospiraceae bacterium* GAM79 |
| SBP00129 | Frescatrano Olives | *Lacinutrix* sp. 5H-3-7-4 |
| SBP00129 | Frescatrano Olives | *Lacinutrix* sp. Bg11-31 |
| SBP00129 | Frescatrano Olives | *Lactobacillus acetotolerans* |
| SBP00129 | Frescatrano Olives | *Lactobacillus acidipiscis* |
| SBP00129 | Frescatrano Olives | *Lactobacillus acidophilus* |
| SBP00129 | Frescatrano Olives | *Lactobacillus agilis* |
| SBP00129 | Frescatrano Olives | *Lactobacillus alimentarius* |
| SBP00129 | Frescatrano Olives | *Lactobacillus allii* |
| SBP00129 | Frescatrano Olives | *Lactobacillus amylolyticus* |
| SBP00129 | Frescatrano Olives | *Lactobacillus amylophilus* |
| SBP00129 | Frescatrano Olives | *Lactobacillus amylovorus* |
| SBP00129 | Frescatrano Olives | *Lactobacillus animalis* |
| SBP00129 | Frescatrano Olives | *Lactobacillus apis* |
| SBP00129 | Frescatrano Olives | *Lactobacillus backii* |
| SBP00129 | Frescatrano Olives | *Lactobacillus bombi* |
| SBP00129 | Frescatrano Olives | *Lactobacillus brevis* |
| SBP00129 | Frescatrano Olives | *Lactobacillus buchneri* |
| SBP00129 | Frescatrano Olives | *Lactobacillus casei* |
| SBP00129 | Frescatrano Olives | *Lactobacillus coryniformis* |
| SBP00129 | Frescatrano Olives | *Lactobacillus crustorum* |
| SBP00129 | Frescatrano Olives | *Lactobacillus curieae* |
| SBP00129 | Frescatrano Olives | *Lactobacillus curvatus* |
| SBP00129 | Frescatrano Olives | *Lactobacillus delbrueckii* |
| SBP00129 | Frescatrano Olives | *Lactobacillus farciminis* |
| SBP00129 | Frescatrano Olives | *Lactobacillus fermentum* |
| SBP00129 | Frescatrano Olives | *Lactobacillus fuchuensis* |
| SBP00129 | Frescatrano Olives | *Lactobacillus gasseri* |
| SBP00129 | Frescatrano Olives | *Lactobacillus ginsenosidimutans* |
| SBP00129 | Frescatrano Olives | *Lactobacillus heilongjiangensis* |
| SBP00129 | Frescatrano Olives | *Lactobacillus helsingborgensis* |
| SBP00129 | Frescatrano Olives | *Lactobacillus helveticus* |
| SBP00129 | Frescatrano Olives | *Lactobacillus hokkaidonensis* |
| SBP00129 | Frescatrano Olives | *Lactobacillus hordei* |
| SBP00129 | Frescatrano Olives | *Lactobacillus jensenii* |
| SBP00129 | Frescatrano Olives | *Lactobacillus johnsonii* |
| SBP00129 | Frescatrano Olives | *Lactobacillus kefiranofaciens* |
| SBP00129 | Frescatrano Olives | *Lactobacillus koreensis* |
| SBP00129 | Frescatrano Olives | *Lactobacillus kullabergensis* |
| SBP00129 | Frescatrano Olives | *Lactobacillus kunkeei* |
| SBP00129 | Frescatrano Olives | *Lactobacillus lindneri* |
| SBP00129 | Frescatrano Olives | *Lactobacillus mucosae* |
| SBP00129 | Frescatrano Olives | *Lactobacillus murinus* |
| SBP00129 | Frescatrano Olives | *Lactobacillus oligofermentans* |
| SBP00129 | Frescatrano Olives | *Lactobacillus parabuchneri* |
| SBP00129 | Frescatrano Olives | *Lactobacillus paracasei* |
| SBP00129 | Frescatrano Olives | *Lactobacillus paracollinoides* |
| SBP00129 | Frescatrano Olives | *Lactobacillus paraplantarum* |
| SBP00129 | Frescatrano Olives | *Lactobacillus pentosus* |
| SBP00129 | Frescatrano Olives | *Lactobacillus plantarum* |
| SBP00129 | Frescatrano Olives | *Lactobacillus reuteri* |
| SBP00129 | Frescatrano Olives | *Lactobacillus rhamnosus* |
| SBP00129 | Frescatrano Olives | *Lactobacillus ruminis* |
| SBP00129 | Frescatrano Olives | *Lactobacillus sakei* |
| SBP00129 | Frescatrano Olives | *Lactobacillus salivarius* |
| SBP00129 | Frescatrano Olives | *Lactobacillus sanfranciscensis* |
| SBP00129 | Frescatrano Olives | *Lactobacillus* sp. BHWM-4 |
| SBP00129 | Frescatrano Olives | *Lactobacillus* sp. CBA3605 |
| SBP00129 | Frescatrano Olives | *Lactobacillus* sp. CBA3606 |
| SBP00129 | Frescatrano Olives | *Lactobacillus* sp. HBUAS52074 |
| SBP00129 | Frescatrano Olives | *Lactobacillus* sp. HSLZ-75 |
| SBP00129 | Frescatrano Olives | *Lactobacillus* sp. wk88 |
| SBP00129 | Frescatrano Olives | *Lactobacillus terrae* |
| SBP00129 | Frescatrano Olives | *Lactococcus garvieae* |
| SBP00129 | Frescatrano Olives | *Lactococcus lactis* |
| SBP00129 | Frescatrano Olives | *Lactococcus piscium* |

TABLE 3-continued

List of species identified in each metagenomic sample of each SBP Sample

| SBP ID | SBP Host Common Name | Genus sp. |
| --- | --- | --- |
| SBP00129 | Frescatrano Olives | *Lactococcus raffinolactis* |
| SBP00129 | Frescatrano Olives | *Lactococcus* sp. 1JSPR-7 |
| SBP00129 | Frescatrano Olives | *Leclercia adecarboxylata* |
| SBP00129 | Frescatrano Olives | *Legionella geestiana* |
| SBP00129 | Frescatrano Olives | *Legionella jordanis* |
| SBP00129 | Frescatrano Olives | *Legionella lansingensis* |
| SBP00129 | Frescatrano Olives | *Legionella pneumophila* |
| SBP00129 | Frescatrano Olives | *Legionella sainthelensi* |
| SBP00129 | Frescatrano Olives | *Legionella spiritensis* |
| SBP00129 | Frescatrano Olives | *Leifsonia xyli* |
| SBP00129 | Frescatrano Olives | *Leisingera aquaemixtae* |
| SBP00129 | Frescatrano Olives | *Leisingera methylohalidivorans* |
| SBP00129 | Frescatrano Olives | *Lelliottia amnigena* |
| SBP00129 | Frescatrano Olives | *Lelliottia jeotgali* |
| SBP00129 | Frescatrano Olives | *Lelliottia* sp. WB101 |
| SBP00129 | Frescatrano Olives | *Leminorella richardii* |
| SBP00129 | Frescatrano Olives | *Lentibacillus amyloliquefaciens* |
| SBP00129 | Frescatrano Olives | *Lentzea guizhouensis* |
| SBP00129 | Frescatrano Olives | *Leptospira biflexa* |
| SBP00129 | Frescatrano Olives | *Leptospirillum ferriphilum* |
| SBP00129 | Frescatrano Olives | *Leptospirillum ferrooxidans* |
| SBP00129 | Frescatrano Olives | *Leptothrix cholodnii* |
| SBP00129 | Frescatrano Olives | *Leptotrichia* sp. oral taxon 212 |
| SBP00129 | Frescatrano Olives | *Leucobacter triazinivorans* |
| SBP00129 | Frescatrano Olives | *Leuconostoc carnosum* |
| SBP00129 | Frescatrano Olives | *Leuconostoc citreum* |
| SBP00129 | Frescatrano Olives | *Leuconostoc garlicum* |
| SBP00129 | Frescatrano Olives | *Leuconostoc gelidum* |
| SBP00129 | Frescatrano Olives | *Leuconostoc lactis* |
| SBP00129 | Frescatrano Olives | *Leuconostoc mesenteroides* |
| SBP00129 | Frescatrano Olives | *Leuconostoc suionicum* |
| SBP00129 | Frescatrano Olives | *Limnohabitans* sp. 103DPR2 |
| SBP00129 | Frescatrano Olives | *Listeria gravi* |
| SBP00129 | Frescatrano Olives | *Listeria innocua* |
| SBP00129 | Frescatrano Olives | *Listeria ivanovii* |
| SBP00129 | Frescatrano Olives | *Listeria monocytogenes* |
| SBP00129 | Frescatrano Olives | *Listeria seeligeri* |
| SBP00129 | Frescatrano Olives | *Listeria welshimeri* |
| SBP00129 | Frescatrano Olives | *Lonsdalea britannica* |
| SBP00129 | Frescatrano Olives | *Luteimonas* sp. 83-4 |
| SBP00129 | Frescatrano Olives | *Lutibacter profundi* |
| SBP00129 | Frescatrano Olives | *Lutibacter* sp. LPB0138 |
| SBP00129 | Frescatrano Olives | *Lysinibacillus* sp. 2017 |
| SBP00129 | Frescatrano Olives | *Lysinibacillus* sp. Marseille-P5727 |
| SBP00129 | Frescatrano Olives | *Lysinibacillus* sp. SGAir0095 |
| SBP00129 | Frescatrano Olives | *Lysinibacillus* sp. YS11 |
| SBP00129 | Frescatrano Olives | *Lysinibacillus sphaericus* |
| SBP00129 | Frescatrano Olives | *Lysinibacillus varians* |
| SBP00129 | Frescatrano Olives | *Lysobacter antibioticus* |
| SBP00129 | Frescatrano Olives | *Lysobacter capsici* |
| SBP00129 | Frescatrano Olives | *Lysobacter maris* |
| SBP00129 | Frescatrano Olives | *Macrococcus canis* |
| SBP00129 | Frescatrano Olives | *Macrococcus caseolyticus* |
| SBP00129 | Frescatrano Olives | *Macrococcus* sp. IME1552 |
| SBP00129 | Frescatrano Olives | *Mageeibacillus indolicus* |
| SBP00129 | Frescatrano Olives | *Mannheimia haemolytica* |
| SBP00129 | Frescatrano Olives | *Maribacter* sp. HTCC2170 |
| SBP00129 | Frescatrano Olives | *Maribacter* sp. T28 |
| SBP00129 | Frescatrano Olives | *Marinilactibacillus* sp. 15R |
| SBP00129 | Frescatrano Olives | *Marinobacter psychrophilus* |
| SBP00129 | Frescatrano Olives | *Marinobacter* sp. LV10R510-11A |
| SBP00129 | Frescatrano Olives | *Marinobacter* sp. NP-4(2019) |
| SBP00129 | Frescatrano Olives | *Marinomonas posidonica* |
| SBP00129 | Frescatrano Olives | *Marinomonas* sp. MWYL1 |
| SBP00129 | Frescatrano Olives | *Marinovum algicola* |
| SBP00129 | Frescatrano Olives | *Mariprofundus aestuarium* |
| SBP00129 | Frescatrano Olives | *Maritalea myrionectae* |
| SBP00129 | Frescatrano Olives | *Martelella endophytica* |
| SBP00129 | Frescatrano Olives | *Martelella mediterranea* |
| SBP00129 | Frescatrano Olives | *Martelella* sp. AD-3 |
| SBP00129 | Frescatrano Olives | *Massilia albidiflava* |
| SBP00129 | Frescatrano Olives | *Massilia putida* |
| SBP00129 | Frescatrano Olives | *Massilia* sp. NR 4-1 |
| SBP00129 | Frescatrano Olives | *Massilia* sp. WG5 |
| SBP00129 | Frescatrano Olives | *Massilia umbonata* |
| SBP00129 | Frescatrano Olives | *Massilia violaceinigra* |

TABLE 3-continued

List of species identified in each metagenomic sample of each SBP Sample

| SBP ID | SBP Host Common Name | Genus sp. |
|---|---|---|
| SBP00129 | Frescatrano Olives | *Megamonas hypermegale* |
| SBP00129 | Frescatrano Olives | *Megasphaera elsdenii* |
| SBP00129 | Frescatrano Olives | *Megasphaera hexanoica* |
| SBP00129 | Frescatrano Olives | *Megasphaera stantonii* |
| SBP00129 | Frescatrano Olives | *Melaminivora* sp. SC2-7 |
| SBP00129 | Frescatrano Olives | *Melaminivora* sp. SC2-9 |
| SBP00129 | Frescatrano Olives | *Melissococcus plutonius* |
| SBP00129 | Frescatrano Olives | *Mesoplasma florum* |
| SBP00129 | Frescatrano Olives | *Mesoplasma lactucae* |
| SBP00129 | Frescatrano Olives | *Mesoplasma syrphidae* |
| SBP00129 | Frescatrano Olives | *Mesorhizobium amorphae* |
| SBP00129 | Frescatrano Olives | *Mesorhizobium ciceri* |
| SBP00129 | Frescatrano Olives | *Mesorhizobium japonicum* |
| SBP00129 | Frescatrano Olives | *Mesorhizobium loti* |
| SBP00129 | Frescatrano Olives | *Mesorhizobium opportunistum* |
| SBP00129 | Frescatrano Olives | *Mesorhizobium* sp. DCY119 |
| SBP00129 | Frescatrano Olives | *Mesorhizobium* sp. M1B.F.Ca.ET.045.04.1.1 |
| SBP00129 | Frescatrano Olives | *Mesorhizobium* sp. M1E.F.Ca.ET.045.02.1.1 |
| SBP00129 | Frescatrano Olives | *Mesorhizobium* sp. M3A.F.Ca.ET.080.04.2.1 |
| SBP00129 | Frescatrano Olives | *Mesorhizobium* sp. M6A.T.Cr.TU.016.01.1.1 |
| SBP00129 | Frescatrano Olives | *Mesorhizobium* sp. M7A.F.Ce.TU.012.03.2.1 |
| SBP00129 | Frescatrano Olives | *Mesorhizobium* sp. M7D.F.Ca.US.005.01.1.1 |
| SBP00129 | Frescatrano Olives | *Mesotoga prima* |
| SBP00129 | Frescatrano Olives | *Methanobacterium congolense* |
| SBP00129 | Frescatrano Olives | *Methanocaldococcus infernus* |
| SBP00129 | Frescatrano Olives | *Methanocaldococcus jannaschii* |
| SBP00129 | Frescatrano Olives | *Methanococcus aeolicus* |
| SBP00129 | Frescatrano Olives | *Methanococcus maripaludis* |
| SBP00129 | Frescatrano Olives | *Methanococcus voltae* |
| SBP00129 | Frescatrano Olives | *Methanosarcina barkeri* |
| SBP00129 | Frescatrano Olives | *Methylibium petroleiphilum* |
| SBP00129 | Frescatrano Olives | *Methylobacillus flagellatus* |
| SBP00129 | Frescatrano Olives | *Methylobacterium aquaticum* |
| SBP00129 | Frescatrano Olives | *Methylobacterium brachiatum* |
| SBP00129 | Frescatrano Olives | *Methylobacterium currus* |
| SBP00129 | Frescatrano Olives | *Methylobacterium nodulans* |
| SBP00129 | Frescatrano Olives | *Methylobacterium phyllosphaerae* |
| SBP00129 | Frescatrano Olives | *Methylobacterium radiotolerans* |
| SBP00129 | Frescatrano Olives | *Methylobacterium* sp. 175D2-17 |
| SBP00129 | Frescatrano Olives | *Methylobacterium* sp. 17Sr1-1 |
| SBP00129 | Frescatrano Olives | *Methylobacterium* sp. 17Sr1-28 |
| SBP00129 | Frescatrano Olives | *Methylobacterium* sp. 17Sr1-43 |
| SBP00129 | Frescatrano Olives | *Methylobacterium* sp. 4-46 |
| SBP00129 | Frescatrano Olives | *Methylobacterium* sp. C1 |
| SBP00129 | Frescatrano Olives | *Methylobacterium* sp. DM1 |
| SBP00129 | Frescatrano Olives | *Methylobacterium* sp. XJLW |
| SBP00129 | Frescatrano Olives | *Methylocystis bryophila* |
| SBP00129 | Frescatrano Olives | *Methylomicrobium album* |
| SBP00129 | Frescatrano Olives | *Methylomicrobium* sp. wino1 |
| SBP00129 | Frescatrano Olives | *Methylophilus* sp. TWE2 |
| SBP00129 | Frescatrano Olives | *Methylorubrum extorquens* |
| SBP00129 | Frescatrano Olives | *Methylorubrum populi* |
| SBP00129 | Frescatrano Olives | *Methylosinus trichosporium* |
| SBP00129 | Frescatrano Olives | *Methyloversatilis* sp. RAC08 |
| SBP00129 | Frescatrano Olives | *Micavibrio aeruginosavorus* |
| SBP00129 | Frescatrano Olives | *Microbacterium oxydans* |
| SBP00129 | Frescatrano Olives | *Microbulbifer thermotolerans* |
| SBP00129 | Frescatrano Olives | *Micrococcus luteus* |
| SBP00129 | Frescatrano Olives | *Microvirga ossetica* |
| SBP00129 | Frescatrano Olives | *Microvirga* sp. 17 mud 1-3 |
| SBP00129 | Frescatrano Olives | *Microvirgula aerodenitrificans* |
| SBP00129 | Frescatrano Olives | *Mitsuaria* sp. 7 |
| SBP00129 | Frescatrano Olives | *Mixta gaviniae* |
| SBP00129 | Frescatrano Olives | *Modestobacter marinus* |
| SBP00129 | Frescatrano Olives | *Moorea producens* |
| SBP00129 | Frescatrano Olives | *Moraxella cuniculi* |
| SBP00129 | Frescatrano Olives | *Moraxella osloensis* |
| SBP00129 | Frescatrano Olives | *Mordavella* sp. Marseille-P3756 |
| SBP00129 | Frescatrano Olives | *Morganella morganii* |
| SBP00129 | Frescatrano Olives | *Moritella yayanosii* |
| SBP00129 | Frescatrano Olives | *Mycobacterium* sp. MS1601 |
| SBP00129 | Frescatrano Olives | *Mycolicibacterium gilvum* |
| SBP00129 | Frescatrano Olives | *Mycolicibacterium hassiacum* |
| SBP00129 | Frescatrano Olives | *Mycoplasma bovis* |
| SBP00129 | Frescatrano Olives | *Mycoplasma canis* |
| SBP00129 | Frescatrano Olives | *Mycoplasma cloacale* |

TABLE 3-continued

List of species identified in each metagenomic sample of each SBP Sample

| SBP ID | SBP Host Common Name | Genus sp. |
| --- | --- | --- |
| SBP00129 | Frescatrano Olives | *Mycoplasma iowae* |
| SBP00129 | Frescatrano Olives | *Mycoplasma penetrans* |
| SBP00129 | Frescatrano Olives | *Mycoplasma pneumoniae* |
| SBP00129 | Frescatrano Olives | *Mycoplasma pullorum* |
| SBP00129 | Frescatrano Olives | *Mycoplasma synoviae* |
| SBP00129 | Frescatrano Olives | *Myroides odoratus* |
| SBP00129 | Frescatrano Olives | *Myroides profundi* |
| SBP00129 | Frescatrano Olives | *Myxococcus stipitatus* |
| SBP00129 | Frescatrano Olives | *Myxococcus xanthus* |
| SBP00129 | Frescatrano Olives | *Natrialba magadii* |
| SBP00129 | Frescatrano Olives | *Neorhizobium galegae* |
| SBP00129 | Frescatrano Olives | *Neorhizobium* sp. NCHU2750 |
| SBP00129 | Frescatrano Olives | *Neorhizobium* sp. SOG26 |
| SBP00129 | Frescatrano Olives | *Nitrobacter hamburgensis* |
| SBP00129 | Frescatrano Olives | *Nitrobacter winogradskyi* |
| SBP00129 | Frescatrano Olives | *Nitrosomonas* sp. Is79A3 |
| SBP00129 | Frescatrano Olives | *Nitrosomonas ureae* |
| SBP00129 | Frescatrano Olives | *Nitrospirillum amazonense* |
| SBP00129 | Frescatrano Olives | *Nocardia brasiliensis* |
| SBP00129 | Frescatrano Olives | *Nonlabens spongiae* |
| SBP00129 | Frescatrano Olives | *Nostoc flagelliforme* |
| SBP00129 | Frescatrano Olives | *Nostoc piscinale* |
| SBP00129 | Frescatrano Olives | *Nostoc* sp. NIES-4103 |
| SBP00129 | Frescatrano Olives | *Nostoc* sp. PCC 7524 |
| SBP00129 | Frescatrano Olives | *Novibacillus thermophilus* |
| SBP00129 | Frescatrano Olives | *Novosphingobium aromaticivorans* |
| SBP00129 | Frescatrano Olives | *Novosphingobium resinovorum* |
| SBP00129 | Frescatrano Olives | *Oceanobacillus iheyensis* |
| SBP00129 | Frescatrano Olives | *Oceanobacillus kimchii* |
| SBP00129 | Frescatrano Olives | *Oceanobacillus* sp. 160 |
| SBP00129 | Frescatrano Olives | *Ochrobactrum* sp. A44 |
| SBP00129 | Frescatrano Olives | *Oenococcus kitaharae* |
| SBP00129 | Frescatrano Olives | *Oenococcus oeni* |
| SBP00129 | Frescatrano Olives | *Oenococcus sicerae* |
| SBP00129 | Frescatrano Olives | *Oenococcus* sp. UCMA 16435 |
| SBP00129 | Frescatrano Olives | *Oleiphilus messinensis* |
| SBP00129 | Frescatrano Olives | *Oleispira antarctica* |
| SBP00129 | Frescatrano Olives | *Oligotropha carboxidovorans* |
| SBP00129 | Frescatrano Olives | *Olsenella* sp. Marseille-P2300 |
| SBP00129 | Frescatrano Olives | *Opitutus terrae* |
| SBP00129 | Frescatrano Olives | *Orientia tsutsugamushi* |
| SBP00129 | Frescatrano Olives | *Ornithobacterium rhinotracheale* |
| SBP00129 | Frescatrano Olives | *Orrella dioscoreae* |
| SBP00129 | Frescatrano Olives | *Ottowia oryzae* |
| SBP00129 | Frescatrano Olives | *Oxalobacter formigenes* |
| SBP00129 | Frescatrano Olives | *Paenibacillaceae bacterium* GAS479 |
| SBP00129 | Frescatrano Olives | *Paenibacillus alvei* |
| SBP00129 | Frescatrano Olives | *Paenibacillus baekrokdamisoli* |
| SBP00129 | Frescatrano Olives | *Paenibacillus beijingensis* |
| SBP00129 | Frescatrano Olives | *Paenibacillus borealis* |
| SBP00129 | Frescatrano Olives | *Paenibacillus bovis* |
| SBP00129 | Frescatrano Olives | *Paenibacillus chitinolyticus* |
| SBP00129 | Frescatrano Olives | *Paenibacillus crassostreae* |
| SBP00129 | Frescatrano Olives | *Paenibacillus donghaensis* |
| SBP00129 | Frescatrano Olives | *Paenibacillus durus* |
| SBP00129 | Frescatrano Olives | *Paenibacillus glucanolyticus* |
| SBP00129 | Frescatrano Olives | *Paenibacillus graminis* |
| SBP00129 | Frescatrano Olives | *Paenibacillus ihbetae* |
| SBP00129 | Frescatrano Olives | *Paenibacillus kribbensis* |
| SBP00129 | Frescatrano Olives | *Paenibacillus larvae* |
| SBP00129 | Frescatrano Olives | *Paenibacillus lentus* |
| SBP00129 | Frescatrano Olives | *Paenibacillus mucilaginosus* |
| SBP00129 | Frescatrano Olives | *Paenibacillus naphthalenovorans* |
| SBP00129 | Frescatrano Olives | *Paenibacillus odorifer* |
| SBP00129 | Frescatrano Olives | *Paenibacillus physcomitrellae* |
| SBP00129 | Frescatrano Olives | *Paenibacillus polymyxa* |
| SBP00129 | Frescatrano Olives | *Paenibacillus riograndensis* |
| SBP00129 | Frescatrano Olives | *Paenibacillus sabinae* |
| SBP00129 | Frescatrano Olives | *Paenibacillus* sp. 32O-W |
| SBP00129 | Frescatrano Olives | *Paenibacillus* sp. BIHB4019 |
| SBP00129 | Frescatrano Olives | *Paenibacillus* sp. CAA11 |
| SBP00129 | Frescatrano Olives | *Paenibacillus* sp. DCT19 |
| SBP00129 | Frescatrano Olives | *Paenibacillus* sp. FSL H7-0357 |
| SBP00129 | Frescatrano Olives | *Paenibacillus* sp. FSL H7-0737 |
| SBP00129 | Frescatrano Olives | *Paenibacillus* sp. FSL P4-0081 |
| SBP00129 | Frescatrano Olives | *Paenibacillus* sp. FSL RS-0345 |

TABLE 3-continued

List of species identified in each metagenomic sample of each SBP Sample

| SBP ID | SBP Host Common Name | Genus sp. |
|---|---|---|
| SBP00129 | Frescatrano Olives | *Paenibacillus* sp. FSL RS-0912 |
| SBP00129 | Frescatrano Olives | *Paenibacillus* sp. FSL R7-0273 |
| SBP00129 | Frescatrano Olives | *Paenibacillus* sp. FSL R7-0331 |
| SBP00129 | Frescatrano Olives | *Paenibacillus* sp. IHB B 3084 |
| SBP00129 | Frescatrano Olives | *Paenibacillus* sp. IHBB 10380 |
| SBP00129 | Frescatrano Olives | *Paenibacillus* sp. JDR-2 |
| SBP00129 | Frescatrano Olives | *Paenibacillus* sp. Izh-N1 |
| SBP00129 | Frescatrano Olives | *Paenibacillus* sp. MBLB1234 |
| SBP00129 | Frescatrano Olives | *Paenibacillus* sp. RUD330 |
| SBP00129 | Frescatrano Olives | *Paenibacillus stellifer* |
| SBP00129 | Frescatrano Olives | *Paenibacillus swuensis* |
| SBP00129 | Frescatrano Olives | *Paenibacillus terrae* |
| SBP00129 | Frescatrano Olives | *Paenibacillus xylanexedens* |
| SBP00129 | Frescatrano Olives | *Paenibacillus yonginensis* |
| SBP00129 | Frescatrano Olives | *Paeniclostridium sordellii* |
| SBP00129 | Frescatrano Olives | *Paenisporosarcina antarctica* |
| SBP00129 | Frescatrano Olives | *Paenisporosarcina* sp. K2R23-3 |
| SBP00129 | Frescatrano Olives | *Pandoraea norimbergensis* |
| SBP00129 | Frescatrano Olives | *Pandoraea pnomenusa* |
| SBP00129 | Frescatrano Olives | *Pannonibacter phragmitetus* |
| SBP00129 | Frescatrano Olives | *Pantoea agglomerans* |
| SBP00129 | Frescatrano Olives | *Pantoea alhagi* |
| SBP00129 | Frescatrano Olives | *Pantoea* sp. At-9b |
| SBP00129 | Frescatrano Olives | *Pantoea* sp. PSNIH1 |
| SBP00129 | Frescatrano Olives | *Pantoea vagans* |
| SBP00129 | Frescatrano Olives | *Parabacteroides distasonis* |
| SBP00129 | Frescatrano Olives | *Paraburkholderia caffeinilytica* |
| SBP00129 | Frescatrano Olives | *Paraburkholderia caribensis* |
| SBP00129 | Frescatrano Olives | *Paraburkholderia fungorum* |
| SBP00129 | Frescatrano Olives | *Paraburkholderia phymatum* |
| SBP00129 | Frescatrano Olives | *Paraburkholderia* sp. DCR13 |
| SBP00129 | Frescatrano Olives | *Paraburkholderia terricola* |
| SBP00129 | Frescatrano Olives | *Paracoccus aminophilus* |
| SBP00129 | Frescatrano Olives | *Paracoccus aminovorans* |
| SBP00129 | Frescatrano Olives | *Paracoccus contaminans* |
| SBP00129 | Frescatrano Olives | *Paracoccus denitrificans* |
| SBP00129 | Frescatrano Olives | *Paracoccus* sp. Arc7-R13 |
| SBP00129 | Frescatrano Olives | *Paracoccus* sp. BM15 |
| SBP00129 | Frescatrano Olives | *Paracoccus* sp. CBA4604 |
| SBP00129 | Frescatrano Olives | *Paracoccus* sp. SC2-6 |
| SBP00129 | Frescatrano Olives | *Paracoccus yeei* |
| SBP00129 | Frescatrano Olives | *Paracoccus zhejiangensis* |
| SBP00129 | Frescatrano Olives | *Parageobacillus* genomosp. 1 |
| SBP00129 | Frescatrano Olives | *Parageobacillus thermoglucosidasius* |
| SBP00129 | Frescatrano Olives | *Paraglaciecola psychrophila* |
| SBP00129 | Frescatrano Olives | *Paraliobacillus* sp. X-1125 |
| SBP00129 | Frescatrano Olives | *Paraphotobacterium marinum* |
| SBP00129 | Frescatrano Olives | *Paraprevotella xylaniphila* |
| SBP00129 | Frescatrano Olives | *Parascardovia denticolens* |
| SBP00129 | Frescatrano Olives | *Parvibaculum lavamentivorans* |
| SBP00129 | Frescatrano Olives | *Parvimonas micra* |
| SBP00129 | Frescatrano Olives | *Pasteurella multocida* |
| SBP00129 | Frescatrano Olives | *Paucibacter* sp. KCTC 42545 |
| SBP00129 | Frescatrano Olives | *Pectobacterium carotovorum* |
| SBP00129 | Frescatrano Olives | *Pediococcus acidilactici* |
| SBP00129 | Frescatrano Olives | *Pediococcus claussenii* |
| SBP00129 | Frescatrano Olives | *Pediococcus damnosus* |
| SBP00129 | Frescatrano Olives | *Pediococcus inopinatus* |
| SBP00129 | Frescatrano Olives | *Pediococcus pentosaceus* |
| SBP00129 | Frescatrano Olives | *Pedobacter ginsengisoli* |
| SBP00129 | Frescatrano Olives | *Pedobacter* sp. PACM 27299 |
| SBP00129 | Frescatrano Olives | *Pedobacter steynii* |
| SBP00129 | Frescatrano Olives | *Pelagibaca abyssi* |
| SBP00129 | Frescatrano Olives | *Pelobacter propionicus* |
| SBP00129 | Frescatrano Olives | *Pelosinus fermentans* |
| SBP00129 | Frescatrano Olives | *Pelosinus* sp. UFO1 |
| SBP00129 | Frescatrano Olives | *Peptoclostridium acidaminophilum* |
| SBP00129 | Frescatrano Olives | *Peptostreptococcaceae bacterium* oral taxon 929 |
| SBP00129 | Frescatrano Olives | *Persicobacter* sp. JZB09 |
| SBP00129 | Frescatrano Olives | *Petrotoga mobilis* |
| SBP00129 | Frescatrano Olives | *Phaeobacter inhibens* |
| SBP00129 | Frescatrano Olives | *Phaeobacter piscinae* |
| SBP00129 | Frescatrano Olives | *Phaeobacter porticola* |
| SBP00129 | Frescatrano Olives | *Photobacterium damselae* |
| SBP00129 | Frescatrano Olives | *Photobacterium gaetbulicola* |
| SBP00129 | Frescatrano Olives | *Photorhabdus thracensis* |

TABLE 3-continued

List of species identified in each metagenomic sample of each SBP Sample

| SBP ID | SBP Host Common Name | Genus sp. |
|---|---|---|
| SBP00129 | Frescatrano Olives | *Phreatobacter cathodiphilus* |
| SBP00129 | Frescatrano Olives | *Phreatobacter stygius* |
| SBP00129 | Frescatrano Olives | *Pimelobacter simplex* |
| SBP00129 | Frescatrano Olives | *Pirellula staleyi* |
| SBP00129 | Frescatrano Olives | *Planococcus antarcticus* |
| SBP00129 | Frescatrano Olives | *Planococcus donghaensis* |
| SBP00129 | Frescatrano Olives | *Planococcus halocryophilus* |
| SBP00129 | Frescatrano Olives | *Planococcus kocurii* |
| SBP00129 | Frescatrano Olives | *Planococcus maritimus* |
| SBP00129 | Frescatrano Olives | *Planococcus plakortidis* |
| SBP00129 | Frescatrano Olives | *Planococcus rifietoensis* |
| SBP00129 | Frescatrano Olives | *Planococcus* sp. MB-3u-03 |
| SBP00129 | Frescatrano Olives | *Planococcus* sp. PAMC 21323 |
| SBP00129 | Frescatrano Olives | *Planococcus* sp. Y42 |
| SBP00129 | Frescatrano Olives | *Planococcus versutus* |
| SBP00129 | Frescatrano Olives | *Plautia stali* |
| SBP00129 | Frescatrano Olives | *Pleomorphomonas* sp. SM30 |
| SBP00129 | Frescatrano Olives | *Pluralibacter gergoviae* |
| SBP00129 | Frescatrano Olives | *Polaribacter reichenbachii* |
| SBP00129 | Frescatrano Olives | *Polaribacter* sp. ALD11 |
| SBP00129 | Frescatrano Olives | *Polaribacter* sp. Hel1_33_78 |
| SBP00129 | Frescatrano Olives | *Polaribacter* sp. KT 15 |
| SBP00129 | Frescatrano Olives | *Polaribacter* sp. SA4-10 |
| SBP00129 | Frescatrano Olives | *Polaribacter* sp. SA4-12 |
| SBP00129 | Frescatrano Olives | *Polaromonas naphthalenivorans* |
| SBP00129 | Frescatrano Olives | *Polaromonas* sp. JS666 |
| SBP00129 | Frescatrano Olives | *Polaromonas* sp. SP1 |
| SBP00129 | Frescatrano Olives | *Polymorphum gilvum* |
| SBP00129 | Frescatrano Olives | *Polynucleobacter necessarius* |
| SBP00129 | Frescatrano Olives | *Porphyrobacter* HT-58-2 |
| SBP00129 | Frescatrano Olives | *Prochlorococcus marinus* |
| SBP00129 | Frescatrano Olives | *Prosthecochloris* sp. HL-130-GSB |
| SBP00129 | Frescatrano Olives | *Proteus mirabilis* |
| SBP00129 | Frescatrano Olives | *Proteus vulgaris* |
| SBP00129 | Frescatrano Olives | *Providencia alcalifaciens* |
| SBP00129 | Frescatrano Olives | *Providencia rettgeri* |
| SBP00129 | Frescatrano Olives | *Providencia stuartii* |
| SBP00129 | Frescatrano Olives | *Pseudanabaena* sp. ABRG5-3 |
| SBP00129 | Frescatrano Olives | *Pseudanabaena* sp. PCC 7367 |
| SBP00129 | Frescatrano Olives | *Pseudoalteromonas luteoviolacea* |
| SBP00129 | Frescatrano Olives | *Pseudoalteromonas piratica* |
| SBP00129 | Frescatrano Olives | *Pseudoalteromonas piscicida* |
| SBP00129 | Frescatrano Olives | *Pseudoalteromonas rubra* |
| SBP00129 | Frescatrano Olives | *Pseudoalteromonas* sp. 1_2015MBL_MicDiv |
| SBP00129 | Frescatrano Olives | *Pseudoalteromonas* sp. DL-6 |
| SBP00129 | Frescatrano Olives | *Pseudoalteromonas* sp. R3 |
| SBP00129 | Frescatrano Olives | *Pseudoalteromonas spongiae* |
| SBP00129 | Frescatrano Olives | *Pseudoalteromonas tetraodonis* |
| SBP00129 | Frescatrano Olives | *Pseudoclostridium thermosuccinogenes* |
| SBP00129 | Frescatrano Olives | *Pseudolabrys taiwanensis* |
| SBP00129 | Frescatrano Olives | *Pseudomonas aeruginosa* |
| SBP00129 | Frescatrano Olives | *Pseudomonas agarici* |
| SBP00129 | Frescatrano Olives | *Pseudomonas alcaligenes* |
| SBP00129 | Frescatrano Olives | *Pseudomonas alcaliphila* |
| SBP00129 | Frescatrano Olives | *Pseudomonas alkylphenolica* |
| SBP00129 | Frescatrano Olives | *Pseudomonas amygdali* |
| SBP00129 | Frescatrano Olives | *Pseudomonas antarctica* |
| SBP00129 | Frescatrano Olives | *Pseudomonas arsenicoxydans* |
| SBP00129 | Frescatrano Olives | *Pseudomonas asplenii* |
| SBP00129 | Frescatrano Olives | *Pseudomonas azotoformans* |
| SBP00129 | Frescatrano Olives | *Pseudomonas balearica* |
| SBP00129 | Frescatrano Olives | *Pseudomonas brassicacearum* |
| SBP00129 | Frescatrano Olives | *Pseudomonas brenneri* |
| SBP00129 | Frescatrano Olives | *Pseudomonas cedrina* |
| SBP00129 | Frescatrano Olives | *Pseudomonas cerasi* |
| SBP00129 | Frescatrano Olives | *Pseudomonas chlororaphis* |
| SBP00129 | Frescatrano Olives | *Pseudomonas cichorii* |
| SBP00129 | Frescatrano Olives | *Pseudomonas citronellolis* |
| SBP00129 | Frescatrano Olives | *Pseudomonas corrugata* |
| SBP00129 | Frescatrano Olives | *Pseudomonas cremoricolorata* |
| SBP00129 | Frescatrano Olives | *Pseudomonas entomophila* |
| SBP00129 | Frescatrano Olives | *Pseudomonas extremaustralis* |
| SBP00129 | Frescatrano Olives | *Pseudomonas extremorientalis* |
| SBP00129 | Frescatrano Olives | *Pseudomonas fluorescens* |
| SBP00129 | Frescatrano Olives | *Pseudomonas fragi* |
| SBP00129 | Frescatrano Olives | *Pseudomonas frederiksbergensis* |

TABLE 3-continued

List of species identified in each metagenomic sample of each SBP Sample

| SBP ID | SBP Host Common Name | Genus sp. |
| --- | --- | --- |
| SBP00129 | Frescatrano Olives | *Pseudomonas fulva* |
| SBP00129 | Frescatrano Olives | *Pseudomonas furukawaii* |
| SBP00129 | Frescatrano Olives | *Pseudomonas fuscovaginae* |
| SBP00129 | Frescatrano Olives | *Pseudomonas granadensis* |
| SBP00129 | Frescatrano Olives | *Pseudomonas guangdongensis* |
| SBP00129 | Frescatrano Olives | *Pseudomonas knackmussii* |
| SBP00129 | Frescatrano Olives | *Pseudomonas koreensis* |
| SBP00129 | Frescatrano Olives | *Pseudomonas kribbensis* |
| SBP00129 | Frescatrano Olives | *Pseudomonas libanensis* |
| SBP00129 | Frescatrano Olives | *Pseudomonas lini* |
| SBP00129 | Frescatrano Olives | *Pseudomonas litoralis* |
| SBP00129 | Frescatrano Olives | *Pseudomonas lurida* |
| SBP00129 | Frescatrano Olives | *Pseudomonas mandelii* |
| SBP00129 | Frescatrano Olives | *Pseudomonas mediterranea* |
| SBP00129 | Frescatrano Olives | *Pseudomonas mendocina* |
| SBP00129 | Frescatrano Olives | *Pseudomonas monteilii* |
| SBP00129 | Frescatrano Olives | *Pseudomonas moraviensis* |
| SBP00129 | Frescatrano Olives | *Pseudomonas mosselii* |
| SBP00129 | Frescatrano Olives | *Pseudomonas mucidolens* |
| SBP00129 | Frescatrano Olives | *Pseudomonas orientalis* |
| SBP00129 | Frescatrano Olives | *Pseudomonas oryzae* |
| SBP00129 | Frescatrano Olives | *Pseudomonas oryzihabitans* |
| SBP00129 | Frescatrano Olives | *Pseudomonas palleroniana* |
| SBP00129 | Frescatrano Olives | *Pseudomonas parafulva* |
| SBP00129 | Frescatrano Olives | *Pseudomonas plecoglossicida* |
| SBP00129 | Frescatrano Olives | *Pseudomonas poae* |
| SBP00129 | Frescatrano Olives | *Pseudomonas pohangensis* |
| SBP00129 | Frescatrano Olives | *Pseudomonas prosekij* |
| SBP00129 | Frescatrano Olives | *Pseudomonas protegens* |
| SBP00129 | Frescatrano Olives | *Pseudomonas psychrophila* |
| SBP00129 | Frescatrano Olives | *Pseudomonas psychrotolerans* |
| SBP00129 | Frescatrano Olives | *Pseudomonas putida* |
| SBP00129 | Frescatrano Olives | *Pseudomonas reinekei* |
| SBP00129 | Frescatrano Olives | *Pseudomonas resinovorans* |
| SBP00129 | Frescatrano Olives | *Pseudomonas rhizosphaerae* |
| SBP00129 | Frescatrano Olives | *Pseudomonas rhodesiae* |
| SBP00129 | Frescatrano Olives | *Pseudomonas sabulinigri* |
| SBP00129 | Frescatrano Olives | *Pseudomonas salegens* |
| SBP00129 | Frescatrano Olives | *Pseudomonas saudiphocaensis* |
| SBP00129 | Frescatrano Olives | *Pseudomonas savastanoi* |
| SBP00129 | Frescatrano Olives | *Pseudomonas sihuiensis* |
| SBP00129 | Frescatrano Olives | *Pseudomonas silesiensis* |
| SBP00129 | Frescatrano Olives | *Pseudomonas simiae* |
| SBP00129 | Frescatrano Olives | *Pseudomonas soli* |
| SBP00129 | Frescatrano Olives | *Pseudomonas sp.* |
| SBP00129 | Frescatrano Olives | *Pseudomonas sp.* 02C 26 |
| SBP00129 | Frescatrano Olives | *Pseudomonas sp.* 09C 129 |
| SBP00129 | Frescatrano Olives | *Pseudomonas sp.* 31-12 |
| SBP00129 | Frescatrano Olives | *Pseudomonas sp.* 7SR1 |
| SBP00129 | Frescatrano Olives | *Pseudomonas sp.* A214 |
| SBP00129 | Frescatrano Olives | *Pseudomonas sp.* ATCC 13867 |
| SBP00129 | Frescatrano Olives | *Pseudomonas sp.* B10 |
| SBP00129 | Frescatrano Olives | *Pseudomonas sp.* CC6-YY-74 |
| SBP00129 | Frescatrano Olives | *Pseudomonas sp.* CCOS 191 |
| SBP00129 | Frescatrano Olives | *Pseudomonas sp.* CMR12a |
| SBP00129 | Frescatrano Olives | *Pseudomonas sp.* CMR5c |
| SBP00129 | Frescatrano Olives | *Pseudomonas sp.* DR 5-09 |
| SBP00129 | Frescatrano Olives | *Pseudomonas sp.* DY-1 |
| SBP00129 | Frescatrano Olives | *Pseudomonas sp.* FDAARGOS_380 |
| SBP00129 | Frescatrano Olives | *Pseudomonas sp.* FGI182 |
| SBP00129 | Frescatrano Olives | *Pseudomonas sp.* GLE121 |
| SBP00129 | Frescatrano Olives | *Pseudomonas sp.* GR 6-02 |
| SBP00129 | Frescatrano Olives | *Pseudomonas sp.* HLS-6 |
| SBP00129 | Frescatrano Olives | *Pseudomonas sp.* K2W315-8 |
| SBP00129 | Frescatrano Olives | *Pseudomonas sp.* LAB-08 |
| SBP00129 | Frescatrano Olives | *Pseudomonas sp.* LBUM920 |
| SBP00129 | Frescatrano Olives | *Pseudomonas sp.* Leaf58 |
| SBP00129 | Frescatrano Olives | *Pseudomonas sp.* LG1D9 |
| SBP00129 | Frescatrano Olives | *Pseudomonas sp.* LG1E9 |
| SBP00129 | Frescatrano Olives | *Pseudomonas sp.* LH1G9 |
| SBP00129 | Frescatrano Olives | *Pseudomonas sp.* LPH1 |
| SBP00129 | Frescatrano Olives | *Pseudomonas sp.* LTJR-52 |
| SBP00129 | Frescatrano Olives | *Pseudomonas sp.* Lz4W |
| SBP00129 | Frescatrano Olives | *Pseudomonas sp.* M30-35 |
| SBP00129 | Frescatrano Olives | *Pseudomonas sp.* MRSN12121 |
| SBP00129 | Frescatrano Olives | *Pseudomonas sp.* MYb193 |

TABLE 3-continued

List of species identified in each metagenomic sample of each SBP Sample

| SBP ID | SBP Host Common Name | Genus sp. |
|---|---|---|
| SBP00129 | Frescatrano Olives | *Pseudomonas* sp. NC02 |
| SBP00129 | Frescatrano Olives | *Pseudomonas* sp. NS1(2017) |
| SBP00129 | Frescatrano Olives | *Pseudomonas* sp. Os17 |
| SBP00129 | Frescatrano Olives | *Pseudomonas* sp. phDV1 |
| SBP00129 | Frescatrano Olives | *Pseudomonas* sp. R1-43-08 |
| SBP00129 | Frescatrano Olives | *Pseudomonas* sp. R2-37-08W |
| SBP00129 | Frescatrano Olives | *Pseudomonas* sp. R2-60-08W |
| SBP00129 | Frescatrano Olives | *Pseudomonas* sp. R2A2 |
| SBP00129 | Frescatrano Olives | *Pseudomonas* sp. R3-18-08 |
| SBP00129 | Frescatrano Olives | *Pseudomonas* sp. R3-52-08 |
| SBP00129 | Frescatrano Olives | *Pseudomonas* sp. R4-34-07 |
| SBP00129 | Frescatrano Olives | *Pseudomonas* sp. R4-35-07 |
| SBP00129 | Frescatrano Olives | *Pseudomonas* sp. R4-39-08 |
| SBP00129 | Frescatrano Olives | *Pseudomonas* sp. R5-89-07 |
| SBP00129 | Frescatrano Olives | *Pseudomonas* sp. RU47 |
| SBP00129 | Frescatrano Olives | *Pseudomonas* sp. S-6-2 |
| SBP00129 | Frescatrano Olives | *Pseudomonas* sp. S09G 359 |
| SBP00129 | Frescatrano Olives | *Pseudomonas* sp. s211(2017) |
| SBP00129 | Frescatrano Olives | *Pseudomonas* sp. SGAir0191 |
| SBP00129 | Frescatrano Olives | *Pseudomonas* sp. St29 |
| SBP00129 | Frescatrano Olives | *Pseudomonas* sp. StFLB209 |
| SBP00129 | Frescatrano Olives | *Pseudomonas* sp. SWI36 |
| SBP00129 | Frescatrano Olives | *Pseudomonas* sp. SXM-1 |
| SBP00129 | Frescatrano Olives | *Pseudomonas* sp. TCU-HL1 |
| SBP00129 | Frescatrano Olives | *Pseudomonas* sp. TMW 2.1634 |
| SBP00129 | Frescatrano Olives | *Pseudomonas* sp. URMO17WK12:I11 |
| SBP00129 | Frescatrano Olives | *Pseudomonas* sp. UW4 |
| SBP00129 | Frescatrano Olives | *Pseudomonas* sp. XWY-1 |
| SBP00129 | Frescatrano Olives | *Pseudomonas* sp. Z003-0.4C(8344-21) |
| SBP00129 | Frescatrano Olives | *Pseudomonas stutzeri* |
| SBP00129 | Frescatrano Olives | *Pseudomonas synxantha* |
| SBP00129 | Frescatrano Olives | *Pseudomonas syringae* |
| SBP00129 | Frescatrano Olives | *Pseudomonas syringae* group genomosp. 3 |
| SBP00129 | Frescatrano Olives | *Pseudomonas taetrolens* |
| SBP00129 | Frescatrano Olives | *Pseudomonas thivervalensis* |
| SBP00129 | Frescatrano Olives | *Pseudomonas tolaasii* |
| SBP00129 | Frescatrano Olives | *Pseudomonas trivialis* |
| SBP00129 | Frescatrano Olives | *Pseudomonas umsongensis* |
| SBP00129 | Frescatrano Olives | *Pseudomonas vancouverensis* |
| SBP00129 | Frescatrano Olives | *Pseudomonas veronii* |
| SBP00129 | Frescatrano Olives | *Pseudomonas versuta* |
| SBP00129 | Frescatrano Olives | *Pseudomonas viridiflava* |
| SBP00129 | Frescatrano Olives | *Pseudomonas xanthomarina* |
| SBP00129 | Frescatrano Olives | *Pseudomonas xinjiangensis* |
| SBP00129 | Frescatrano Olives | *Pseudomonas yamanorum* |
| SBP00129 | Frescatrano Olives | *Pseudopedobacter saltans* |
| SBP00129 | Frescatrano Olives | *Pseudorhodobacter* sp. S12M18 |
| SBP00129 | Frescatrano Olives | *Pseudorhodoplanes sinuspersici* |
| SBP00129 | Frescatrano Olives | *Pseudoxanthomonas suwonensis* |
| SBP00129 | Frescatrano Olives | *Psychrobacter* sp. AntiMn-1 |
| SBP00129 | Frescatrano Olives | *Psychrobacter* sp. P11G3 |
| SBP00129 | Frescatrano Olives | *Pyrococcus abyssi* |
| SBP00129 | Frescatrano Olives | *Rahnella aquatilis* |
| SBP00129 | Frescatrano Olives | *Rahnella* sp. ERMR1:05 |
| SBP00129 | Frescatrano Olives | *Ralstonia insidiosa* |
| SBP00129 | Frescatrano Olives | *Ralstonia mannitolilytica* |
| SBP00129 | Frescatrano Olives | *Ralstonia pickettii* |
| SBP00129 | Frescatrano Olives | *Ralstonia solanacearum* |
| SBP00129 | Frescatrano Olives | *Ramlibacter tataouinensis* |
| SBP00129 | Frescatrano Olives | *Raoultella planticola* |
| SBP00129 | Frescatrano Olives | *Rhizobacter gummiphilus* |
| SBP00129 | Frescatrano Olives | *Rhizobium etli* |
| SBP00129 | Frescatrano Olives | *Rhizobium favelukesii* |
| SBP00129 | Frescatrano Olives | *Rhizobium gallicum* |
| SBP00129 | Frescatrano Olives | *Rhizobium leguminosarum* |
| SBP00129 | Frescatrano Olives | *Rhizobium* sp. NT-26 |
| SBP00129 | Frescatrano Olives | *Rhizobium* sp. NXC24 |
| SBP00129 | Frescatrano Olives | *Rhizobium tropici* |
| SBP00129 | Frescatrano Olives | *Rhizorhabdus dicambivorans* |
| SBP00129 | Frescatrano Olives | *Rhodobaca barguzinensis* |
| SBP00129 | Frescatrano Olives | *Rhodobacter blasticus* |
| SBP00129 | Frescatrano Olives | *Rhodobacter capsulatus* |
| SBP00129 | Frescatrano Olives | *Rhodobacter* sp. CZR27 |
| SBP00129 | Frescatrano Olives | *Rhodobacter* sp. LPB0142 |
| SBP00129 | Frescatrano Olives | *Rhodobacter sphaeroides* |
| SBP00129 | Frescatrano Olives | *Rhodobacteraceae bacterium* QY30 |

TABLE 3-continued

List of species identified in each metagenomic sample of each SBP Sample

| SBP ID | SBP Host Common Name | Genus sp. |
|---|---|---|
| SBP00129 | Frescatrano Olives | *Rhodococcus opacus* |
| SBP00129 | Frescatrano Olives | *Rhodoferax ferrireducens* |
| SBP00129 | Frescatrano Olives | *Rhodoferax koreense* |
| SBP00129 | Frescatrano Olives | *Rhodoferax saidenbachensis* |
| SBP00129 | Frescatrano Olives | *Rhodoplanes* sp. Z2-YC6860 |
| SBP00129 | Frescatrano Olives | *Rhodopseudomonas palustris* |
| SBP00129 | Frescatrano Olives | *Rhodospirillum centenum* |
| SBP00129 | Frescatrano Olives | *Rhodovulum* sp. MB263 |
| SBP00129 | Frescatrano Olives | *Rhodovulum* sp. P5 |
| SBP00129 | Frescatrano Olives | *Rhodovulum sulfidophilum* |
| SBP00129 | Frescatrano Olives | *Riemerella anatipestifer* |
| SBP00129 | Frescatrano Olives | *Roseateles depolymerans* |
| SBP00129 | Frescatrano Olives | *Roseburia intestinalis* |
| SBP00129 | Frescatrano Olives | *Roseobacter denitrificans* |
| SBP00129 | Frescatrano Olives | *Roseomonas gilardii* |
| SBP00129 | Frescatrano Olives | *Roseomonas* sp. FDAARGOS_362 |
| SBP00129 | Frescatrano Olives | *Rubrivivax gelatinosus* |
| SBP00129 | Frescatrano Olives | *Ruegeria pomeroyi* |
| SBP00129 | Frescatrano Olives | *Ruegeria* sp. NKC1-1 |
| SBP00129 | Frescatrano Olives | *Ruminococcaceae bacterium* CPB6 |
| SBP00129 | Frescatrano Olives | *Ruminococcus albus* |
| SBP00129 | Frescatrano Olives | *Ruminococcus champanelensis* |
| SBP00129 | Frescatrano Olives | *Rummeliibacillus stabekisii* |
| SBP00129 | Frescatrano Olives | *Sagittula* sp. P11 |
| SBP00129 | Frescatrano Olives | *Salimicrobium jeotgali* |
| SBP00129 | Frescatrano Olives | *Salinibacter ruber* |
| SBP00129 | Frescatrano Olives | *Salinicoccus halodurans* |
| SBP00129 | Frescatrano Olives | *Salinicola tamaricis* |
| SBP00129 | Frescatrano Olives | *Salinigranum rubrum* |
| SBP00129 | Frescatrano Olives | *Salinimonas* sp. N102 |
| SBP00129 | Frescatrano Olives | *Salinisphaera* sp. LB1 |
| SBP00129 | Frescatrano Olives | *Salinivibrio kushneri* |
| SBP00129 | Frescatrano Olives | *Salinivirga cyanobacteriivorans* |
| SBP00129 | Frescatrano Olives | *Salipiger profundus* |
| SBP00129 | Frescatrano Olives | *Salmonella enterica* |
| SBP00129 | Frescatrano Olives | *Sebaldella termitidis* |
| SBP00129 | Frescatrano Olives | *Selenomonas ruminantium* |
| SBP00129 | Frescatrano Olives | *Selenomonas* sp. oral taxon 920 |
| SBP00129 | Frescatrano Olives | *Seonamhaeicola* sp. 52-3 |
| SBP00129 | Frescatrano Olives | *Serpentinomonas mccroryi* |
| SBP00129 | Frescatrano Olives | *Serratia fonticola* |
| SBP00129 | Frescatrano Olives | *Serratia liquefaciens* |
| SBP00129 | Frescatrano Olives | *Serratia marcescens* |
| SBP00129 | Frescatrano Olives | *Serratia plymuthica* |
| SBP00129 | Frescatrano Olives | *Serratia rubidaea* |
| SBP00129 | Frescatrano Olives | *Serratia* sp. P2ACOL2 |
| SBP00129 | Frescatrano Olives | *Shewanella frigidimarina* |
| SBP00129 | Frescatrano Olives | *Shewanella putrefaciens* |
| SBP00129 | Frescatrano Olives | *Shewanella sediminis* |
| SBP00129 | Frescatrano Olives | *Shewanella* sp. ANA-3 |
| SBP00129 | Frescatrano Olives | *Shewanella* sp. MR-7 |
| SBP00129 | Frescatrano Olives | *Shimwellia blattae* |
| SBP00129 | Frescatrano Olives | *Shinella* sp. HZN7 |
| SBP00129 | Frescatrano Olives | *Silicimonas algicola* |
| SBP00129 | Frescatrano Olives | *Simplicispira suum* |
| SBP00129 | Frescatrano Olives | *Sinorhizobium fredii* |
| SBP00129 | Frescatrano Olives | *Sinorhizobium meliloti* |
| SBP00129 | Frescatrano Olives | *Sinorhizobium* sp. RAC02 |
| SBP00129 | Frescatrano Olives | *Slackia heliotrinireducens* |
| SBP00129 | Frescatrano Olives | *Sneathia amnii* |
| SBP00129 | Frescatrano Olives | *Snodgrassella alvi* |
| SBP00129 | Frescatrano Olives | *Soehngenia* sp. W6 |
| SBP00129 | Frescatrano Olives | *Solibacillus silvestris* |
| SBP00129 | Frescatrano Olives | *Solibacillus* sp. R5-41 |
| SBP00129 | Frescatrano Olives | *Solimonas* sp. K1W22B-7 |
| SBP00129 | Frescatrano Olives | *Sorangium cellulosum* |
| SBP00129 | Frescatrano Olives | *Sphingobacterium daejeonense* |
| SBP00129 | Frescatrano Olives | *Sphingobacterium* sp. ML3W |
| SBP00129 | Frescatrano Olives | *Sphingobium baderi* |
| SBP00129 | Frescatrano Olives | *Sphingobium cloacae* |
| SBP00129 | Frescatrano Olives | *Sphingobium hydrophobicum* |
| SBP00129 | Frescatrano Olives | *Sphingobium* sp. TK5 |
| SBP00129 | Frescatrano Olives | *Sphingobium yanoikuyae* |
| SBP00129 | Frescatrano Olives | *Sphingomonas koreensis* |
| SBP00129 | Frescatrano Olives | *Sphingomonas melonis* |
| SBP00129 | Frescatrano Olives | *Sphingomonas panacis* |

TABLE 3-continued

List of species identified in each metagenomic sample of each SBP Sample

| SBP ID | SBP Host Common Name | Genus sp. |
|---|---|---|
| SBP00129 | Frescatrano Olives | *Sphingomonas sanxanigenens* |
| SBP00129 | Frescatrano Olives | *Sphingomonas* sp. AAP5 |
| SBP00129 | Frescatrano Olives | *Sphingomonas* sp. C8-2 |
| SBP00129 | Frescatrano Olives | *Sphingomonas* sp. Cra20 |
| SBP00129 | Frescatrano Olives | *Sphingomonas* sp. FARSPH |
| SBP00129 | Frescatrano Olives | *Sphingomonas* sp. LK11 |
| SBP00129 | Frescatrano Olives | *Sphingomonas* sp. LM7 |
| SBP00129 | Frescatrano Olives | *Sphingomonas* sp. MM-1 |
| SBP00129 | Frescatrano Olives | *Sphingomonas* sp. NIC1 |
| SBP00129 | Frescatrano Olives | *Sphingomonas taxi* |
| SBP00129 | Frescatrano Olives | *Sphingomonas wittichii* |
| SBP00129 | Frescatrano Olives | *Sphingopyxis alaskensis* |
| SBP00129 | Frescatrano Olives | *Sphingopyxis fribergensis* |
| SBP00129 | Frescatrano Olives | *Sphingopyxis macrogoltabida* |
| SBP00129 | Frescatrano Olives | *Sphingopyxis* sp. WS5A3p |
| SBP00129 | Frescatrano Olives | *Spiribacter salinus* |
| SBP00129 | Frescatrano Olives | *Spiroplasma alleghenense* |
| SBP00129 | Frescatrano Olives | *Spiroplasma clarkii* |
| SBP00129 | Frescatrano Olives | *Spiroplasma corruscae* |
| SBP00129 | Frescatrano Olives | *Spiroplasma taiwanense* |
| SBP00129 | Frescatrano Olives | *Sporolactobacillus terrae* |
| SBP00129 | Frescatrano Olives | *Sporosarcina pasteurii* |
| SBP00129 | Frescatrano Olives | *Sporosarcina psychrophila* |
| SBP00129 | Frescatrano Olives | *Sporosarcina* sp. P33 |
| SBP00129 | Frescatrano Olives | *Sporosarcina* sp. PTS2304 |
| SBP00129 | Frescatrano Olives | *Sporosarcina ureae* |
| SBP00129 | Frescatrano Olives | *Staphylococcus agnetis* |
| SBP00129 | Frescatrano Olives | *Staphylococcus argenteus* |
| SBP00129 | Frescatrano Olives | *Staphylococcus arlettae* |
| SBP00129 | Frescatrano Olives | *Staphylococcus aureus* |
| SBP00129 | Frescatrano Olives | *Staphylococcus auricularis* |
| SBP00129 | Frescatrano Olives | *Staphylococcus capitis* |
| SBP00129 | Frescatrano Olives | *Staphylococcus caprae* |
| SBP00129 | Frescatrano Olives | *Staphylococcus carnosus* |
| SBP00129 | Frescatrano Olives | *Staphylococcus cohnii* |
| SBP00129 | Frescatrano Olives | *Staphylococcus condimenti* |
| SBP00129 | Frescatrano Olives | *Staphylococcus delphini* |
| SBP00129 | Frescatrano Olives | *Staphylococcus epidermidis* |
| SBP00129 | Frescatrano Olives | *Staphylococcus equorum* |
| SBP00129 | Frescatrano Olives | *Staphylococcus felis* |
| SBP00129 | Frescatrano Olives | *Staphylococcus haemolyticus* |
| SBP00129 | Frescatrano Olives | *Staphylococcus hominis* |
| SBP00129 | Frescatrano Olives | *Staphylococcus hyicus* |
| SBP00129 | Frescatrano Olives | *Staphylococcus kloosii* |
| SBP00129 | Frescatrano Olives | *Staphylococcus lugdunensis* |
| SBP00129 | Frescatrano Olives | *Staphylococcus lutrae* |
| SBP00129 | Frescatrano Olives | *Staphylococcus muscae* |
| SBP00129 | Frescatrano Olives | *Staphylococcus nepalensis* |
| SBP00129 | Frescatrano Olives | *Staphylococcus pasteuri* |
| SBP00129 | Frescatrano Olives | *Staphylococcus pettenkoferi* |
| SBP00129 | Frescatrano Olives | *Staphylococcus piscifermentans* |
| SBP00129 | Frescatrano Olives | *Staphylococcus pseudintermedius* |
| SBP00129 | Frescatrano Olives | *Staphylococcus saprophyticus* |
| SBP00129 | Frescatrano Olives | *Staphylococcus schleiferi* |
| SBP00129 | Frescatrano Olives | *Staphylococcus schweitzeri* |
| SBP00129 | Frescatrano Olives | *Staphylococcus sciuri* |
| SBP00129 | Frescatrano Olives | *Staphylococcus simiae* |
| SBP00129 | Frescatrano Olives | *Staphylococcus simulans* |
| SBP00129 | Frescatrano Olives | *Staphylococcus* sp. M0911 |
| SBP00129 | Frescatrano Olives | *Staphylococcus* sp. SDB 2975 |
| SBP00129 | Frescatrano Olives | *Staphylococcus stepanovicii* |
| SBP00129 | Frescatrano Olives | *Staphylococcus succinus* |
| SBP00129 | Frescatrano Olives | *Staphylococcus xylosus* |
| SBP00129 | Frescatrano Olives | *Stappia* sp. ES.058 |
| SBP00129 | Frescatrano Olives | *Starkeya novella* |
| SBP00129 | Frescatrano Olives | *Stella humosa* |
| SBP00129 | Frescatrano Olives | *Stenotrophomonas acidaminiphila* |
| SBP00129 | Frescatrano Olives | *Stenotrophomonas maltophilia* |
| SBP00129 | Frescatrano Olives | *Streptobacillus moniliformis* |
| SBP00129 | Frescatrano Olives | *Streptococcus acidominimus* |
| SBP00129 | Frescatrano Olives | *Streptococcus agalactiae* |
| SBP00129 | Frescatrano Olives | *Streptococcus anginosus* |
| SBP00129 | Frescatrano Olives | *Streptococcus australis* |
| SBP00129 | Frescatrano Olives | *Streptococcus canis* |
| SBP00129 | Frescatrano Olives | *Streptococcus constellatus* |
| SBP00129 | Frescatrano Olives | *Streptococcus cristatus* |

TABLE 3-continued

List of species identified in each metagenomic sample of each SBP Sample

| SBP ID | SBP Host Common Name | Genus sp. |
|---|---|---|
| SBP00129 | Frescatrano Olives | *Streptococcus dysgalactiae* |
| SBP00129 | Frescatrano Olives | *Streptococcus equi* |
| SBP00129 | Frescatrano Olives | *Streptococcus equinus* |
| SBP00129 | Frescatrano Olives | *Streptococcus ferus* |
| SBP00129 | Frescatrano Olives | *Streptococcus gallolyticus* |
| SBP00129 | Frescatrano Olives | *Streptococcus gordonii* |
| SBP00129 | Frescatrano Olives | *Streptococcus halotolerans* |
| SBP00129 | Frescatrano Olives | *Streptococcus himalayensis* |
| SBP00129 | Frescatrano Olives | *Streptococcus infantarius* |
| SBP00129 | Frescatrano Olives | *Streptococcus iniae* |
| SBP00129 | Frescatrano Olives | *Streptococcus intermedius* |
| SBP00129 | Frescatrano Olives | *Streptococcus marmotae* |
| SBP00129 | Frescatrano Olives | *Streptococcus merionis* |
| SBP00129 | Frescatrano Olives | *Streptococcus mitis* |
| SBP00129 | Frescatrano Olives | *Streptococcus mutans* |
| SBP00129 | Frescatrano Olives | *Streptococcus oralis* |
| SBP00129 | Frescatrano Olives | *Streptococcus pantholopis* |
| SBP00129 | Frescatrano Olives | *Streptococcus parasanguinis* |
| SBP00129 | Frescatrano Olives | *Streptococcus parauberis* |
| SBP00129 | Frescatrano Olives | *Streptococcus pluranimalium* |
| SBP00129 | Frescatrano Olives | *Streptococcus pneumoniae* |
| SBP00129 | Frescatrano Olives | *Streptococcus porcinus* |
| SBP00129 | Frescatrano Olives | *Streptococcus pyogenes* |
| SBP00129 | Frescatrano Olives | *Streptococcus respiraculi* |
| SBP00129 | Frescatrano Olives | *Streptococcus ruminantium* |
| SBP00129 | Frescatrano Olives | *Streptococcus salivarius* |
| SBP00129 | Frescatrano Olives | *Streptococcus sanguinis* |
| SBP00129 | Frescatrano Olives | *Streptococcus sobrinus* |
| SBP00129 | Frescatrano Olives | *Streptococcus* sp. A12 |
| SBP00129 | Frescatrano Olives | *Streptococcus* sp. HSISM1 |
| SBP00129 | Frescatrano Olives | *Streptococcus* sp. I-P16 |
| SBP00129 | Frescatrano Olives | *Streptococcus* sp. NPS 308 |
| SBP00129 | Frescatrano Olives | *Streptococcus* sp. oral taxon 431 |
| SBP00129 | Frescatrano Olives | *Streptococcus* sp. Z15 |
| SBP00129 | Frescatrano Olives | *Streptococcus suis* |
| SBP00129 | Frescatrano Olives | *Streptococcus thermophilus* |
| SBP00129 | Frescatrano Olives | *Streptococcus troglodytae* |
| SBP00129 | Frescatrano Olives | *Streptococcus uberis* |
| SBP00129 | Frescatrano Olives | *Streptococcus urinalis* |
| SBP00129 | Frescatrano Olives | *Streptococcus viridans* |
| SBP00129 | Frescatrano Olives | *Streptomyces atratus* |
| SBP00129 | Frescatrano Olives | *Streptomyces cyaneogriseus* |
| SBP00129 | Frescatrano Olives | *Streptomyces lincolnensis* |
| SBP00129 | Frescatrano Olives | *Streptomyces* sp. CFMR 7 |
| SBP00129 | Frescatrano Olives | *Streptomyces* sp. ICC1 |
| SBP00129 | Frescatrano Olives | *Streptomyces* sp. MK45 |
| SBP00129 | Frescatrano Olives | *Streptomyces* sp. RTd22 |
| SBP00129 | Frescatrano Olives | *Streptomyces* sp. TLI_053 |
| SBP00129 | Frescatrano Olives | *Streptosporangium* sp. 'caverna' |
| SBP00129 | Frescatrano Olives | *Sulfitobacter* sp. AM1-D1 |
| SBP00129 | Frescatrano Olives | *Sulfitobacter* sp. SK025 |
| SBP00129 | Frescatrano Olives | *Sulfurihydrogenibium* sp. YO3AOP1 |
| SBP00129 | Frescatrano Olives | *Sulfuritalea hydrogenivorans* |
| SBP00129 | Frescatrano Olives | *Tabrizicola* sp. K13M18 |
| SBP00129 | Frescatrano Olives | *Tateyamaria omphalii* |
| SBP00129 | Frescatrano Olives | *Tenacibaculum mesophilum* |
| SBP00129 | Frescatrano Olives | *Tenericutes bacterium* MZ-XQ |
| SBP00129 | Frescatrano Olives | *Tepidanaerobacter acetatoxydans* |
| SBP00129 | Frescatrano Olives | *Terribacillus goriensis* |
| SBP00129 | Frescatrano Olives | *Terriglobus saanensis* |
| SBP00129 | Frescatrano Olives | *Tessaracoccus flavus* |
| SBP00129 | Frescatrano Olives | *Tetragenococcus halophilus* |
| SBP00129 | Frescatrano Olives | *Tetragenococcus koreensis* |
| SBP00129 | Frescatrano Olives | *Tetragenococcus osmophilus* |
| SBP00129 | Frescatrano Olives | *Thalassococcus* sp. SH-1 |
| SBP00129 | Frescatrano Olives | *Thalassospira indica* |
| SBP00129 | Frescatrano Olives | *Thalassospira xiamenensis* |
| SBP00129 | Frescatrano Olives | *Thauera aromatica* |
| SBP00129 | Frescatrano Olives | *Thauera* sp. MZ1T |
| SBP00129 | Frescatrano Olives | *Thermaerobacter marianensis* |
| SBP00129 | Frescatrano Olives | *Thermincola potens* |
| SBP00129 | Frescatrano Olives | *Thermoanaerobacter italicus* |
| SBP00129 | Frescatrano Olives | *Thermoanaerobacter mathranii* |
| SBP00129 | Frescatrano Olives | *Thermoanaerobacterales bacterium* SK-G1 |
| SBP00129 | Frescatrano Olives | *Thermoanaerobacterium* sp. RBIITO |
| SBP00129 | Frescatrano Olives | *Thermoanaerobacterium thermosaccharolyticum* |

TABLE 3-continued

List of species identified in each metagenomic sample of each SBP Sample

| SBP ID | SBP Host Common Name | Genus sp. |
|---|---|---|
| SBP00129 | Frescatrano Olives | Thermoanaerobacterium xylanolyticum |
| SBP00129 | Frescatrano Olives | Thermobacillus composti |
| SBP00129 | Frescatrano Olives | Thermococcus sp. P6 |
| SBP00129 | Frescatrano Olives | Thermosipho africanus |
| SBP00129 | Frescatrano Olives | Thermosipho melanesiensis |
| SBP00129 | Frescatrano Olives | Thermosipho sp. 1070 |
| SBP00129 | Frescatrano Olives | Thioalkalivibrio sp. K90mix |
| SBP00129 | Frescatrano Olives | Thioclava nitratireducens |
| SBP00129 | Frescatrano Olives | Thiomonas arsenitoxydans |
| SBP00129 | Frescatrano Olives | Thiomonas intermedia |
| SBP00129 | Frescatrano Olives | Thiomonas sp. X19 |
| SBP00129 | Frescatrano Olives | Treponema denticola |
| SBP00129 | Frescatrano Olives | Trichormus azollae |
| SBP00129 | Frescatrano Olives | Tsukamurella paurometabola |
| SBP00129 | Frescatrano Olives | Tumebacillus avium |
| SBP00129 | Frescatrano Olives | Turicibacter sp. H121 |
| SBP00129 | Frescatrano Olives | Ureibacillus thermosphaericus |
| SBP00129 | Frescatrano Olives | Vagococcus penaei |
| SBP00129 | Frescatrano Olives | Vagococcus teuberi |
| SBP00129 | Frescatrano Olives | Variovorax boronicumulans |
| SBP00129 | Frescatrano Olives | Variovorax paradoxus |
| SBP00129 | Frescatrano Olives | Variovorax sp. HW608 |
| SBP00129 | Frescatrano Olives | Variovorax sp. PAMC 28711 |
| SBP00129 | Frescatrano Olives | Variovorax sp. PMC12 |
| SBP00129 | Frescatrano Olives | Veillonella dispar |
| SBP00129 | Frescatrano Olives | Verminephrobacter eiseniae |
| SBP00129 | Frescatrano Olives | Vibrio alfacsensis |
| SBP00129 | Frescatrano Olives | Vibrio alginolyticus |
| SBP00129 | Frescatrano Olives | Vibrio anguillarum |
| SBP00129 | Frescatrano Olives | Vibrio aphrogenes |
| SBP00129 | Frescatrano Olives | Vibrio campbellii |
| SBP00129 | Frescatrano Olives | Vibrio casei |
| SBP00129 | Frescatrano Olives | Vibrio chagasii |
| SBP00129 | Frescatrano Olives | Vibrio cholerae |
| SBP00129 | Frescatrano Olives | Vibrio coralliilyticus |
| SBP00129 | Frescatrano Olives | Vibrio crassostreae |
| SBP00129 | Frescatrano Olives | Vibrio diabolicus |
| SBP00129 | Frescatrano Olives | Vibrio fluvialis |
| SBP00129 | Frescatrano Olives | Vibrio furnissii |
| SBP00129 | Frescatrano Olives | Vibrio gazogenes |
| SBP00129 | Frescatrano Olives | Vibrio mediterranei |
| SBP00129 | Frescatrano Olives | Vibrio mimicus |
| SBP00129 | Frescatrano Olives | Vibrio nigripulchritudo |
| SBP00129 | Frescatrano Olives | Vibrio owensii |
| SBP00129 | Frescatrano Olives | Vibrio parahaemolyticus |
| SBP00129 | Frescatrano Olives | Vibrio rumoiensis |
| SBP00129 | Frescatrano Olives | Vibrio scophthalmi |
| SBP00129 | Frescatrano Olives | Vibrio sp. 2521-89 |
| SBP00129 | Frescatrano Olives | Vibrio sp. dhg |
| SBP00129 | Frescatrano Olives | Vibrio sp. HBUAS61001 |
| SBP00129 | Frescatrano Olives | Vibrio tapetis |
| SBP00129 | Frescatrano Olives | Vibrio tritonius |
| SBP00129 | Frescatrano Olives | Vibrio tubiashii |
| SBP00129 | Frescatrano Olives | Vibrio vulnificus |
| SBP00129 | Frescatrano Olives | Virgibacillus dokdonensis |
| SBP00129 | Frescatrano Olives | Virgibacillus halodenitrificans |
| SBP00129 | Frescatrano Olives | Virgibacillus necropolis |
| SBP00129 | Frescatrano Olives | Virgibacillus phasianinus |
| SBP00129 | Frescatrano Olives | Virgibacillus sp. 6R |
| SBP00129 | Frescatrano Olives | Virgibacillus sp. Bac330 |
| SBP00129 | Frescatrano Olives | Virgibacillus sp. Bac332 |
| SBP00129 | Frescatrano Olives | Virgibacillus sp. SK37 |
| SBP00129 | Frescatrano Olives | Vulgatibacter incomptus |
| SBP00129 | Frescatrano Olives | Weissella ceti |
| SBP00129 | Frescatrano Olives | Weissella cibaria |
| SBP00129 | Frescatrano Olives | Weissella confusa |
| SBP00129 | Frescatrano Olives | Weissella hellenica |
| SBP00129 | Frescatrano Olives | Weissella jogaejeotgali |
| SBP00129 | Frescatrano Olives | Weissella koreensis |
| SBP00129 | Frescatrano Olives | Weissella paramesenteroides |
| SBP00129 | Frescatrano Olives | Weissella soli |
| SBP00129 | Frescatrano Olives | Weissella viridescens |
| SBP00129 | Frescatrano Olives | Winogradskyella sp. J14-2 |
| SBP00129 | Frescatrano Olives | Winogradskyella sp. PC-19 |
| SBP00129 | Frescatrano Olives | Winogradskyella sp. RHA_55 |
| SBP00129 | Frescatrano Olives | Xanthobacter autotrophicus |

TABLE 3-continued

List of species identified in each metagenomic sample of each SBP Sample

| SBP ID | SBP Host Common Name | Genus sp. |
|---|---|---|
| SBP00129 | Frescatrano Olives | *Xanthomonas citri* |
| SBP00129 | Frescatrano Olives | *Xanthomonas oryzae* |
| SBP00129 | Frescatrano Olives | *Xanthomonas translucens* |
| SBP00129 | Frescatrano Olives | *Xylanimonas cellulosilytica* |
| SBP00129 | Frescatrano Olives | *Yangia pacifica* |
| SBP00129 | Frescatrano Olives | *Yangia* sp. CCB-MM3 |
| SBP00129 | Frescatrano Olives | *Yersinia aleksiciae* |
| SBP00129 | Frescatrano Olives | *Yersinia enterocolitica* |
| SBP00129 | Frescatrano Olives | *Yersinia ruckeri* |
| SBP00129 | Frescatrano Olives | *Yoonia vestfoldensis* |
| SBP00130 | Greek Ripe Black Olives | [*Enterobacter*] *lignolyticus* |
| SBP00130 | Greek Ripe Black Olives | [*Enterobacter*] *lignolyticus* |
| SBP00130 | Greek Ripe Black Olives | [*Polyangium*] *brachysporum* |
| SBP00130 | Greek Ripe Black Olives | [*Polyangium*] *brachysporum* |
| SBP00130 | Greek Ripe Black Olives | *Acetobacter aceti* |
| SBP00130 | Greek Ripe Black Olives | *Acetobacter aceti* |
| SBP00130 | Greek Ripe Black Olives | *Acetobacter persici* |
| SBP00130 | Greek Ripe Black Olives | *Acetobacter persici* |
| SBP00130 | Greek Ripe Black Olives | *Acetobacteraceae bacterium* |
| SBP00130 | Greek Ripe Black Olives | *Acetobacteraceae bacterium* |
| SBP00130 | Greek Ripe Black Olives | *Achromobacter denitrificans* |
| SBP00130 | Greek Ripe Black Olives | *Achromobacter denitrificans* |
| SBP00130 | Greek Ripe Black Olives | *Achromobacter insolitus* |
| SBP00130 | Greek Ripe Black Olives | *Achromobacter insolitus* |
| SBP00130 | Greek Ripe Black Olives | *Achromobacter* sp. AONIH1 |
| SBP00130 | Greek Ripe Black Olives | *Achromobacter* sp. AONIH1 |
| SBP00130 | Greek Ripe Black Olives | *Achromobacter* sp. B7 |
| SBP00130 | Greek Ripe Black Olives | *Achromobacter* sp. B7 |
| SBP00130 | Greek Ripe Black Olives | *Achromobacter* sp. MFA1 R4 |
| SBP00130 | Greek Ripe Black Olives | *Achromobacter* sp. MFA1 R4 |
| SBP00130 | Greek Ripe Black Olives | *Achromobacter spanius* |
| SBP00130 | Greek Ripe Black Olives | *Achromobacter spanius* |
| SBP00130 | Greek Ripe Black Olives | *Achromobacter xylosoxidans* |
| SBP00130 | Greek Ripe Black Olives | *Achromobacter xylosoxidans* |
| SBP00130 | Greek Ripe Black Olives | *Acidihalobacter ferrooxidans* |
| SBP00130 | Greek Ripe Black Olives | *Acidihalobacter ferrooxidans* |
| SBP00130 | Greek Ripe Black Olives | *Acidihalobacter prosperus* |
| SBP00130 | Greek Ripe Black Olives | *Acidihalobacter prosperus* |
| SBP00130 | Greek Ripe Black Olives | *Acidithiobacillus ferridurans* |
| SBP00130 | Greek Ripe Black Olives | *Acidithiobacillus ferridurans* |
| SBP00130 | Greek Ripe Black Olives | *Acidobacteriaceae bacterium* SBC82 |
| SBP00130 | Greek Ripe Black Olives | *Acidobacteriaceae bacterium* SBC82 |
| SBP00130 | Greek Ripe Black Olives | *Acidovorax avenae* |
| SBP00130 | Greek Ripe Black Olives | *Acidovorax avenae* |
| SBP00130 | Greek Ripe Black Olives | *Acidovorax carolinensis* |
| SBP00130 | Greek Ripe Black Olives | *Acidovorax carolinensis* |
| SBP00130 | Greek Ripe Black Olives | *Acidovorax cattleyae* |
| SBP00130 | Greek Ripe Black Olives | *Acidovorax cattleyae* |
| SBP00130 | Greek Ripe Black Olives | *Acidovorax citrulli* |
| SBP00130 | Greek Ripe Black Olives | *Acidovorax citrulli* |
| SBP00130 | Greek Ripe Black Olives | *Acidovorax ebreus* |
| SBP00130 | Greek Ripe Black Olives | *Acidovorax ebreus* |
| SBP00130 | Greek Ripe Black Olives | *Acidovorax* sp. KKS102 |
| SBP00130 | Greek Ripe Black Olives | *Acidovorax* sp. KKS102 |
| SBP00130 | Greek Ripe Black Olives | *Acidovorax* sp. T1 |
| SBP00130 | Greek Ripe Black Olives | *Acidovorax* sp. T1 |
| SBP00130 | Greek Ripe Black Olives | *Acinetobacter baumannii* |
| SBP00130 | Greek Ripe Black Olives | *Acinetobacter baumannii* |
| SBP00130 | Greek Ripe Black Olives | *Acinetobacter calcoaceticus* |
| SBP00130 | Greek Ripe Black Olives | *Acinetobacter calcoaceticus* |
| SBP00130 | Greek Ripe Black Olives | *Acinetobacter defluvii* |
| SBP00130 | Greek Ripe Black Olives | *Acinetobacter defluvii* |
| SBP00130 | Greek Ripe Black Olives | *Acinetobacter guillouiae* |
| SBP00130 | Greek Ripe Black Olives | *Acinetobacter guillouiae* |
| SBP00130 | Greek Ripe Black Olives | *Acinetobacter haemolyticus* |
| SBP00130 | Greek Ripe Black Olives | *Acinetobacter haemolyticus* |
| SBP00130 | Greek Ripe Black Olives | *Acinetobacter indicus* |
| SBP00130 | Greek Ripe Black Olives | *Acinetobacter indicus* |
| SBP00130 | Greek Ripe Black Olives | *Acinetobacter johnsonii* |
| SBP00130 | Greek Ripe Black Olives | *Acinetobacter johnsonii* |
| SBP00130 | Greek Ripe Black Olives | *Acinetobacter junii* |
| SBP00130 | Greek Ripe Black Olives | *Acinetobacter junii* |
| SBP00130 | Greek Ripe Black Olives | *Acinetobacter larvae* |
| SBP00130 | Greek Ripe Black Olives | *Acinetobacter larvae* |
| SBP00130 | Greek Ripe Black Olives | *Acinetobacter lwoffii* |
| SBP00130 | Greek Ripe Black Olives | *Acinetobacter lwoffii* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Acinetobacter nosocomialis* |
| SBP00130 | Greek Ripe Black Olives | *Acinetobacter nosocomialis* |
| SBP00130 | Greek Ripe Black Olives | *Acinetobacter pittii* |
| SBP00130 | Greek Ripe Black Olives | *Acinetobacter pittii* |
| SBP00130 | Greek Ripe Black Olives | *Acinetobacter radioresistens* |
| SBP00130 | Greek Ripe Black Olives | *Acinetobacter radioresistens* |
| SBP00130 | Greek Ripe Black Olives | *Acinetobacter schindleri* |
| SBP00130 | Greek Ripe Black Olives | *Acinetobacter schindleri* |
| SBP00130 | Greek Ripe Black Olives | *Acinetobacter soli* |
| SBP00130 | Greek Ripe Black Olives | *Acinetobacter soli* |
| SBP00130 | Greek Ripe Black Olives | *Acinetobacter* sp. ACNIH1 |
| SBP00130 | Greek Ripe Black Olives | *Acinetobacter* sp. ACNIH1 |
| SBP00130 | Greek Ripe Black Olives | *Acinetobacter* sp. ACNIH2 |
| SBP00130 | Greek Ripe Black Olives | *Acinetobacter* sp. ACNIH2 |
| SBP00130 | Greek Ripe Black Olives | *Acinetobacter* sp. LoGeW2-3 |
| SBP00130 | Greek Ripe Black Olives | *Acinetobacter* sp. LoGeW2-3 |
| SBP00130 | Greek Ripe Black Olives | *Acinetobacter* sp. NCu2D-2 |
| SBP00130 | Greek Ripe Black Olives | *Acinetobacter* sp. NCu2D-2 |
| SBP00130 | Greek Ripe Black Olives | *Acinetobacter* sp. TGL-Y2 |
| SBP00130 | Greek Ripe Black Olives | *Acinetobacter* sp. TGL-Y2 |
| SBP00130 | Greek Ripe Black Olives | *Acinetobacter* sp. TTH0-4 |
| SBP00130 | Greek Ripe Black Olives | *Acinetobacter* sp. TTH0-4 |
| SBP00130 | Greek Ripe Black Olives | *Acinetobacter* sp. WCHA45 |
| SBP00130 | Greek Ripe Black Olives | *Acinetobacter* sp. WCHA45 |
| SBP00130 | Greek Ripe Black Olives | *Acinetobacter* sp. WCHA55 |
| SBP00130 | Greek Ripe Black Olives | *Acinetobacter* sp. WCHA55 |
| SBP00130 | Greek Ripe Black Olives | *Acinetobacter* sp. WCHAc010005 |
| SBP00130 | Greek Ripe Black Olives | *Acinetobacter* sp. WCHAc010005 |
| SBP00130 | Greek Ripe Black Olives | *Acinetobacter* sp. WCHAc010034 |
| SBP00130 | Greek Ripe Black Olives | *Acinetobacter* sp. WCHAc010034 |
| SBP00130 | Greek Ripe Black Olives | *Acinetobacter ursingii* |
| SBP00130 | Greek Ripe Black Olives | *Acinetobacter ursingii* |
| SBP00130 | Greek Ripe Black Olives | *Acinetobacter venetianus* |
| SBP00130 | Greek Ripe Black Olives | *Acinetobacter venetianus* |
| SBP00130 | Greek Ripe Black Olives | *Acinetobacter wuhouensis* |
| SBP00130 | Greek Ripe Black Olives | *Acinetobacter wuhouensis* |
| SBP00130 | Greek Ripe Black Olives | *Actinobacillus pleuropnemoniae* |
| SBP00130 | Greek Ripe Black Olives | *Actinobacillus pleuropnemoniae* |
| SBP00130 | Greek Ripe Black Olives | *Actinobacteria bacterium* IMCC26103 |
| SBP00130 | Greek Ripe Black Olives | *Actinobacteria bacterium* IMCC26103 |
| SBP00130 | Greek Ripe Black Olives | *Actinomyces* sp. oral taxon 897 |
| SBP00130 | Greek Ripe Black Olives | *Actinomyces* sp. oral taxon 897 |
| SBP00130 | Greek Ripe Black Olives | *Actinoplanes derwentensis* |
| SBP00130 | Greek Ripe Black Olives | *Actinoplanes derwentensis* |
| SBP00130 | Greek Ripe Black Olives | *Actinoplanes* sp. N902-109 |
| SBP00130 | Greek Ripe Black Olives | *Actinoplanes* sp. N902-109 |
| SBP00130 | Greek Ripe Black Olives | *Actinoplanes* sp. OR16 |
| SBP00130 | Greek Ripe Black Olives | *Actinoplanes* sp. OR16 |
| SBP00130 | Greek Ripe Black Olives | *Actinopolymorpha singaporensis* |
| SBP00130 | Greek Ripe Black Olives | *Actinopolymorpha singaporensis* |
| SBP00130 | Greek Ripe Black Olives | *Actinosynnema pretiosum* |
| SBP00130 | Greek Ripe Black Olives | *Actinosynnema pretiosum* |
| SBP00130 | Greek Ripe Black Olives | *Advenella kashmirensis* |
| SBP00130 | Greek Ripe Black Olives | *Advenella kashmirensis* |
| SBP00130 | Greek Ripe Black Olives | *Advenella mimigardefordensis* |
| SBP00130 | Greek Ripe Black Olives | *Advenella mimigardefordensis* |
| SBP00130 | Greek Ripe Black Olives | *Aeromonas caviae* |
| SBP00130 | Greek Ripe Black Olives | *Aeromonas caviae* |
| SBP00130 | Greek Ripe Black Olives | *Aeromonas dhakensis* |
| SBP00130 | Greek Ripe Black Olives | *Aeromonas dhakensis* |
| SBP00130 | Greek Ripe Black Olives | *Aeromonas encheleia* |
| SBP00130 | Greek Ripe Black Olives | *Aeromonas encheleia* |
| SBP00130 | Greek Ripe Black Olives | *Aeromonas hydrophila* |
| SBP00130 | Greek Ripe Black Olives | *Aeromonas hydrophila* |
| SBP00130 | Greek Ripe Black Olives | *Aeromonas media* |
| SBP00130 | Greek Ripe Black Olives | *Aeromonas media* |
| SBP00130 | Greek Ripe Black Olives | *Aeromonas salmonicida* |
| SBP00130 | Greek Ripe Black Olives | *Aeromonas salmonicida* |
| SBP00130 | Greek Ripe Black Olives | *Aeromonas schubertii* |
| SBP00130 | Greek Ripe Black Olives | *Aeromonas schubertii* |
| SBP00130 | Greek Ripe Black Olives | *Aeromonas* sp. ASNIH3 |
| SBP00130 | Greek Ripe Black Olives | *Aeromonas* sp. ASNIH3 |
| SBP00130 | Greek Ripe Black Olives | *Aeromonas* sp. ASNIH4 |
| SBP00130 | Greek Ripe Black Olives | *Aeromonas* sp. ASNIH4 |
| SBP00130 | Greek Ripe Black Olives | *Aeromonas* sp. CU5 |
| SBP00130 | Greek Ripe Black Olives | *Aeromonas* sp. CU5 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | Aeromonas veronii |
| SBP00130 | Greek Ripe Black Olives | Aeromonas veronii |
| SBP00130 | Greek Ripe Black Olives | Afipia sp. GAS231 |
| SBP00130 | Greek Ripe Black Olives | Afipia sp. GAS231 |
| SBP00130 | Greek Ripe Black Olives | Aggregatibacter actinomycetemcomitans |
| SBP00130 | Greek Ripe Black Olives | Aggregatibacter actinomycetemcomitans |
| SBP00130 | Greek Ripe Black Olives | Agrobacterium fabrum |
| SBP00130 | Greek Ripe Black Olives | Agrobacterium fabrum |
| SBP00130 | Greek Ripe Black Olives | Agrobacterium rhizogenes |
| SBP00130 | Greek Ripe Black Olives | Agrobacterium rhizogenes |
| SBP00130 | Greek Ripe Black Olives | Agrobacterium sp. |
| SBP00130 | Greek Ripe Black Olives | Agrobacterium sp. |
| SBP00130 | Greek Ripe Black Olives | Agrobacterium tumefaciens |
| SBP00130 | Greek Ripe Black Olives | Agrobacterium tumefaciens |
| SBP00130 | Greek Ripe Black Olives | Agrobacterium vitis |
| SBP00130 | Greek Ripe Black Olives | Agrobacterium vitis |
| SBP00130 | Greek Ripe Black Olives | Agromyces flavus |
| SBP00130 | Greek Ripe Black Olives | Agromyces flavus |
| SBP00130 | Greek Ripe Black Olives | Agromyces sp. 30A |
| SBP00130 | Greek Ripe Black Olives | Agromyces sp. 30A |
| SBP00130 | Greek Ripe Black Olives | Ahniella affigens |
| SBP00130 | Greek Ripe Black Olives | Ahniella affigens |
| SBP00130 | Greek Ripe Black Olives | Alcaligenes aquatilis |
| SBP00130 | Greek Ripe Black Olives | Alcaligenes aquatilis |
| SBP00130 | Greek Ripe Black Olives | Alcaligenes faecalis |
| SBP00130 | Greek Ripe Black Olives | Alcaligenes faecalis |
| SBP00130 | Greek Ripe Black Olives | Alcanivorax dieselolei |
| SBP00130 | Greek Ripe Black Olives | Alcanivorax dieselolei |
| SBP00130 | Greek Ripe Black Olives | Alcanivorax pacificus |
| SBP00130 | Greek Ripe Black Olives | Alcanivorax pacificus |
| SBP00130 | Greek Ripe Black Olives | Alcanivorax sp. N3-2A |
| SBP00130 | Greek Ripe Black Olives | Alcanivorax sp. N3-2A |
| SBP00130 | Greek Ripe Black Olives | Alcanivorax xenomutans |
| SBP00130 | Greek Ripe Black Olives | Alcanivorax xenomutans |
| SBP00130 | Greek Ripe Black Olives | Algoriphagus machipongonensis |
| SBP00130 | Greek Ripe Black Olives | Algoriphagus machipongonensis |
| SBP00130 | Greek Ripe Black Olives | Alicycliphilus denitrificans |
| SBP00130 | Greek Ripe Black Olives | Alicycliphilus denitrificans |
| SBP00130 | Greek Ripe Black Olives | Alicyclobacillus acidocaldarius |
| SBP00130 | Greek Ripe Black Olives | Alicyclobacillus acidocaldarius |
| SBP00130 | Greek Ripe Black Olives | Alkalilimnicola ehrlichii |
| SBP00130 | Greek Ripe Black Olives | Alkalilimnicola ehrlichii |
| SBP00130 | Greek Ripe Black Olives | Alloactinosynnema sp. L-07 |
| SBP00130 | Greek Ripe Black Olives | Alloactinosynnema sp. L-07 |
| SBP00130 | Greek Ripe Black Olives | Alteromonas macleodii |
| SBP00130 | Greek Ripe Black Olives | Alteromonas macleodii |
| SBP00130 | Greek Ripe Black Olives | Alteromonas mediterranea |
| SBP00130 | Greek Ripe Black Olives | Alteromonas mediterranea |
| SBP00130 | Greek Ripe Black Olives | Alteromonas naphthalenivorans |
| SBP00130 | Greek Ripe Black Olives | Alteromonas naphthalenivorans |
| SBP00130 | Greek Ripe Black Olives | Alteromonas sp. 76-1 |
| SBP00130 | Greek Ripe Black Olives | Alteromonas sp. 76-1 |
| SBP00130 | Greek Ripe Black Olives | Alteromonas sp. BL110 |
| SBP00130 | Greek Ripe Black Olives | Alteromonas sp. BL110 |
| SBP00130 | Greek Ripe Black Olives | Alteromonas sp. RKMC-009 |
| SBP00130 | Greek Ripe Black Olives | Alteromonas sp. RKMC-009 |
| SBP00130 | Greek Ripe Black Olives | Aminobacter aminovorans |
| SBP00130 | Greek Ripe Black Olives | Aminobacter aminovorans |
| SBP00130 | Greek Ripe Black Olives | Amycolatopsis keratiniphila |
| SBP00130 | Greek Ripe Black Olives | Amycolatopsis keratiniphila |
| SBP00130 | Greek Ripe Black Olives | Anderseniella sp. Alg231-50 |
| SBP00130 | Greek Ripe Black Olives | Anderseniella sp. Alg231-50 |
| SBP00130 | Greek Ripe Black Olives | Antarctobacter heliothermus |
| SBP00130 | Greek Ripe Black Olives | Antarctobacter heliothermus |
| SBP00130 | Greek Ripe Black Olives | Aquabacterium olei |
| SBP00130 | Greek Ripe Black Olives | Aquabacterium olei |
| SBP00130 | Greek Ripe Black Olives | Aquaspirillum sp. LM1 |
| SBP00130 | Greek Ripe Black Olives | Aquaspirillum sp. LM1 |
| SBP00130 | Greek Ripe Black Olives | Aquiflexum balticum |
| SBP00130 | Greek Ripe Black Olives | Aquiflexum balticum |
| SBP00130 | Greek Ripe Black Olives | Aquitalea magnusonii |
| SBP00130 | Greek Ripe Black Olives | Aquitalea magnusonii |
| SBP00130 | Greek Ripe Black Olives | Aquitalea sp. THG-DN7.12 |
| SBP00130 | Greek Ripe Black Olives | Aquitalea sp. THG-DN7.12 |
| SBP00130 | Greek Ripe Black Olives | Aquitalea sp. USM4 |
| SBP00130 | Greek Ripe Black Olives | Aquitalea sp. USM4 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | Arcanobacterium phocae |
| SBP00130 | Greek Ripe Black Olives | Arcanobacterium phocae |
| SBP00130 | Greek Ripe Black Olives | Arsenicicoccus sp. oral taxon 190 |
| SBP00130 | Greek Ripe Black Olives | Arsenicicoccus sp. oral taxon 190 |
| SBP00130 | Greek Ripe Black Olives | Arthrobacter crystallopoietes |
| SBP00130 | Greek Ripe Black Olives | Arthrobacter crystallopoietes |
| SBP00130 | Greek Ripe Black Olives | Arthrobacter sp. U41 |
| SBP00130 | Greek Ripe Black Olives | Arthrobacter sp. U41 |
| SBP00130 | Greek Ripe Black Olives | Arthrobacter sp. YC-RL1 |
| SBP00130 | Greek Ripe Black Olives | Arthrobacter sp. YC-RL1 |
| SBP00130 | Greek Ripe Black Olives | Arthrospira platensis |
| SBP00130 | Greek Ripe Black Olives | Arthrospira platensis |
| SBP00130 | Greek Ripe Black Olives | Asaia bogorensis |
| SBP00130 | Greek Ripe Black Olives | Asaia bogorensis |
| SBP00130 | Greek Ripe Black Olives | Asticcacaulis excentricus |
| SBP00130 | Greek Ripe Black Olives | Asticcacaulis excentricus |
| SBP00130 | Greek Ripe Black Olives | Atlantibacter hermannii |
| SBP00130 | Greek Ripe Black Olives | Atlantibacter hermannii |
| SBP00130 | Greek Ripe Black Olives | Aureimonas sp. AU20 |
| SBP00130 | Greek Ripe Black Olives | Aureimonas sp. AU20 |
| SBP00130 | Greek Ripe Black Olives | Austwickia chelonae |
| SBP00130 | Greek Ripe Black Olives | Austwickia chelonae |
| SBP00130 | Greek Ripe Black Olives | Azoarcus communis |
| SBP00130 | Greek Ripe Black Olives | Azoarcus communis |
| SBP00130 | Greek Ripe Black Olives | Azoarcus sp. CIB |
| SBP00130 | Greek Ripe Black Olives | Azoarcus sp. CIB |
| SBP00130 | Greek Ripe Black Olives | Azoarcus sp. KH32C |
| SBP00130 | Greek Ripe Black Olives | Azoarcus sp. KH32C |
| SBP00130 | Greek Ripe Black Olives | Azorhizobium caulinodans |
| SBP00130 | Greek Ripe Black Olives | Azorhizobium caulinodans |
| SBP00130 | Greek Ripe Black Olives | Azospira oryzae |
| SBP00130 | Greek Ripe Black Olives | Azospira oryzae |
| SBP00130 | Greek Ripe Black Olives | Azospirillum brasilense |
| SBP00130 | Greek Ripe Black Olives | Azospirillum brasilense |
| SBP00130 | Greek Ripe Black Olives | Azospirillum lipoferum |
| SBP00130 | Greek Ripe Black Olives | Azospirillum lipoferum |
| SBP00130 | Greek Ripe Black Olives | Azospiritlum sp. TSA2s |
| SBP00130 | Greek Ripe Black Olives | Azospirillum sp. TSA2s |
| SBP00130 | Greek Ripe Black Olives | Azospirillum sp. TSH100 |
| SBP00130 | Greek Ripe Black Olives | Azospirillum sp. TSH100 |
| SBP00130 | Greek Ripe Black Olives | Azospirillum sp. TSH58 |
| SBP00130 | Greek Ripe Black Olives | Azospirillum sp. TSH58 |
| SBP00130 | Greek Ripe Black Olives | Azotobacter chroococcum |
| SBP00130 | Greek Ripe Black Olives | Azotobacter chroococcum |
| SBP00130 | Greek Ripe Black Olives | Azotobacter vinelandii |
| SBP00130 | Greek Ripe Black Olives | Azotobacter vinelandii |
| SBP00130 | Greek Ripe Black Olives | Bacillus altitudinis |
| SBP00130 | Greek Ripe Black Olives | Bacillus altitudinis |
| SBP00130 | Greek Ripe Black Olives | Bacillus cereus |
| SBP00130 | Greek Ripe Black Olives | Bacillus cereus |
| SBP00130 | Greek Ripe Black Olives | Bacillus paralicheniformis |
| SBP00130 | Greek Ripe Black Olives | Bacillus paralicheniformis |
| SBP00130 | Greek Ripe Black Olives | Bacillus pumilus |
| SBP00130 | Greek Ripe Black Olives | Bacillus pumilus |
| SBP00130 | Greek Ripe Black Olives | Bacillus safensis |
| SBP00130 | Greek Ripe Black Olives | Bacillus safensis |
| SBP00130 | Greek Ripe Black Olives | Bacillus sp. OxB-1 |
| SBP00130 | Greek Ripe Black Olives | Bacillus sp. OxB-1 |
| SBP00130 | Greek Ripe Black Olives | Bacillus subtilis |
| SBP00130 | Greek Ripe Black Olives | Bacillus subtilis |
| SBP00130 | Greek Ripe Black Olives | Bacterioplanes sanyensis |
| SBP00130 | Greek Ripe Black Olives | Bacterioplanes sanyensis |
| SBP00130 | Greek Ripe Black Olives | Bacteroides fragilis |
| SBP00130 | Greek Ripe Black Olives | Bacteroides fragilis |
| SBP00130 | Greek Ripe Black Olives | Bacteroides heparinolyticus |
| SBP00130 | Greek Ripe Black Olives | Bacteroides heparinolyticus |
| SBP00130 | Greek Ripe Black Olives | Bdellovibrio bacteriovorus |
| SBP00130 | Greek Ripe Black Olives | Bdellovibrio bacteriovorus |
| SBP00130 | Greek Ripe Black Olives | Beijerinckia indica |
| SBP00130 | Greek Ripe Black Olives | Beijerinckia indica |
| SBP00130 | Greek Ripe Black Olives | Bibersteinia trehalosi |
| SBP00130 | Greek Ripe Black Olives | Bibersteinia trehalosi |
| SBP00130 | Greek Ripe Black Olives | Bifidobacterium pseudocatenulatum |
| SBP00130 | Greek Ripe Black Olives | Bifidobacterium pseudocatenulatum |
| SBP00130 | Greek Ripe Black Olives | Bifidobacterium scardovii |
| SBP00130 | Greek Ripe Black Olives | Bifidobacterium scardovii |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Blastomonas* sp. RAC04 |
| SBP00130 | Greek Ripe Black Olives | *Blastomonas* sp. RAC04 |
| SBP00130 | Greek Ripe Black Olives | *Blautia producta* |
| SBP00130 | Greek Ripe Black Olives | *Blautia producta* |
| SBP00130 | Greek Ripe Black Olives | *Bordetella avium* |
| SBP00130 | Greek Ripe Black Olives | *Bordetella avium* |
| SBP00130 | Greek Ripe Black Olives | *Bordetella flabilis* |
| SBP00130 | Greek Ripe Black Olives | *Bordetella flabilis* |
| SBP00130 | Greek Ripe Black Olives | *Bordetella* genomosp. 13 |
| SBP00130 | Greek Ripe Black Olives | *Bordetella* genomosp. 13 |
| SBP00130 | Greek Ripe Black Olives | *Bordetella* genomosp. 8 |
| SBP00130 | Greek Ripe Black Olives | *Bordetella* genomosp. 8 |
| SBP00130 | Greek Ripe Black Olives | *Bordetella* genomosp. 9 |
| SBP00130 | Greek Ripe Black Olives | *Bordetella* genomosp. 9 |
| SBP00130 | Greek Ripe Black Olives | *Bordetella hinzii* |
| SBP00130 | Greek Ripe Black Olives | *Bordetella hinzii* |
| SBP00130 | Greek Ripe Black Olives | *Bordetella holmesii* |
| SBP00130 | Greek Ripe Black Olives | *Bordetella holmesii* |
| SBP00130 | Greek Ripe Black Olives | *Bordetella petrii* |
| SBP00130 | Greek Ripe Black Olives | *Bordetella petrii* |
| SBP00130 | Greek Ripe Black Olives | *Bordetella pseudohinzii* |
| SBP00130 | Greek Ripe Black Olives | *Bordetella pseudohinzii* |
| SBP00130 | Greek Ripe Black Olives | *Bordetella* sp. H567 |
| SBP00130 | Greek Ripe Black Olives | *Bordetella* sp. H567 |
| SBP00130 | Greek Ripe Black Olives | *Bordetella* sp. N |
| SBP00130 | Greek Ripe Black Olives | *Bordetella* sp. N |
| SBP00130 | Greek Ripe Black Olives | *Bordetella trematum* |
| SBP00130 | Greek Ripe Black Olives | *Bordetella trematum* |
| SBP00130 | Greek Ripe Black Olives | *Bosea* sp. AS-1 |
| SBP00130 | Greek Ripe Black Olives | *Bosea* sp. AS-1 |
| SBP00130 | Greek Ripe Black Olives | *Bosea* sp. PAMC 26642 |
| SBP00130 | Greek Ripe Black Olives | *Bosea* sp. PAMC 26642 |
| SBP00130 | Greek Ripe Black Olives | *Bosea* sp. RAC05 |
| SBP00130 | Greek Ripe Black Olives | *Bosea* sp. RAC05 |
| SBP00130 | Greek Ripe Black Olives | *Bosea* sp. Tri-49 |
| SBP00130 | Greek Ripe Black Olives | *Bosea* sp. Tri-49 |
| SBP00130 | Greek Ripe Black Olives | *Bosea vaviloviae* |
| SBP00130 | Greek Ripe Black Olives | *Bosea vaviloviae* |
| SBP00130 | Greek Ripe Black Olives | *Bradymonas sediminis* |
| SBP00130 | Greek Ripe Black Olives | *Bradymonas sediminis* |
| SBP00130 | Greek Ripe Black Olives | *Bradyrhizobium diazoefficiens* |
| SBP00130 | Greek Ripe Black Olives | *Bradyrhizobium diazoefficiens* |
| SBP00130 | Greek Ripe Black Olives | *Bradyrhizobium erythrophlei* |
| SBP00130 | Greek Ripe Black Olives | *Bradyrhizobium erythrophlei* |
| SBP00130 | Greek Ripe Black Olives | *Bradyrhizobium guangdongense* |
| SBP00130 | Greek Ripe Black Olives | *Bradyrhizobium guangdongense* |
| SBP00130 | Greek Ripe Black Olives | *Bradyrhizobium guangxiense* |
| SBP00130 | Greek Ripe Black Olives | *Bradyrhizobium guangxiense* |
| SBP00130 | Greek Ripe Black Olives | *Bradyrhizobium icense* |
| SBP00130 | Greek Ripe Black Olives | *Bradyrhizobium icense* |
| SBP00130 | Greek Ripe Black Olives | *Bradyrhizobium japonicum* |
| SBP00130 | Greek Ripe Black Olives | *Bradyrhizobium japonicum* |
| SBP00130 | Greek Ripe Black Olives | *Bradyrhizobium lablabi* |
| SBP00130 | Greek Ripe Black Olives | *Bradyrhizobium lablabi* |
| SBP00130 | Greek Ripe Black Olives | *Bradyrhizobium oligotrophicum* |
| SBP00130 | Greek Ripe Black Olives | *Bradyrhizobium oligotrophicum* |
| SBP00130 | Greek Ripe Black Olives | *Bradyrhizobium ottawaense* |
| SBP00130 | Greek Ripe Black Olives | *Bradyrhizobium ottawaense* |
| SBP00130 | Greek Ripe Black Olives | *Bradyrhizobium* sp. |
| SBP00130 | Greek Ripe Black Olives | *Bradyrhizobium* sp. |
| SBP00130 | Greek Ripe Black Olives | *Bradyrhizobium* sp. 2 3951MB |
| SBP00130 | Greek Ripe Black Olives | *Bradyrhizobium* sp. 2 3951MB |
| SBP00130 | Greek Ripe Black Olives | *Bradyrhizobium* sp. BTAi1 |
| SBP00130 | Greek Ripe Black Olives | *Bradyrhizobium* sp. BTAi1 |
| SBP00130 | Greek Ripe Black Olives | *Bradyrhizobium* sp. CCBAU 51670 |
| SBP00130 | Greek Ripe Black Olives | *Bradyrhizobium* sp. CCBAU 51670 |
| SBP00130 | Greek Ripe Black Olives | *Bradyrhizobium* sp. CCBAU 51778 |
| SBP00130 | Greek Ripe Black Olives | *Bradyrhizobium* sp. CCBAU 51778 |
| SBP00130 | Greek Ripe Black Olives | *Bradyrhizobium* sp. CCGE-LA001 |
| SBP00130 | Greek Ripe Black Olives | *Bradyrhizobium* sp. CCGE-LA001 |
| SBP00130 | Greek Ripe Black Olives | *Bradyrhizobium* sp. ORS 278 |
| SBP00130 | Greek Ripe Black Olives | *Bradyrhizobium* sp. ORS 278 |
| SBP00130 | Greek Ripe Black Olives | *Bradyrhizobium* sp. ORS 285 |
| SBP00130 | Greek Ripe Black Olives | *Bradyrhizobium* sp. ORS 285 |
| SBP00130 | Greek Ripe Black Olives | *Bradyrhizobium* sp. ORS 3257 |
| SBP00130 | Greek Ripe Black Olives | *Bradyrhizobium* sp. ORS 3257 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Bradyrhizobium* sp. S23321 |
| SBP00130 | Greek Ripe Black Olives | *Bradyrhizobium* sp. S23321 |
| SBP00130 | Greek Ripe Black Olives | *Bradyrhizobium* sp. SK17 |
| SBP00130 | Greek Ripe Black Olives | *Bradyrhizobium* sp. SK17 |
| SBP00130 | Greek Ripe Black Olives | *Bradyrhizobium* sp. WSM471 |
| SBP00130 | Greek Ripe Black Olives | *Bradyrhizobium* sp. WSM471 |
| SBP00130 | Greek Ripe Black Olives | *Brenneria goodwinii* |
| SBP00130 | Greek Ripe Black Olives | *Brenneria goodwinii* |
| SBP00130 | Greek Ripe Black Olives | *Brenneria rubrifaciens* |
| SBP00130 | Greek Ripe Black Olives | *Brenneria rubrifaciens* |
| SBP00130 | Greek Ripe Black Olives | *Brenneria* sp. EniD312 |
| SBP00130 | Greek Ripe Black Olives | *Brenneria* sp. EniD312 |
| SBP00130 | Greek Ripe Black Olives | *Brevibacillus brevis* |
| SBP00130 | Greek Ripe Black Olives | *Brevibacillus brevis* |
| SBP00130 | Greek Ripe Black Olives | *Brevundimonas diminuta* |
| SBP00130 | Greek Ripe Black Olives | *Brevundimonas diminuta* |
| SBP00130 | Greek Ripe Black Olives | *Brevundimonas naejangsanensis* |
| SBP00130 | Greek Ripe Black Olives | *Brevundimonas naejangsanensis* |
| SBP00130 | Greek Ripe Black Olives | *Brochothrix thermosphacta* |
| SBP00130 | Greek Ripe Black Olives | *Brochothrix thermosphacta* |
| SBP00130 | Greek Ripe Black Olives | *Burkholderia ambifaria* |
| SBP00130 | Greek Ripe Black Olives | *Burkholderia ambifaria* |
| SBP00130 | Greek Ripe Black Olives | *Burkholderia cenocepacia* |
| SBP00130 | Greek Ripe Black Olives | *Burkholderia cenocepacia* |
| SBP00130 | Greek Ripe Black Olives | *Burkholderia cepacia* |
| SBP00130 | Greek Ripe Black Olives | *Burkholderia cepacia* |
| SBP00130 | Greek Ripe Black Olives | *Burkholderia contaminans* |
| SBP00130 | Greek Ripe Black Olives | *Burkholderia contaminans* |
| SBP00130 | Greek Ripe Black Olives | *Burkholderia diffusa* |
| SBP00130 | Greek Ripe Black Olives | *Burkholderia diffusa* |
| SBP00130 | Greek Ripe Black Olives | *Burkholderia gladioli* |
| SBP00130 | Greek Ripe Black Olives | *Burkholderia gladioli* |
| SBP00130 | Greek Ripe Black Olives | *Burkholderia insecticola* |
| SBP00130 | Greek Ripe Black Olives | *Burkholderia insecticola* |
| SBP00130 | Greek Ripe Black Olives | *Burkholderia lata* |
| SBP00130 | Greek Ripe Black Olives | *Burkholderia lata* |
| SBP00130 | Greek Ripe Black Olives | *Burkholderia metallica* |
| SBP00130 | Greek Ripe Black Olives | *Burkholderia metallica* |
| SBP00130 | Greek Ripe Black Olives | *Burkholderia multivorans* |
| SBP00130 | Greek Ripe Black Olives | *Burkholderia multivorans* |
| SBP00130 | Greek Ripe Black Olives | *Burkholderia pseudomallei* |
| SBP00130 | Greek Ripe Black Olives | *Burkholderia pseudomallei* |
| SBP00130 | Greek Ripe Black Olives | *Burkholderia pyrrocinia* |
| SBP00130 | Greek Ripe Black Olives | *Burkholderia pyrrocinia* |
| SBP00130 | Greek Ripe Black Olives | *Burkholderia* sp. CCGE1002 |
| SBP00130 | Greek Ripe Black Olives | *Burkholderia* sp. CCGE1002 |
| SBP00130 | Greek Ripe Black Olives | *Burkholderia* sp. CCGE1003 |
| SBP00130 | Greek Ripe Black Olives | *Burkholderia* sp. CCGE1003 |
| SBP00130 | Greek Ripe Black Olives | *Burkholderia* sp. IDO3 |
| SBP00130 | Greek Ripe Black Olives | *Burkholderia* sp. IDO3 |
| SBP00130 | Greek Ripe Black Olives | *Burkholderia* sp. KK1 |
| SBP00130 | Greek Ripe Black Olives | *Burkholderia* sp. KK1 |
| SBP00130 | Greek Ripe Black Olives | *Burkholderia* sp. MSMB0856 |
| SBP00130 | Greek Ripe Black Olives | *Burkholderia* sp. MSMB0856 |
| SBP00130 | Greek Ripe Black Olives | *Burkholderia* sp. OLGA172 |
| SBP00130 | Greek Ripe Black Olives | *Burkholderia* sp. OLGA172 |
| SBP00130 | Greek Ripe Black Olives | *Burkholderia* sp. PAMC 26561 |
| SBP00130 | Greek Ripe Black Olives | *Burkholderia* sp. PAMC 26561 |
| SBP00130 | Greek Ripe Black Olives | *Burkholderia* sp. RPE67 |
| SBP00130 | Greek Ripe Black Olives | *Burkholderia* sp. RPE67 |
| SBP00130 | Greek Ripe Black Olives | *Burkholderia* sp. YI23 |
| SBP00130 | Greek Ripe Black Olives | *Burkholderia* sp. YI23 |
| SBP00130 | Greek Ripe Black Olives | *Burkholderia stabilis* |
| SBP00130 | Greek Ripe Black Olives | *Burkholderia stabilis* |
| SBP00130 | Greek Ripe Black Olives | *Burkholderia stagnalis* |
| SBP00130 | Greek Ripe Black Olives | *Burkholderia stagnalis* |
| SBP00130 | Greek Ripe Black Olives | *Burkholderia territorii* |
| SBP00130 | Greek Ripe Black Olives | *Burkholderia territorii* |
| SBP00130 | Greek Ripe Black Olives | *Burkholderia thailandensis* |
| SBP00130 | Greek Ripe Black Olives | *Burkholderia thailandensis* |
| SBP00130 | Greek Ripe Black Olives | *Burkholderia ubonensis* |
| SBP00130 | Greek Ripe Black Olives | *Burkholderia ubonensis* |
| SBP00130 | Greek Ripe Black Olives | *Burkholderia vietnamiensis* |
| SBP00130 | Greek Ripe Black Olives | *Burkholderia vietnamiensis* |
| SBP00130 | Greek Ripe Black Olives | *Burkholderiales bacterium* GJ-E10 |
| SBP00130 | Greek Ripe Black Olives | *Burkholderiales bacterium* GJ-E10 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Burkholderiales bacterium* JOSHI_001 |
| SBP00130 | Greek Ripe Black Olives | *Burkholderiales bacterium* JOSHI_001 |
| SBP00130 | Greek Ripe Black Olives | *Buttiauxella* sp. 3AFRM03 |
| SBP00130 | Greek Ripe Black Olives | *Buttiauxella* sp. 3AFRM03 |
| SBP00130 | Greek Ripe Black Olives | *Caldicellulosiruptor saccharolyticus* |
| SBP00130 | Greek Ripe Black Olives | *Caldicellulosiruptor saccharolyticus* |
| SBP00130 | Greek Ripe Black Olives | *Candidatus Fukatsuia symbiotica* |
| SBP00130 | Greek Ripe Black Olives | *Candidatus Fukatsuia symbiotica* |
| SBP00130 | Greek Ripe Black Olives | *Candidatus Promineofilum breve* |
| SBP00130 | Greek Ripe Black Olives | *Candidatus Promineofilum breve* |
| SBP00130 | Greek Ripe Black Olives | *Candidatus Pseudomonas adelgestsugas* |
| SBP00130 | Greek Ripe Black Olives | *Candidatus Pseudomonas adelgestsugas* |
| SBP00130 | Greek Ripe Black Olives | *Candidatus Rhodoluna limnophila* |
| SBP00130 | Greek Ripe Black Olives | *Candidatus Rhodoluna limnophila* |
| SBP00130 | Greek Ripe Black Olives | *Candidatus Sodalis pierantonius* |
| SBP00130 | Greek Ripe Black Olives | *Candidatus Sodalis pierantonius* |
| SBP00130 | Greek Ripe Black Olives | *Candidatus Thiodictyon syntrophicum* |
| SBP00130 | Greek Ripe Black Olives | *Candidatus Thiodictyon syntrophicum* |
| SBP00130 | Greek Ripe Black Olives | *Cardiobacterium hominis* |
| SBP00130 | Greek Ripe Black Olives | *Cardiobacterium hominis* |
| SBP00130 | Greek Ripe Black Olives | *Carnobacterium divergens* |
| SBP00130 | Greek Ripe Black Olives | *Carnobacterium divergens* |
| SBP00130 | Greek Ripe Black Olives | *Carnobacterium inhibens* |
| SBP00130 | Greek Ripe Black Olives | *Carnobacterium inhibens* |
| SBP00130 | Greek Ripe Black Olives | *Carnobacterium maltaromaticum* |
| SBP00130 | Greek Ripe Black Olives | *Carnobacterium maltaromaticum* |
| SBP00130 | Greek Ripe Black Olives | *Carnobacterium* sp. 17-4 |
| SBP00130 | Greek Ripe Black Olives | *Carnobacterium* sp. 17-4 |
| SBP00130 | Greek Ripe Black Olives | *Castellaniella defragrans* |
| SBP00130 | Greek Ripe Black Olives | *Castellaniella defragrans* |
| SBP00130 | Greek Ripe Black Olives | *Catenovulum* sp. CCB-QB4 |
| SBP00130 | Greek Ripe Black Olives | *Catenovulum* sp. CCB-QB4 |
| SBP00130 | Greek Ripe Black Olives | *Catenulispora acidiphila* |
| SBP00130 | Greek Ripe Black Olives | *Catenulispora acidiphila* |
| SBP00130 | Greek Ripe Black Olives | *Caulobacter flavus* |
| SBP00130 | Greek Ripe Black Olives | *Caulobacter flavus* |
| SBP00130 | Greek Ripe Black Olives | *Caulobacter segnis* |
| SBP00130 | Greek Ripe Black Olives | *Caulobacter segnis* |
| SBP00130 | Greek Ripe Black Olives | *Caulobacter* sp. K31 |
| SBP00130 | Greek Ripe Black Olives | *Caulobacter* sp. K31 |
| SBP00130 | Greek Ripe Black Olives | *Caulobacter vibrioides* |
| SBP00130 | Greek Ripe Black Olives | *Caulobacter vibrioides* |
| SBP00130 | Greek Ripe Black Olives | *Caulobacteraceae bacterium* OTSz_A_272 |
| SBP00130 | Greek Ripe Black Olives | *Caulobacteraceae bacterium* OTSz_A_272 |
| SBP00130 | Greek Ripe Black Olives | *Cedecea lapagei* |
| SBP00130 | Greek Ripe Black Olives | *Cedecea lapagei* |
| SBP00130 | Greek Ripe Black Olives | *Cedecea neteri* |
| SBP00130 | Greek Ripe Black Olives | *Cedecea neteri* |
| SBP00130 | Greek Ripe Black Olives | *Celeribacter manganoxidans* |
| SBP00130 | Greek Ripe Black Olives | *Celeribacter manganoxidans* |
| SBP00130 | Greek Ripe Black Olives | *Cellvibrio japonicus* |
| SBP00130 | Greek Ripe Black Olives | *Cellvibrio japonicus* |
| SBP00130 | Greek Ripe Black Olives | *Cellvibrio* sp. PSBB006 |
| SBP00130 | Greek Ripe Black Olives | *Cellvibrio* sp. PSBB006 |
| SBP00130 | Greek Ripe Black Olives | *Cellvibrio* sp. PSBB023 |
| SBP00130 | Greek Ripe Black Olives | *Cellvibrio* sp. PSBB023 |
| SBP00130 | Greek Ripe Black Olives | *Chania multitudinisentens* |
| SBP00130 | Greek Ripe Black Olives | *Chania multitudinisentens* |
| SBP00130 | Greek Ripe Black Olives | *Chelatococcus* sp. CO-6 |
| SBP00130 | Greek Ripe Black Olives | *Chelatococcus* sp. CO-6 |
| SBP00130 | Greek Ripe Black Olives | *Chitinophaga pinensis* |
| SBP00130 | Greek Ripe Black Olives | *Chitinophaga pinensis* |
| SBP00130 | Greek Ripe Black Olives | *Chondrocystis* sp. NIES-4102 |
| SBP00130 | Greek Ripe Black Olives | *Chondrocystis* sp. NIES-4102 |
| SBP00130 | Greek Ripe Black Olives | *Chromatiaceae bacterium* 2141T.STBD.0c.01a |
| SBP00130 | Greek Ripe Black Olives | *Chromatiaceae bacterium* 2141T.STBD.0c.01a |
| SBP00130 | Greek Ripe Black Olives | *Chromobacterium rhizoryzae* |
| SBP00130 | Greek Ripe Black Olives | *Chromobacterium rhizoryzae* |
| SBP00130 | Greek Ripe Black Olives | *Chromobacterium* sp. IIBBL 274-1 |
| SBP00130 | Greek Ripe Black Olives | *Chromobacterium* sp. IIBBL 274-1 |
| SBP00130 | Greek Ripe Black Olives | *Chromobacterium vaccinii* |
| SBP00130 | Greek Ripe Black Olives | *Chromobacterium vaccinii* |
| SBP00130 | Greek Ripe Black Olives | *Chromohalobacter salexigens* |
| SBP00130 | Greek Ripe Black Olives | *Chromohalobacter salexigens* |
| SBP00130 | Greek Ripe Black Olives | *Chryseobacterium camelliae* |
| SBP00130 | Greek Ripe Black Olives | *Chryseobacterium camelliae* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Citrobacter amalonaticus* |
| SBP00130 | Greek Ripe Black Olives | *Citrobacter amalonaticus* |
| SBP00130 | Greek Ripe Black Olives | *Citrobacter braakii* |
| SBP00130 | Greek Ripe Black Olives | *Citrobacter braakii* |
| SBP00130 | Greek Ripe Black Olives | *Citrobacter freundii* |
| SBP00130 | Greek Ripe Black Olives | *Citrobacter freundii* |
| SBP00130 | Greek Ripe Black Olives | *Citrobacter freundii* complex sp. CFNIH3 |
| SBP00130 | Greek Ripe Black Olives | *Citrobacter freundii* complex sp. CFNIH3 |
| SBP00130 | Greek Ripe Black Olives | *Citrobacter koseri* |
| SBP00130 | Greek Ripe Black Olives | *Citrobacter koseri* |
| SBP00130 | Greek Ripe Black Olives | *Citrobacter rodentium* |
| SBP00130 | Greek Ripe Black Olives | *Citrobacter rodentium* |
| SBP00130 | Greek Ripe Black Olives | *Citrobacter werkmanii* |
| SBP00130 | Greek Ripe Black Olives | *Citrobacter werkmanii* |
| SBP00130 | Greek Ripe Black Olives | *Citrobacter youngae* |
| SBP00130 | Greek Ripe Black Olives | *Citrobacter youngae* |
| SBP00130 | Greek Ripe Black Olives | *Clostridium chauvoei* |
| SBP00130 | Greek Ripe Black Olives | *Clostridium chauvoei* |
| SBP00130 | Greek Ripe Black Olives | *Clostridium perfringens* |
| SBP00130 | Greek Ripe Black Olives | *Clostridium perfringens* |
| SBP00130 | Greek Ripe Black Olives | *Cnuibacter physcomitrellae* |
| SBP00130 | Greek Ripe Black Olives | *Cnuibacter physcomitrellae* |
| SBP00130 | Greek Ripe Black Olives | *Cobetia marina* |
| SBP00130 | Greek Ripe Black Olives | *Cobetia marina* |
| SBP00130 | Greek Ripe Black Olives | *Collimonas arenae* |
| SBP00130 | Greek Ripe Black Olives | *Collimonas arenae* |
| SBP00130 | Greek Ripe Black Olives | *Collimonas fungivorans* |
| SBP00130 | Greek Ripe Black Olives | *Collimonas fungivorans* |
| SBP00130 | Greek Ripe Black Olives | *Collimonas pratensis* |
| SBP00130 | Greek Ripe Black Olives | *Collimonas pratensis* |
| SBP00130 | Greek Ripe Black Olives | *Colwellia* sp. PAMC 20917 |
| SBP00130 | Greek Ripe Black Olives | *Colwellia* sp. PAMC 20917 |
| SBP00130 | Greek Ripe Black Olives | *Comamonas aquatica* |
| SBP00130 | Greek Ripe Black Olives | *Comamonas aquatica* |
| SBP00130 | Greek Ripe Black Olives | *Comamonas kerstersii* |
| SBP00130 | Greek Ripe Black Olives | *Comamonas kerstersii* |
| SBP00130 | Greek Ripe Black Olives | *Comamonas serinivorans* |
| SBP00130 | Greek Ripe Black Olives | *Comamonas serinivorans* |
| SBP00130 | Greek Ripe Black Olives | *Comamonas terrigena* |
| SBP00130 | Greek Ripe Black Olives | *Comamonas terrigena* |
| SBP00130 | Greek Ripe Black Olives | *Comamonas testosteroni* |
| SBP00130 | Greek Ripe Black Olives | *Comamonas testosteroni* |
| SBP00130 | Greek Ripe Black Olives | *Comamonas thiooxydans* |
| SBP00130 | Greek Ripe Black Olives | *Comamonas thiooxydans* |
| SBP00130 | Greek Ripe Black Olives | *Congregibacter litoralis* |
| SBP00130 | Greek Ripe Black Olives | *Congregibacter litoralis* |
| SBP00130 | Greek Ripe Black Olives | *Corallococcus coralloides* |
| SBP00130 | Greek Ripe Black Olives | *Corallococcus coralloides* |
| SBP00130 | Greek Ripe Black Olives | *Coriobacteriaceae bacterium* 68-1-3 |
| SBP00130 | Greek Ripe Black Olives | *Coriobacteriaceae bacterium* 68-1-3 |
| SBP00130 | Greek Ripe Black Olives | *Corynebacterium imitans* |
| SBP00130 | Greek Ripe Black Olives | *Corynebacterium imitans* |
| SBP00130 | Greek Ripe Black Olives | *Corynebacterium terpenotabidum* |
| SBP00130 | Greek Ripe Black Olives | *Corynebacterium terpenotabidum* |
| SBP00130 | Greek Ripe Black Olives | *Corynebacterium ureicelerivorans* |
| SBP00130 | Greek Ripe Black Olives | *Corynebacterium ureicelerivorans* |
| SBP00130 | Greek Ripe Black Olives | *Coxiella burnetii* |
| SBP00130 | Greek Ripe Black Olives | *Coxiella burnetii* |
| SBP00130 | Greek Ripe Black Olives | *Cronobacter condimenti* |
| SBP00130 | Greek Ripe Black Olives | *Cronobacter condimenti* |
| SBP00130 | Greek Ripe Black Olives | *Cronobacter dublinensis* |
| SBP00130 | Greek Ripe Black Olives | *Cronobacter dublinensis* |
| SBP00130 | Greek Ripe Black Olives | *Cronobacter malonaticus* |
| SBP00130 | Greek Ripe Black Olives | *Cronobacter malonaticus* |
| SBP00130 | Greek Ripe Black Olives | *Cronobacter muytjensii* |
| SBP00130 | Greek Ripe Black Olives | *Cronobacter muytjensii* |
| SBP00130 | Greek Ripe Black Olives | *Cronobacter sakazakii* |
| SBP00130 | Greek Ripe Black Olives | *Cronobacter sakazakii* |
| SBP00130 | Greek Ripe Black Olives | *Cronobacter turicensis* |
| SBP00130 | Greek Ripe Black Olives | *Cronobacter turicensis* |
| SBP00130 | Greek Ripe Black Olives | *Cryobacterium* sp. LW097 |
| SBP00130 | Greek Ripe Black Olives | *Cryobacterium* sp. LW097 |
| SBP00130 | Greek Ripe Black Olives | *Cryptobacterium curtum* |
| SBP00130 | Greek Ripe Black Olives | *Cryptobacterium curtum* |
| SBP00130 | Greek Ripe Black Olives | *Cupriavidus basilensis* |
| SBP00130 | Greek Ripe Black Olives | *Cupriavidus basilensis* |

TABLE 3-continued

List of species identified in each metagenomic sample of each SBP Sample

| SBP ID | SBP Host Common Name | Genus sp. |
| --- | --- | --- |
| SBP00130 | Greek Ripe Black Olives | *Cupriavidus gilardii* |
| SBP00130 | Greek Ripe Black Olives | *Cupriavidus gilardii* |
| SBP00130 | Greek Ripe Black Olives | *Cupriavidus metallidurans* |
| SBP00130 | Greek Ripe Black Olives | *Cupriavidus metallidurans* |
| SBP00130 | Greek Ripe Black Olives | *Cupriavidus necator* |
| SBP00130 | Greek Ripe Black Olives | *Cupriavidus necator* |
| SBP00130 | Greek Ripe Black Olives | *Cupriavidus oxalaticus* |
| SBP00130 | Greek Ripe Black Olives | *Cupriavidus oxalaticus* |
| SBP00130 | Greek Ripe Black Olives | *Cupriavidus pauculus* |
| SBP00130 | Greek Ripe Black Olives | *Cupriavidus pauculus* |
| SBP00130 | Greek Ripe Black Olives | *Cupriavidus pinatubonensis* |
| SBP00130 | Greek Ripe Black Olives | *Cupriavidus pinatubonensis* |
| SBP00130 | Greek Ripe Black Olives | *Cupriavidus* sp. USMAHM13 |
| SBP00130 | Greek Ripe Black Olives | *Cupriavidus* sp. USMAHM13 |
| SBP00130 | Greek Ripe Black Olives | *Cupriavidus taiwanensis* |
| SBP00130 | Greek Ripe Black Olives | *Cupriavidus taiwanensis* |
| SBP00130 | Greek Ripe Black Olives | *Curvibacter* sp. AEP1-3 |
| SBP00130 | Greek Ripe Black Olives | *Curvibacter* sp. AEP1-3 |
| SBP00130 | Greek Ripe Black Olives | *Cutibacterium acnes* |
| SBP00130 | Greek Ripe Black Olives | *Cutibacterium acnes* |
| SBP00130 | Greek Ripe Black Olives | *Cystobacter fuscus* |
| SBP00130 | Greek Ripe Black Olives | *Cystobacter fuscus* |
| SBP00130 | Greek Ripe Black Olives | *Dechloromonas aromatica* |
| SBP00130 | Greek Ripe Black Olives | *Dechloromonas aromatica* |
| SBP00130 | Greek Ripe Black Olives | *Deinococcus actinosclerus* |
| SBP00130 | Greek Ripe Black Olives | *Deinococcus actinosclerus* |
| SBP00130 | Greek Ripe Black Olives | *Deinococcus peraridilitoris* |
| SBP00130 | Greek Ripe Black Olives | *Deinococcus peraridilitoris* |
| SBP00130 | Greek Ripe Black Olives | *Delftia* sp. |
| SBP00130 | Greek Ripe Black Olives | *Delftia* sp. |
| SBP00130 | Greek Ripe Black Olives | *Delftia tsuruhatensis* |
| SBP00130 | Greek Ripe Black Olives | *Delftia tsuruhatensis* |
| SBP00130 | Greek Ripe Black Olives | *Desulfobacula toluolica* |
| SBP00130 | Greek Ripe Black Olives | *Desulfobacula toluolica* |
| SBP00130 | Greek Ripe Black Olives | *Desulfohalobium retbaense* |
| SBP00130 | Greek Ripe Black Olives | *Desulfohalobium retbaense* |
| SBP00130 | Greek Ripe Black Olives | *Desulfotomaculum reducens* |
| SBP00130 | Greek Ripe Black Olives | *Desulfotomaculum reducens* |
| SBP00130 | Greek Ripe Black Olives | *Desulfurispirillum indicum* |
| SBP00130 | Greek Ripe Black Olives | *Desulfurispirillum indicum* |
| SBP00130 | Greek Ripe Black Olives | *Devosia* sp. A16 |
| SBP00130 | Greek Ripe Black Olives | *Devosia* sp. A16 |
| SBP00130 | Greek Ripe Black Olives | *Devosia* sp. H5989 |
| SBP00130 | Greek Ripe Black Olives | *Devosia* sp. H5989 |
| SBP00130 | Greek Ripe Black Olives | *Dialister* sp. Marseille-P5638 |
| SBP00130 | Greek Ripe Black Olives | *Dialister* sp. Marseille-P5638 |
| SBP00130 | Greek Ripe Black Olives | *Dichelobacter nodosus* |
| SBP00130 | Greek Ripe Black Olives | *Dichelobacter nodosus* |
| SBP00130 | Greek Ripe Black Olives | *Dickeya chrysanthemi* |
| SBP00130 | Greek Ripe Black Olives | *Dickeya chrysanthemi* |
| SBP00130 | Greek Ripe Black Olives | *Dickeya dadantii* |
| SBP00130 | Greek Ripe Black Olives | *Dickeya dadantii* |
| SBP00130 | Greek Ripe Black Olives | *Dickeya dianthicola* |
| SBP00130 | Greek Ripe Black Olives | *Dickeya dianthicola* |
| SBP00130 | Greek Ripe Black Olives | *Dickeya fangzhongdai* |
| SBP00130 | Greek Ripe Black Olives | *Dickeya fangzhongdai* |
| SBP00130 | Greek Ripe Black Olives | *Dickeya paradisiaca* |
| SBP00130 | Greek Ripe Black Olives | *Dickeya paradisiaca* |
| SBP00130 | Greek Ripe Black Olives | *Dickeya solani* |
| SBP00130 | Greek Ripe Black Olives | *Dickeya solani* |
| SBP00130 | Greek Ripe Black Olives | *Dickeya* sp. NCPPB 569 |
| SBP00130 | Greek Ripe Black Olives | *Dickeya* sp. NCPPB 569 |
| SBP00130 | Greek Ripe Black Olives | *Dickeya* sp. Secpp 1600 |
| SBP00130 | Greek Ripe Black Olives | *Dickeya* sp. Secpp 1600 |
| SBP00130 | Greek Ripe Black Olives | *Dickeya zeae* |
| SBP00130 | Greek Ripe Black Olives | *Dickeya zeae* |
| SBP00130 | Greek Ripe Black Olives | *Dinoroseobacter shibae* |
| SBP00130 | Greek Ripe Black Olives | *Dinoroseobacter shibae* |
| SBP00130 | Greek Ripe Black Olives | *Diptera* sp. BOLD: AAB3286 |
| SBP00130 | Greek Ripe Black Olives | *Diptera* sp. BOLD: AAB3286 |
| SBP00130 | Greek Ripe Black Olives | *Dyella* sp. M7H15-1 |
| SBP00130 | Greek Ripe Black Olives | *Dyella* sp. M7H15-1 |
| SBP00130 | Greek Ripe Black Olives | *Ectothiorhodospira haloalkaliphila* |
| SBP00130 | Greek Ripe Black Olives | *Ectothiorhodospira haloalkaliphila* |
| SBP00130 | Greek Ripe Black Olives | *Edwardsiella hoshinae* |
| SBP00130 | Greek Ripe Black Olives | *Edwardsiella hoshinae* |

TABLE 3-continued

List of species identified in each metagenomic sample of each SBP Sample

| SBP ID | SBP Host Common Name | Genus sp. |
| --- | --- | --- |
| SBP00130 | Greek Ripe Black Olives | *Edwardsiella ictaluri* |
| SBP00130 | Greek Ripe Black Olives | *Edwardsiella ictaluri* |
| SBP00130 | Greek Ripe Black Olives | *Edwardsiella tarda* |
| SBP00130 | Greek Ripe Black Olives | *Edwardsiella tarda* |
| SBP00130 | Greek Ripe Black Olives | *Egibacter rhizosphaerae* |
| SBP00130 | Greek Ripe Black Olives | *Egibacter rhizosphaerae* |
| SBP00130 | Greek Ripe Black Olives | *Endozoicomonas montiporae* |
| SBP00130 | Greek Ripe Black Olives | *Endozoicomonas montiporae* |
| SBP00130 | Greek Ripe Black Olives | *Ensifer adhaerens* |
| SBP00130 | Greek Ripe Black Olives | *Ensifer adhaerens* |
| SBP00130 | Greek Ripe Black Olives | *Enterobacter asburiae* |
| SBP00130 | Greek Ripe Black Olives | *Enterobacter asburiae* |
| SBP00130 | Greek Ripe Black Olives | *Enterobacter bugandensis* |
| SBP00130 | Greek Ripe Black Olives | *Enterobacter bugandensis* |
| SBP00130 | Greek Ripe Black Olives | *Enterobacter cancerogenus* |
| SBP00130 | Greek Ripe Black Olives | *Enterobacter cancerogenus* |
| SBP00130 | Greek Ripe Black Olives | *Enterobacter cloacae* |
| SBP00130 | Greek Ripe Black Olives | *Enterobacter cloacae* |
| SBP00130 | Greek Ripe Black Olives | *Enterobacter cloacae* complex sp. |
| SBP00130 | Greek Ripe Black Olives | *Enterobacter cloacae* complex sp. |
| SBP00130 | Greek Ripe Black Olives | *Enterobacter cloacae* complex sp. ECNIH7 |
| SBP00130 | Greek Ripe Black Olives | *Enterobacter cloacae* complex sp. ECNIH7 |
| SBP00130 | Greek Ripe Black Olives | *Enterobacter hormaechei* |
| SBP00130 | Greek Ripe Black Olives | *Enterobacter hormaechei* |
| SBP00130 | Greek Ripe Black Olives | *Enterobacter kobei* |
| SBP00130 | Greek Ripe Black Olives | *Enterobacter kobei* |
| SBP00130 | Greek Ripe Black Olives | *Enterobacter ludwigii* |
| SBP00130 | Greek Ripe Black Olives | *Enterobacter ludwigii* |
| SBP00130 | Greek Ripe Black Olives | *Enterobacter phage Arya* |
| SBP00130 | Greek Ripe Black Olives | *Enterobacter phage Arya* |
| SBP00130 | Greek Ripe Black Olives | *Enterobacter roggenkampii* |
| SBP00130 | Greek Ripe Black Olives | *Enterobacter roggenkampii* |
| SBP00130 | Greek Ripe Black Olives | *Enterobacter soli* |
| SBP00130 | Greek Ripe Black Olives | *Enterobacter soli* |
| SBP00130 | Greek Ripe Black Olives | *Enterobacter* sp. 638 |
| SBP00130 | Greek Ripe Black Olives | *Enterobacter* sp. 638 |
| SBP00130 | Greek Ripe Black Olives | *Enterobacter* sp. FY-07 |
| SBP00130 | Greek Ripe Black Olives | *Enterobacter* sp. FY-07 |
| SBP00130 | Greek Ripe Black Olives | *Enterobacter* sp. N18-03635 |
| SBP00130 | Greek Ripe Black Olives | *Enterobacter* sp. N18-03635 |
| SBP00130 | Greek Ripe Black Olives | *Enterobacter* sp. R4-368 |
| SBP00130 | Greek Ripe Black Olives | *Enterobacter* sp. R4-368 |
| SBP00130 | Greek Ripe Black Olives | *Enterobacter* sp. SA187 |
| SBP00130 | Greek Ripe Black Olives | *Enterobacter* sp. SA187 |
| SBP00130 | Greek Ripe Black Olives | *Enterobacteriaceae bacterium* ENNIH1 |
| SBP00130 | Greek Ripe Black Olives | *Enterobacteriaceae bacterium* ENNIH1 |
| SBP00130 | Greek Ripe Black Olives | *Enterobacteriaceae bacterium* strain FGI 57 |
| SBP00130 | Greek Ripe Black Olives | *Enterobacteriaceae bacterium* strain FGI 57 |
| SBP00130 | Greek Ripe Black Olives | *Enterobacteriaceae bacterium* w6 |
| SBP00130 | Greek Ripe Black Olives | *Enterobacteriaceae bacterium* w6 |
| SBP00130 | Greek Ripe Black Olives | *Enterococcus avium* |
| SBP00130 | Greek Ripe Black Olives | *Enterococcus avium* |
| SBP00130 | Greek Ripe Black Olives | *Enterococcus casseliflavus* |
| SBP00130 | Greek Ripe Black Olives | *Enterococcus casseliflavus* |
| SBP00130 | Greek Ripe Black Olives | *Enterococcus durans* |
| SBP00130 | Greek Ripe Black Olives | *Enterococcus durans* |
| SBP00130 | Greek Ripe Black Olives | *Enterococcus faecalis* |
| SBP00130 | Greek Ripe Black Olives | *Enterococcus faecalis* |
| SBP00130 | Greek Ripe Black Olives | *Enterococcus faecium* |
| SBP00130 | Greek Ripe Black Olives | *Enterococcus faecium* |
| SBP00130 | Greek Ripe Black Olives | *Enterococcus gallinarum* |
| SBP00130 | Greek Ripe Black Olives | *Enterococcus gallinarum* |
| SBP00130 | Greek Ripe Black Olives | *Enterococcus gilvus* |
| SBP00130 | Greek Ripe Black Olives | *Enterococcus gilvus* |
| SBP00130 | Greek Ripe Black Olives | *Enterococcus mundtii* |
| SBP00130 | Greek Ripe Black Olives | *Enterococcus mundtii* |
| SBP00130 | Greek Ripe Black Olives | *Enterococcus* sp. CR-Ec1 |
| SBP00130 | Greek Ripe Black Olives | *Enterococcus* sp. CR-Ec1 |
| SBP00130 | Greek Ripe Black Olives | *Enterococcus* sp. FDAARGOS_375 |
| SBP00130 | Greek Ripe Black Olives | *Enterococcus* sp. FDAARGOS_375 |
| SBP00130 | Greek Ripe Black Olives | *Enterococcus* sp. FDAARGOS_553 |
| SBP00130 | Greek Ripe Black Olives | *Enterococcus* sp. FDAARGOS_553 |
| SBP00130 | Greek Ripe Black Olives | *Enterococcus thailandicus* |
| SBP00130 | Greek Ripe Black Olives | *Enterococcus thailandicus* |
| SBP00130 | Greek Ripe Black Olives | *Epibacterium mobile* |
| SBP00130 | Greek Ripe Black Olives | *Epibacterium mobile* |

TABLE 3-continued

List of species identified in each metagenomic sample of each SBP Sample

| SBP ID | SBP Host Common Name | Genus sp. |
| --- | --- | --- |
| SBP00130 | Greek Ripe Black Olives | *Ereboglobus luteus* |
| SBP00130 | Greek Ripe Black Olives | *Ereboglobus luteus* |
| SBP00130 | Greek Ripe Black Olives | *Erwinia amylovora* |
| SBP00130 | Greek Ripe Black Olives | *Erwinia amylovora* |
| SBP00130 | Greek Ripe Black Olives | *Erwinia billingiae* |
| SBP00130 | Greek Ripe Black Olives | *Erwinia billingiae* |
| SBP00130 | Greek Ripe Black Olives | *Erwinia persicina* |
| SBP00130 | Greek Ripe Black Olives | *Erwinia persicina* |
| SBP00130 | Greek Ripe Black Olives | *Erwinia pyrifoliae* |
| SBP00130 | Greek Ripe Black Olives | *Erwinia pyrifoliae* |
| SBP00130 | Greek Ripe Black Olives | *Erwinia* sp. |
| SBP00130 | Greek Ripe Black Olives | *Erwinia* sp. |
| SBP00130 | Greek Ripe Black Olives | *Erwinia tasmaniensis* |
| SBP00130 | Greek Ripe Black Olives | *Erwinia tasmaniensis* |
| SBP00130 | Greek Ripe Black Olives | *Erythrobacter atlanticus* |
| SBP00130 | Greek Ripe Black Olives | *Erythrobacter atlanticus* |
| SBP00130 | Greek Ripe Black Olives | *Escherichia albertii* |
| SBP00130 | Greek Ripe Black Olives | *Escherichia albertii* |
| SBP00130 | Greek Ripe Black Olives | *Escherichia coli* |
| SBP00130 | Greek Ripe Black Olives | *Escherichia coli* |
| SBP00130 | Greek Ripe Black Olives | *Escherichia* sp. E4742 |
| SBP00130 | Greek Ripe Black Olives | *Escherichia* sp. E4742 |
| SBP00130 | Greek Ripe Black Olives | *Exiguobacterium mexicanum* |
| SBP00130 | Greek Ripe Black Olives | *Exiguobacterium mexicanum* |
| SBP00130 | Greek Ripe Black Olives | *Exiguobacterium* sp. AT1b |
| SBP00130 | Greek Ripe Black Olives | *Exiguobacterium* sp. AT1b |
| SBP00130 | Greek Ripe Black Olives | *Ferrimonas balearica* |
| SBP00130 | Greek Ripe Black Olives | *Ferrimonas balearica* |
| SBP00130 | Greek Ripe Black Olives | *Ferriphaselus amnicola* |
| SBP00130 | Greek Ripe Black Olives | *Ferriphaselus amnicola* |
| SBP00130 | Greek Ripe Black Olives | *Fervidobacterium pennivorans* |
| SBP00130 | Greek Ripe Black Olives | *Fervidobacterium pennivorans* |
| SBP00130 | Greek Ripe Black Olives | *Fibrella aestuarina* |
| SBP00130 | Greek Ripe Black Olives | *Fibrella aestuarina* |
| SBP00130 | Greek Ripe Black Olives | *Fimbriimonas ginsengisoli* |
| SBP00130 | Greek Ripe Black Olives | *Fimbriimonas ginsengisoli* |
| SBP00130 | Greek Ripe Black Olives | *Fischerella* sp. NIES-4106 |
| SBP00130 | Greek Ripe Black Olives | *Fischerella* sp. NIES-4106 |
| SBP00130 | Greek Ripe Black Olives | *Flaviflexus* sp. H23T48 |
| SBP00130 | Greek Ripe Black Olives | *Flaviflexus* sp. H23T48 |
| SBP00130 | Greek Ripe Black Olives | *Formosa* sp. Hel1_31_208 |
| SBP00130 | Greek Ripe Black Olives | *Formosa* sp. Hel1_31_208 |
| SBP00130 | Greek Ripe Black Olives | *Frankia casuarinae* |
| SBP00130 | Greek Ripe Black Olives | *Frankia casuarinae* |
| SBP00130 | Greek Ripe Black Olives | *Frateuria aurantia* |
| SBP00130 | Greek Ripe Black Olives | *Frateuria aurantia* |
| SBP00130 | Greek Ripe Black Olives | *Gallaecimonas* sp. HK-28 |
| SBP00130 | Greek Ripe Black Olives | *Gallaecimonas* sp. HK-28 |
| SBP00130 | Greek Ripe Black Olives | *Gallibacterium anatis* |
| SBP00130 | Greek Ripe Black Olives | *Gallibacterium anatis* |
| SBP00130 | Greek Ripe Black Olives | gamma proteobacterium HdN1 |
| SBP00130 | Greek Ripe Black Olives | gamma proteobacterium HdN1 |
| SBP00130 | Greek Ripe Black Olives | *Gammaproteobacteria bacterium* DM2 |
| SBP00130 | Greek Ripe Black Olives | *Gammaproteobacteria bacterium* DM2 |
| SBP00130 | Greek Ripe Black Olives | *Gammaproteobacteria bacterium* ESL0073 |
| SBP00130 | Greek Ripe Black Olives | *Gammaproteobacteria bacterium* ESL0073 |
| SBP00130 | Greek Ripe Black Olives | *Gemmatirosa kalamazoonesis* |
| SBP00130 | Greek Ripe Black Olives | *Gemmatirosa kalamazoonesis* |
| SBP00130 | Greek Ripe Black Olives | *Gemmobacter* sp. HYN0069 |
| SBP00130 | Greek Ripe Black Olives | *Gemmobacter* sp. HYN0069 |
| SBP00130 | Greek Ripe Black Olives | *Geoalkalibacter subterraneus* |
| SBP00130 | Greek Ripe Black Olives | *Geoalkalibacter subterraneus* |
| SBP00130 | Greek Ripe Black Olives | *Geobacter lovleyi* |
| SBP00130 | Greek Ripe Black Olives | *Geobacter lovleyi* |
| SBP00130 | Greek Ripe Black Olives | *Geobacter metallireducens* |
| SBP00130 | Greek Ripe Black Olives | *Geobacter metallireducens* |
| SBP00130 | Greek Ripe Black Olives | *Gibbsiella quercinecans* |
| SBP00130 | Greek Ripe Black Olives | *Gibbsiella quercinecans* |
| SBP00130 | Greek Ripe Black Olives | *Glaciecola nitratireducens* |
| SBP00130 | Greek Ripe Black Olives | *Glaciecola nitratireducens* |
| SBP00130 | Greek Ripe Black Olives | *Gloeobacter violaceus* |
| SBP00130 | Greek Ripe Black Olives | *Gloeobacter violaceus* |
| SBP00130 | Greek Ripe Black Olives | *Glutamicibacter halophytocola* |
| SBP00130 | Greek Ripe Black Olives | *Glutamicibacter halophytocola* |
| SBP00130 | Greek Ripe Black Olives | *Gordonia* sp. 1D |
| SBP00130 | Greek Ripe Black Olives | *Gordonia* sp. 1D |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Gordonia* sp. KTR9 |
| SBP00130 | Greek Ripe Black Olives | *Gordonia* sp. KTR9 |
| SBP00130 | Greek Ripe Black Olives | *Gramella salexigens* |
| SBP00130 | Greek Ripe Black Olives | *Gramella salexigens* |
| SBP00130 | Greek Ripe Black Olives | *Granulibacter bethesdensis* |
| SBP00130 | Greek Ripe Black Olives | *Granulibacter bethesdensis* |
| SBP00130 | Greek Ripe Black Olives | *Gynuella sunshinyii* |
| SBP00130 | Greek Ripe Black Olives | *Gynuella sunshinyii* |
| SBP00130 | Greek Ripe Black Olives | *Haematospirillum jordaniae* |
| SBP00130 | Greek Ripe Black Olives | *Haematospirillum jordaniae* |
| SBP00130 | Greek Ripe Black Olives | *Hafnia alvei* |
| SBP00130 | Greek Ripe Black Olives | *Hafnia alvei* |
| SBP00130 | Greek Ripe Black Olives | *Hafnia paralvei* |
| SBP00130 | Greek Ripe Black Olives | *Hafnia paralvei* |
| SBP00130 | Greek Ripe Black Olives | *Hahella chejuensis* |
| SBP00130 | Greek Ripe Black Olives | *Hahella chejuensis* |
| SBP00130 | Greek Ripe Black Olives | *Haliangium ochraceum* |
| SBP00130 | Greek Ripe Black Olives | *Haliangium ochraceum* |
| SBP00130 | Greek Ripe Black Olives | *Halioglobus japonicus* |
| SBP00130 | Greek Ripe Black Olives | *Halioglobus japonicus* |
| SBP00130 | Greek Ripe Black Olives | *Haloarculaceae archaeon* HArcel1 |
| SBP00130 | Greek Ripe Black Olives | *Haloarculaceae archaeon* HArcel1 |
| SBP00130 | Greek Ripe Black Olives | *Halobacteriovorax* sp. BALOs_7 |
| SBP00130 | Greek Ripe Black Olives | *Halobacteriovorax* sp. BALOs_7 |
| SBP00130 | Greek Ripe Black Olives | *Haloferax mediterranei* |
| SBP00130 | Greek Ripe Black Olives | *Haloferax mediterranei* |
| SBP00130 | Greek Ripe Black Olives | *Halomonas beimenensis* |
| SBP00130 | Greek Ripe Black Olives | *Halomonas beimenensis* |
| SBP00130 | Greek Ripe Black Olives | *Halomonas chromatireducens* |
| SBP00130 | Greek Ripe Black Olives | *Halomonas chromatireducens* |
| SBP00130 | Greek Ripe Black Olives | *Halomonas elongata* |
| SBP00130 | Greek Ripe Black Olives | *Halomonas elongata* |
| SBP00130 | Greek Ripe Black Olives | *Halomonas huangheensis* |
| SBP00130 | Greek Ripe Black Olives | *Halomonas huangheensis* |
| SBP00130 | Greek Ripe Black Olives | *Halomonas hydrothermalis* |
| SBP00130 | Greek Ripe Black Olives | *Halomonas hydrothermalis* |
| SBP00130 | Greek Ripe Black Olives | *Halomonas* sp. 1513 |
| SBP00130 | Greek Ripe Black Olives | *Halomonas* sp. 1513 |
| SBP00130 | Greek Ripe Black Olives | *Halomonas* sp. A3H3 |
| SBP00130 | Greek Ripe Black Olives | *Halomonas* sp. A3H3 |
| SBP00130 | Greek Ripe Black Olives | *Halomonas* sp. GT |
| SBP00130 | Greek Ripe Black Olives | *Halomonas* sp. GT |
| SBP00130 | Greek Ripe Black Olives | *Halomonas* sp. JS92-SW72 |
| SBP00130 | Greek Ripe Black Olives | *Halomonas* sp. JS92-SW72 |
| SBP00130 | Greek Ripe Black Olives | *Halomonas* sp. KO116 |
| SBP00130 | Greek Ripe Black Olives | *Halomonas* sp. KO116 |
| SBP00130 | Greek Ripe Black Olives | *Halomonas* sp. SF2003 |
| SBP00130 | Greek Ripe Black Olives | *Halomonas* sp. SF2003 |
| SBP00130 | Greek Ripe Black Olives | *Halomonas subglaciescola* |
| SBP00130 | Greek Ripe Black Olives | *Halomonas subglaciescola* |
| SBP00130 | Greek Ripe Black Olives | *Halomonas venusta* |
| SBP00130 | Greek Ripe Black Olives | *Halomonas venusta* |
| SBP00130 | Greek Ripe Black Olives | *Halorhodospira halophila* |
| SBP00130 | Greek Ripe Black Olives | *Halorhodospira halophila* |
| SBP00130 | Greek Ripe Black Olives | *Halotalea alkalilenta* |
| SBP00130 | Greek Ripe Black Olives | *Halotalea alkalilenta* |
| SBP00130 | Greek Ripe Black Olives | *Haloterrigena turkmenica* |
| SBP00130 | Greek Ripe Black Olives | *Haloterrigena turkmenica* |
| SBP00130 | Greek Ripe Black Olives | *Halothiobacillus* sp. LS2 |
| SBP00130 | Greek Ripe Black Olives | *Halothiobacillus* sp. LS2 |
| SBP00130 | Greek Ripe Black Olives | *Herbaspirillum hiltneri* |
| SBP00130 | Greek Ripe Black Olives | *Herbaspirillum hiltneri* |
| SBP00130 | Greek Ripe Black Olives | *Herbaspirillum huttiense* |
| SBP00130 | Greek Ripe Black Olives | *Herbaspirillum huttiense* |
| SBP00130 | Greek Ripe Black Olives | *Herbaspirillum robiniae* |
| SBP00130 | Greek Ripe Black Olives | *Herbaspirillum robiniae* |
| SBP00130 | Greek Ripe Black Olives | *Herbaspirillum rubrisubalbicans* |
| SBP00130 | Greek Ripe Black Olives | *Herbaspirillum rubrisubalbicans* |
| SBP00130 | Greek Ripe Black Olives | *Herbaspirillum seropedicae* |
| SBP00130 | Greek Ripe Black Olives | *Herbaspirillum seropedicae* |
| SBP00130 | Greek Ripe Black Olives | *Herbaspirillum* sp. meg3 |
| SBP00130 | Greek Ripe Black Olives | *Herbaspirillum* sp. meg3 |
| SBP00130 | Greek Ripe Black Olives | *Herminiimonas arsenicoxydans* |
| SBP00130 | Greek Ripe Black Olives | *Herminiimonas arsenicoxydans* |
| SBP00130 | Greek Ripe Black Olives | *Herminiimonas arsenitoxidans* |
| SBP00130 | Greek Ripe Black Olives | *Herminiimonas arsenitoxidans* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Hoeflea* sp. IMCC20628 |
| SBP00130 | Greek Ripe Black Olives | *Hoeflea* sp. IMCC20628 |
| SBP00130 | Greek Ripe Black Olives | *Hydrogenophaga crassostreae* |
| SBP00130 | Greek Ripe Black Olives | *Hydrogenophaga crassostreae* |
| SBP00130 | Greek Ripe Black Olives | *Hydrogenophaga* sp. PBC |
| SBP00130 | Greek Ripe Black Olives | *Hydrogenophaga* sp. PBC |
| SBP00130 | Greek Ripe Black Olives | *Hydrogenophaga* sp. RAC07 |
| SBP00130 | Greek Ripe Black Olives | *Hydrogenophaga* sp. RAC07 |
| SBP00130 | Greek Ripe Black Olives | *Hydromonas* sp. F02 |
| SBP00130 | Greek Ripe Black Olives | *Hydromonas* sp. F02 |
| SBP00130 | Greek Ripe Black Olives | *Hylemonella gracilis* |
| SBP00130 | Greek Ripe Black Olives | *Hylemonella gracilis* |
| SBP00130 | Greek Ripe Black Olives | *Hymenobacter sedentarius* |
| SBP00130 | Greek Ripe Black Olives | *Hymenobacter sedentarius* |
| SBP00130 | Greek Ripe Black Olives | *Hymenobacter* sp. 17J68-5 |
| SBP00130 | Greek Ripe Black Olives | *Hymenobacter* sp. 17J68-5 |
| SBP00130 | Greek Ripe Black Olives | *Hymenobacter swuensis* |
| SBP00130 | Greek Ripe Black Olives | *Hymenobacter swuensis* |
| SBP00130 | Greek Ripe Black Olives | *Hyperthermus butylicus* |
| SBP00130 | Greek Ripe Black Olives | *Hyperthermus butylicus* |
| SBP00130 | Greek Ripe Black Olives | *Hyphomicrobium denitrificans* |
| SBP00130 | Greek Ripe Black Olives | *Hyphomicrobium denitrificans* |
| SBP00130 | Greek Ripe Black Olives | *Idiomarina loihiensis* |
| SBP00130 | Greek Ripe Black Olives | *Idiomarina loihiensis* |
| SBP00130 | Greek Ripe Black Olives | *Idiomarina* sp. OT37-5b |
| SBP00130 | Greek Ripe Black Olives | *Idiomarina* sp. OT37-5b |
| SBP00130 | Greek Ripe Black Olives | *Immundisolibacter cernigliae* |
| SBP00130 | Greek Ripe Black Olives | *Immundisolibacter cernigliae* |
| SBP00130 | Greek Ripe Black Olives | *Inhella inkyongensis* |
| SBP00130 | Greek Ripe Black Olives | *Inhella inkyongensis* |
| SBP00130 | Greek Ripe Black Olives | *Intrasporangium calvum* |
| SBP00130 | Greek Ripe Black Olives | *Intrasporangium calvum* |
| SBP00130 | Greek Ripe Black Olives | *Iodobacter* sp. H11R3 |
| SBP00130 | Greek Ripe Black Olives | *Iodobacter* sp. H11R3 |
| SBP00130 | Greek Ripe Black Olives | *Isosphaera pallida* |
| SBP00130 | Greek Ripe Black Olives | *Isosphaera pallida* |
| SBP00130 | Greek Ripe Black Olives | *Janibacter indicus* |
| SBP00130 | Greek Ripe Black Olives | *Janibacter indicus* |
| SBP00130 | Greek Ripe Black Olives | *Janthinobacterium agaricidamnosum* |
| SBP00130 | Greek Ripe Black Olives | *Janthinobacterium agaricidamnosum* |
| SBP00130 | Greek Ripe Black Olives | *Janthinobacterium* sp. 1_2014MBL_MicDiv |
| SBP00130 | Greek Ripe Black Olives | *Janthinobacterium* sp. 1_2014MBL_MicDiv |
| SBP00130 | Greek Ripe Black Olives | *Janthinobacterium* sp. 17J80-10 |
| SBP00130 | Greek Ripe Black Olives | *Janthinobacterium* sp. 17J80-10 |
| SBP00130 | Greek Ripe Black Olives | *Janthinobacterium* sp. B9-8 |
| SBP00130 | Greek Ripe Black Olives | *Janthinobacterium* sp. B9-8 |
| SBP00130 | Greek Ripe Black Olives | *Janthinobacterium* sp. Marseille |
| SBP00130 | Greek Ripe Black Olives | *Janthinobacterium* sp. Marseille |
| SBP00130 | Greek Ripe Black Olives | *Janthinobacterium svalbardensis* |
| SBP00130 | Greek Ripe Black Olives | *Janthinobacterium svalbardensis* |
| SBP00130 | Greek Ripe Black Olives | *Jeongeupia* sp. USM3 |
| SBP00130 | Greek Ripe Black Olives | *Jeongeupia* sp. USM3 |
| SBP00130 | Greek Ripe Black Olives | *Jeotgalibaca dankookensis* |
| SBP00130 | Greek Ripe Black Olives | *Jeotgalibaca dankookensis* |
| SBP00130 | Greek Ripe Black Olives | *Jeotgalibaca* sp. H21T32 |
| SBP00130 | Greek Ripe Black Olives | *Jeotgalibaca* sp. H21T32 |
| SBP00130 | Greek Ripe Black Olives | *Jeotgalibaca* sp. PTS2502 |
| SBP00130 | Greek Ripe Black Olives | *Jeotgalibaca* sp. PTS2502 |
| SBP00130 | Greek Ripe Black Olives | *Jiangella alkaliphila* |
| SBP00130 | Greek Ripe Black Olives | *Jiangella alkaliphila* |
| SBP00130 | Greek Ripe Black Olives | *Kangiella geojedonensis* |
| SBP00130 | Greek Ripe Black Olives | *Kangiella geojedonensis* |
| SBP00130 | Greek Ripe Black Olives | *Kangiella profundi* |
| SBP00130 | Greek Ripe Black Olives | *Kangiella profundi* |
| SBP00130 | Greek Ripe Black Olives | *Kerstersia gyiorum* |
| SBP00130 | Greek Ripe Black Olives | *Kerstersia gyiorum* |
| SBP00130 | Greek Ripe Black Olives | *Ketobacter alkanivorans* |
| SBP00130 | Greek Ripe Black Olives | *Ketobacter alkanivorans* |
| SBP00130 | Greek Ripe Black Olives | *Ketogulonicigenium robustum* |
| SBP00130 | Greek Ripe Black Olives | *Ketogulonicigenium robustum* |
| SBP00130 | Greek Ripe Black Olives | *Ketogulonicigenium vulgare* |
| SBP00130 | Greek Ripe Black Olives | *Ketogulonicigenium vulgare* |
| SBP00130 | Greek Ripe Black Olives | *Kineococcus radiotolerans* |
| SBP00130 | Greek Ripe Black Olives | *Kineococcus radiotolerans* |
| SBP00130 | Greek Ripe Black Olives | *Klebsiella aerogenes* |
| SBP00130 | Greek Ripe Black Olives | *Klebsiella aerogenes* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Klebsiella michiganensis* |
| SBP00130 | Greek Ripe Black Olives | *Klebsiella michiganensis* |
| SBP00130 | Greek Ripe Black Olives | *Klebsiella oxytoca* |
| SBP00130 | Greek Ripe Black Olives | *Klebsiella oxytoca* |
| SBP00130 | Greek Ripe Black Olives | *Klebsiella pneumoniae* |
| SBP00130 | Greek Ripe Black Olives | *Klebsiella pneumoniae* |
| SBP00130 | Greek Ripe Black Olives | *Klebsiella quasipneumoniae* |
| SBP00130 | Greek Ripe Black Olives | *Klebsiella quasipneumoniae* |
| SBP00130 | Greek Ripe Black Olives | *Klebsiella* sp. FDAARGOS_511 |
| SBP00130 | Greek Ripe Black Olives | *Klebsiella* sp. FDAARGOS_511 |
| SBP00130 | Greek Ripe Black Olives | *Klebsiella* sp. P1CD1 |
| SBP00130 | Greek Ripe Black Olives | *Klebsiella* sp. P1CD1 |
| SBP00130 | Greek Ripe Black Olives | *Klebsiella* sp. WCHKl090001 |
| SBP00130 | Greek Ripe Black Olives | *Klebsiella* sp. WCHKl090001 |
| SBP00130 | Greek Ripe Black Olives | *Klebsiella variicola* |
| SBP00130 | Greek Ripe Black Olives | *Klebsiella variicola* |
| SBP00130 | Greek Ripe Black Olives | *Kluyvera intermedia* |
| SBP00130 | Greek Ripe Black Olives | *Kluyvera intermedia* |
| SBP00130 | Greek Ripe Black Olives | *Kocuria indica* |
| SBP00130 | Greek Ripe Black Olives | *Kocuria indica* |
| SBP00130 | Greek Ripe Black Olives | *Komagataeibacter saccharivorans* |
| SBP00130 | Greek Ripe Black Olives | *Komagataeibacter saccharivorans* |
| SBP00130 | Greek Ripe Black Olives | *Komagataeibacter xylinus* |
| SBP00130 | Greek Ripe Black Olives | *Komagataeibacter xylinus* |
| SBP00130 | Greek Ripe Black Olives | *Kosakonia cowanii* |
| SBP00130 | Greek Ripe Black Olives | *Kosakonia cowanii* |
| SBP00130 | Greek Ripe Black Olives | *Kosakonia oryzae* |
| SBP00130 | Greek Ripe Black Olives | *Kosakonia oryzae* |
| SBP00130 | Greek Ripe Black Olives | *Kosakonia radicincitans* |
| SBP00130 | Greek Ripe Black Olives | *Kosakonia radicincitans* |
| SBP00130 | Greek Ripe Black Olives | *Kosakonia sacchari* |
| SBP00130 | Greek Ripe Black Olives | *Kosakonia sacchari* |
| SBP00130 | Greek Ripe Black Olives | *Kozakia baliensis* |
| SBP00130 | Greek Ripe Black Olives | *Kozakia baliensis* |
| SBP00130 | Greek Ripe Black Olives | *Kushneria konosiri* |
| SBP00130 | Greek Ripe Black Olives | *Kushneria konosiri* |
| SBP00130 | Greek Ripe Black Olives | *Kushneria marisflavi* |
| SBP00130 | Greek Ripe Black Olives | *Kushneria marisflavi* |
| SBP00130 | Greek Ripe Black Olives | *Kyrpidia spormannii* |
| SBP00130 | Greek Ripe Black Olives | *Kyrpidia spormannii* |
| SBP00130 | Greek Ripe Black Olives | *Labrenzia aggregata* |
| SBP00130 | Greek Ripe Black Olives | *Labrenzia aggregata* |
| SBP00130 | Greek Ripe Black Olives | *Labrenzia* sp. VG12 |
| SBP00130 | Greek Ripe Black Olives | *Labrenzia* sp. VG12 |
| SBP00130 | Greek Ripe Black Olives | *Lacimicrobium alkaliphilum* |
| SBP00130 | Greek Ripe Black Olives | *Lacimicrobium alkaliphilum* |
| SBP00130 | Greek Ripe Black Olives | *Lactobacillus acetotolerans* |
| SBP00130 | Greek Ripe Black Olives | *Lactobacillus acetotolerans* |
| SBP00130 | Greek Ripe Black Olives | *Lactobacillus acidipiscis* |
| SBP00130 | Greek Ripe Black Olives | *Lactobacillus acidipiscis* |
| SBP00130 | Greek Ripe Black Olives | *Lactobacillus acidophilus* |
| SBP00130 | Greek Ripe Black Olives | *Lactobacillus acidophilus* |
| SBP00130 | Greek Ripe Black Olives | *Lactobacillus alimentarius* |
| SBP00130 | Greek Ripe Black Olives | *Lactobacillus alimentarius* |
| SBP00130 | Greek Ripe Black Olives | *Lactobacillus allii* |
| SBP00130 | Greek Ripe Black Olives | *Lactobacillus allii* |
| SBP00130 | Greek Ripe Black Olives | *Lactobacillus backii* |
| SBP00130 | Greek Ripe Black Olives | *Lactobacillus backii* |
| SBP00130 | Greek Ripe Black Olives | *Lactobacillus brevis* |
| SBP00130 | Greek Ripe Black Olives | *Lactobacillus brevis* |
| SBP00130 | Greek Ripe Black Olives | *Lactobacillus buchneri* |
| SBP00130 | Greek Ripe Black Olives | *Lactobacillus buchneri* |
| SBP00130 | Greek Ripe Black Olives | *Lactobacillus casei* |
| SBP00130 | Greek Ripe Black Olives | *Lactobacillus casei* |
| SBP00130 | Greek Ripe Black Olives | *Lactobacillus coryniformis* |
| SBP00130 | Greek Ripe Black Olives | *Lactobacillus coryniformis* |
| SBP00130 | Greek Ripe Black Olives | *Lactobacillus crustorum* |
| SBP00130 | Greek Ripe Black Olives | *Lactobacillus crustorum* |
| SBP00130 | Greek Ripe Black Olives | *Lactobacillus curieae* |
| SBP00130 | Greek Ripe Black Olives | *Lactobacillus curieae* |
| SBP00130 | Greek Ripe Black Olives | *Lactobacillus curvatus* |
| SBP00130 | Greek Ripe Black Olives | *Lactobacillus curvatus* |
| SBP00130 | Greek Ripe Black Olives | *Lactobacillus delbrueckii* |
| SBP00130 | Greek Ripe Black Olives | *Lactobacillus delbrueckii* |
| SBP00130 | Greek Ripe Black Olives | *Lactobacillus farciminis* |
| SBP00130 | Greek Ripe Black Olives | *Lactobacillus farciminis* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Lactobacillus fermentum* |
| SBP00130 | Greek Ripe Black Olives | *Lactobacillus fermentum* |
| SBP00130 | Greek Ripe Black Olives | *Lactobacillus fuchuensis* |
| SBP00130 | Greek Ripe Black Olives | *Lactobacillus fuchuensis* |
| SBP00130 | Greek Ripe Black Olives | *Lactobacillus gasseri* |
| SBP00130 | Greek Ripe Black Olives | *Lactobacillus gasseri* |
| SBP00130 | Greek Ripe Black Olives | *Lactobacillus ginsenosidimutans* |
| SBP00130 | Greek Ripe Black Olives | *Lactobacillus ginsenosidimutans* |
| SBP00130 | Greek Ripe Black Olives | *Lactobacillus heilongjiangensis* |
| SBP00130 | Greek Ripe Black Olives | *Lactobacillus heilongjiangensis* |
| SBP00130 | Greek Ripe Black Olives | *Lactobacillus helveticus* |
| SBP00130 | Greek Ripe Black Olives | *Lactobacillus helveticus* |
| SBP00130 | Greek Ripe Black Olives | *Lactobacillus hokkaidonensis* |
| SBP00130 | Greek Ripe Black Olives | *Lactobacillus hokkaidonensis* |
| SBP00130 | Greek Ripe Black Olives | *Lactobacillus hordei* |
| SBP00130 | Greek Ripe Black Olives | *Lactobacillus hordei* |
| SBP00130 | Greek Ripe Black Olives | *Lactobacillus kefiranofaciens* |
| SBP00130 | Greek Ripe Black Olives | *Lactobacillus kefiranofaciens* |
| SBP00130 | Greek Ripe Black Olives | *Lactobacillus koreensis* |
| SBP00130 | Greek Ripe Black Olives | *Lactobacillus koreensis* |
| SBP00130 | Greek Ripe Black Olives | *Lactobacillus kunkeei* |
| SBP00130 | Greek Ripe Black Olives | *Lactobacillus kunkeei* |
| SBP00130 | Greek Ripe Black Olives | *Lactobacillus lindneri* |
| SBP00130 | Greek Ripe Black Olives | *Lactobacillus lindneri* |
| SBP00130 | Greek Ripe Black Olives | *Lactobacillus mucosae* |
| SBP00130 | Greek Ripe Black Olives | *Lactobacillus mucosae* |
| SBP00130 | Greek Ripe Black Olives | *Lactobacillus murinus* |
| SBP00130 | Greek Ripe Black Olives | *Lactobacillus murinus* |
| SBP00130 | Greek Ripe Black Olives | *Lactobacillus oligofermentans* |
| SBP00130 | Greek Ripe Black Olives | *Lactobacillus oligofermentans* |
| SBP00130 | Greek Ripe Black Olives | *Lactobacillus parabuchneri* |
| SBP00130 | Greek Ripe Black Olives | *Lactobacillus parabuchneri* |
| SBP00130 | Greek Ripe Black Olives | *Lactobacillus paracasei* |
| SBP00130 | Greek Ripe Black Olives | *Lactobacillus paracasei* |
| SBP00130 | Greek Ripe Black Olives | *Lactobacillus paracollinoides* |
| SBP00130 | Greek Ripe Black Olives | *Lactobacillus paracollinoides* |
| SBP00130 | Greek Ripe Black Olives | *Lactobacillus paraplantarum* |
| SBP00130 | Greek Ripe Black Olives | *Lactobacillus paraplantarum* |
| SBP00130 | Greek Ripe Black Olives | *Lactobacillus pentosus* |
| SBP00130 | Greek Ripe Black Olives | *Lactobacillus pentosus* |
| SBP00130 | Greek Ripe Black Olives | *Lactobacillus plantarum* |
| SBP00130 | Greek Ripe Black Olives | *Lactobacillus plantarum* |
| SBP00130 | Greek Ripe Black Olives | *Lactobacillus reuteri* |
| SBP00130 | Greek Ripe Black Olives | *Lactobacillus reuteri* |
| SBP00130 | Greek Ripe Black Olives | *Lactobacillus rhamnosus* |
| SBP00130 | Greek Ripe Black Olives | *Lactobacillus rhamnosus* |
| SBP00130 | Greek Ripe Black Olives | *Lactobacillus sakei* |
| SBP00130 | Greek Ripe Black Olives | *Lactobacillus sakei* |
| SBP00130 | Greek Ripe Black Olives | *Lactobacillus salivarius* |
| SBP00130 | Greek Ripe Black Olives | *Lactobacillus salivarius* |
| SBP00130 | Greek Ripe Black Olives | *Lactobacillus sanfranciscensis* |
| SBP00130 | Greek Ripe Black Olives | *Lactobacillus sanfranciscensis* |
| SBP00130 | Greek Ripe Black Olives | *Lactobacillus* sp. BHWM-4 |
| SBP00130 | Greek Ripe Black Olives | *Lactobacillus* sp. BHWM-4 |
| SBP00130 | Greek Ripe Black Olives | *Lactobacillus* sp. CBA3605 |
| SBP00130 | Greek Ripe Black Olives | *Lactobacillus* sp. CBA3605 |
| SBP00130 | Greek Ripe Black Olives | *Lactobacillus* sp. CBA3606 |
| SBP00130 | Greek Ripe Black Olives | *Lactobacillus* sp. CBA3606 |
| SBP00130 | Greek Ripe Black Olives | *Lactobacillus* sp. HBUAS52074 |
| SBP00130 | Greek Ripe Black Olives | *Lactobacillus* sp. HBUAS52074 |
| SBP00130 | Greek Ripe Black Olives | *Lactobacillus zymae* |
| SBP00130 | Greek Ripe Black Olives | *Lactobacillus zymae* |
| SBP00130 | Greek Ripe Black Olives | *Lactococcus lactis* |
| SBP00130 | Greek Ripe Black Olives | *Lactococcus lactis* |
| SBP00130 | Greek Ripe Black Olives | *Laribacter hongkongensis* |
| SBP00130 | Greek Ripe Black Olives | *Laribacter hongkongensis* |
| SBP00130 | Greek Ripe Black Olives | *Lautropia mirabilis* |
| SBP00130 | Greek Ripe Black Olives | *Lautropia mirabilis* |
| SBP00130 | Greek Ripe Black Olives | *Leclercia adecarboxylata* |
| SBP00130 | Greek Ripe Black Olives | *Leclercia adecarboxylata* |
| SBP00130 | Greek Ripe Black Olives | *Leclercia* sp. LSNIH3 |
| SBP00130 | Greek Ripe Black Olives | *Leclercia* sp. LSNIH3 |
| SBP00130 | Greek Ripe Black Olives | *Legionella israelensis* |
| SBP00130 | Greek Ripe Black Olives | *Legionella israelensis* |
| SBP00130 | Greek Ripe Black Olives | *Legionella sainthelensi* |
| SBP00130 | Greek Ripe Black Olives | *Legionella sainthelensi* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Legionella spiritensis* |
| SBP00130 | Greek Ripe Black Olives | *Legionella spiritensis* |
| SBP00130 | Greek Ripe Black Olives | *Leisingera aquaemixtae* |
| SBP00130 | Greek Ripe Black Olives | *Leisingera aquaemixtae* |
| SBP00130 | Greek Ripe Black Olives | *Leisingera methylohalidivorans* |
| SBP00130 | Greek Ripe Black Olives | *Leisingera methylohalidivorans* |
| SBP00130 | Greek Ripe Black Olives | *Lelliottia amnigena* |
| SBP00130 | Greek Ripe Black Olives | *Lelliottia amnigena* |
| SBP00130 | Greek Ripe Black Olives | *Lelliottia jeotgali* |
| SBP00130 | Greek Ripe Black Olives | *Lelliottia jeotgali* |
| SBP00130 | Greek Ripe Black Olives | *Leminorella richardii* |
| SBP00130 | Greek Ripe Black Olives | *Leminorella richardii* |
| SBP00130 | Greek Ripe Black Olives | *Leptothrix cholodnii* |
| SBP00130 | Greek Ripe Black Olives | *Leptothrix cholodnii* |
| SBP00130 | Greek Ripe Black Olives | *Leuconostoc gelidum* |
| SBP00130 | Greek Ripe Black Olives | *Leuconostoc gelidum* |
| SBP00130 | Greek Ripe Black Olives | *Leuconostoc mesenteroides* |
| SBP00130 | Greek Ripe Black Olives | *Leuconostoc mesenteroides* |
| SBP00130 | Greek Ripe Black Olives | *Limnohabitans* sp. 103DPR2 |
| SBP00130 | Greek Ripe Black Olives | *Limnohabitans* sp. 103DPR2 |
| SBP00130 | Greek Ripe Black Olives | *Listeria monocytogenes* |
| SBP00130 | Greek Ripe Black Olives | *Listeria monocytogenes* |
| SBP00130 | Greek Ripe Black Olives | *Lonsdalea britannica* |
| SBP00130 | Greek Ripe Black Olives | *Lonsdalea britannica* |
| SBP00130 | Greek Ripe Black Olives | *Luteibacter rhizovicinus* |
| SBP00130 | Greek Ripe Black Olives | *Luteibacter rhizovicinus* |
| SBP00130 | Greek Ripe Black Olives | *Luteimonas* sp. 100111 |
| SBP00130 | Greek Ripe Black Olives | *Luteimonas* sp. 100111 |
| SBP00130 | Greek Ripe Black Olives | *Luteimonas* sp. 83-4 |
| SBP00130 | Greek Ripe Black Olives | *Luteimonas* sp. 83-4 |
| SBP00130 | Greek Ripe Black Olives | *Luteimonas* sp. JM171 |
| SBP00130 | Greek Ripe Black Olives | *Luteimonas* sp. JM171 |
| SBP00130 | Greek Ripe Black Olives | *Lysinibacillus sphaericus* |
| SBP00130 | Greek Ripe Black Olives | *Lysinibacillus sphaericus* |
| SBP00130 | Greek Ripe Black Olives | *Lysobacter capsici* |
| SBP00130 | Greek Ripe Black Olives | *Lysobacter capsici* |
| SBP00130 | Greek Ripe Black Olives | *Lysobacter enzymogenes* |
| SBP00130 | Greek Ripe Black Olives | *Lysobacter enzymogenes* |
| SBP00130 | Greek Ripe Black Olives | *Lysobacter maris* |
| SBP00130 | Greek Ripe Black Olives | *Lysobacter maris* |
| SBP00130 | Greek Ripe Black Olives | *Magnetospira* sp. QH-2 |
| SBP00130 | Greek Ripe Black Olives | *Magnetospira* sp. QH-2 |
| SBP00130 | Greek Ripe Black Olives | *Mannheimia varigena* |
| SBP00130 | Greek Ripe Black Olives | *Mannheimia varigena* |
| SBP00130 | Greek Ripe Black Olives | *Marichromatium purpuratum* |
| SBP00130 | Greek Ripe Black Olives | *Marichromatium purpuratum* |
| SBP00130 | Greek Ripe Black Olives | *Marinilactibacillus* sp. 15R |
| SBP00130 | Greek Ripe Black Olives | *Marinilactibacillus* sp. 15R |
| SBP00130 | Greek Ripe Black Olives | *Marinobacter hydrocarbonoclasticus* |
| SBP00130 | Greek Ripe Black Olives | *Marinobacter hydrocarbonoclasticus* |
| SBP00130 | Greek Ripe Black Olives | *Marinobacter psychrophilus* |
| SBP00130 | Greek Ripe Black Olives | *Marinobacter psychrophilus* |
| SBP00130 | Greek Ripe Black Olives | *Marinobacter salinus* |
| SBP00130 | Greek Ripe Black Olives | *Marinobacter salinus* |
| SBP00130 | Greek Ripe Black Olives | *Marinobacter similis* |
| SBP00130 | Greek Ripe Black Olives | *Marinobacter similis* |
| SBP00130 | Greek Ripe Black Olives | *Marinobacter* sp. Arc7-DN-1 |
| SBP00130 | Greek Ripe Black Olives | *Marinobacter* sp. Arc7-DN-1 |
| SBP00130 | Greek Ripe Black Olives | *Marinobacter* sp. BSs20148 |
| SBP00130 | Greek Ripe Black Olives | *Marinobacter* sp. BSs20148 |
| SBP00130 | Greek Ripe Black Olives | *Marinobacter* sp. CP1 |
| SBP00130 | Greek Ripe Black Olives | *Marinobacter* sp. CP1 |
| SBP00130 | Greek Ripe Black Olives | *Marinobacter* sp. es.042 |
| SBP00130 | Greek Ripe Black Olives | *Marinobacter* sp. es.042 |
| SBP00130 | Greek Ripe Black Olives | *Marinobacter* sp. LQ44 |
| SBP00130 | Greek Ripe Black Olives | *Marinobacter* sp. LQ44 |
| SBP00130 | Greek Ripe Black Olives | *Marinobacter* sp. LV10RS10-11A |
| SBP00130 | Greek Ripe Black Olives | *Marinobacter* sp. LV10RS10-11A |
| SBP00130 | Greek Ripe Black Olives | *Marinobacterium aestuarii* |
| SBP00130 | Greek Ripe Black Olives | *Marinobacterium aestuarii* |
| SBP00130 | Greek Ripe Black Olives | *Marinomonas mediterranea* |
| SBP00130 | Greek Ripe Black Olives | *Marinomonas mediterranea* |
| SBP00130 | Greek Ripe Black Olives | *Marinomonas posidonica* |
| SBP00130 | Greek Ripe Black Olives | *Marinomonas posidonica* |
| SBP00130 | Greek Ripe Black Olives | *Marinomonas primoryensis* |
| SBP00130 | Greek Ripe Black Olives | *Marinomonas primoryensis* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Marinomonas sp. FW-1* |
| SBP00130 | Greek Ripe Black Olives | *Marinomonas sp. FW-1* |
| SBP00130 | Greek Ripe Black Olives | *Marinovum algicola* |
| SBP00130 | Greek Ripe Black Olives | *Marinovum algicola* |
| SBP00130 | Greek Ripe Black Olives | *Mariprofundus ferrinatatus* |
| SBP00130 | Greek Ripe Black Olives | *Mariprofundus ferrinatatus* |
| SBP00130 | Greek Ripe Black Olives | *Marivivens sp. JLT3646* |
| SBP00130 | Greek Ripe Black Olives | *Marivivens sp. ILT3646* |
| SBP00130 | Greek Ripe Black Olives | *Martelella sp. AD-3* |
| SBP00130 | Greek Ripe Black Olives | *Martelella sp. AD-3* |
| SBP00130 | Greek Ripe Black Olives | *Massilia albidiflava* |
| SBP00130 | Greek Ripe Black Olives | *Massilia albidiflava* |
| SBP00130 | Greek Ripe Black Olives | *Massilia armeniaca* |
| SBP00130 | Greek Ripe Black Olives | *Massilia armeniaca* |
| SBP00130 | Greek Ripe Black Olives | *Massilia lutea* |
| SBP00130 | Greek Ripe Black Olives | *Massilia lutea* |
| SBP00130 | Greek Ripe Black Olives | *Massilia oculi* |
| SBP00130 | Greek Ripe Black Olives | *Massilia oculi* |
| SBP00130 | Greek Ripe Black Olives | *Massilia plicata* |
| SBP00130 | Greek Ripe Black Olives | *Massilia plicata* |
| SBP00130 | Greek Ripe Black Olives | *Massilia putida* |
| SBP00130 | Greek Ripe Black Olives | *Massilia putida* |
| SBP00130 | Greek Ripe Black Olives | *Massilia sp. NR 4-1* |
| SBP00130 | Greek Ripe Black Olives | *Massilia sp. NR 4-1* |
| SBP00130 | Greek Ripe Black Olives | *Massilia sp. WG5* |
| SBP00130 | Greek Ripe Black Olives | *Massilia sp. WGS* |
| SBP00130 | Greek Ripe Black Olives | *Massilia sp. YMA4* |
| SBP00130 | Greek Ripe Black Olives | *Massilia sp. YMA4* |
| SBP00130 | Greek Ripe Black Olives | *Massilia umbonata* |
| SBP00130 | Greek Ripe Black Olives | *Massilia umbonata* |
| SBP00130 | Greek Ripe Black Olives | *Massilia violaceinigra* |
| SBP00130 | Greek Ripe Black Olives | *Massilia violaceinigra* |
| SBP00130 | Greek Ripe Black Olives | *Melaminivora sp. SC2-7* |
| SBP00130 | Greek Ripe Black Olives | *Melaminivora sp. SC2-7* |
| SBP00130 | Greek Ripe Black Olives | *Melaminivora sp. SC2-9* |
| SBP00130 | Greek Ripe Black Olives | *Melaminivora sp. SC2-9* |
| SBP00130 | Greek Ripe Black Olives | *Melissococcus plutonius* |
| SBP00130 | Greek Ripe Black Olives | *Melissococcus plutonius* |
| SBP00130 | Greek Ripe Black Olives | *Melittangium boletus* |
| SBP00130 | Greek Ripe Black Olives | *Melittangium boletus* |
| SBP00130 | Greek Ripe Black Olives | *Mesorhizobium amorphae* |
| SBP00130 | Greek Ripe Black Olives | *Mesorhizobium amorphae* |
| SBP00130 | Greek Ripe Black Olives | *Mesorhizobium australicum* |
| SBP00130 | Greek Ripe Black Olives | *Mesorhizobium australicum* |
| SBP00130 | Greek Ripe Black Olives | *Mesorhizobium ciceri* |
| SBP00130 | Greek Ripe Black Olives | *Mesorhizobium ciceri* |
| SBP00130 | Greek Ripe Black Olives | *Mesorhizobium oceanicum* |
| SBP00130 | Greek Ripe Black Olives | *Mesorhizobium oceanicum* |
| SBP00130 | Greek Ripe Black Olives | *Mesorhizobium sp. M1D.F.Ca.ET.043.01.1.1* |
| SBP00130 | Greek Ripe Black Olives | *Mesorhizobium sp. M1D.F.Ca.ET.043.01.1.1* |
| SBP00130 | Greek Ripe Black Olives | *Mesorhizobium sp. M1E.F.Ca.ET.045.02.1.1* |
| SBP00130 | Greek Ripe Black Olives | *Mesorhizobium sp. M1E.F.Ca.ET.045.02.1.1* |
| SBP00130 | Greek Ripe Black Olives | *Mesorhizobium sp. M2A.F.Ca.ET.043.05.1.1* |
| SBP00130 | Greek Ripe Black Olives | *Mesorhizobium sp. M2A.F.Ca.ET.043.05.1.1* |
| SBP00130 | Greek Ripe Black Olives | *Mesorhizobium sp. M3A.F.Ca.ET.080.04.2.1* |
| SBP00130 | Greek Ripe Black Olives | *Mesorhizobium sp. M3A.F.Ca.ET.080.04.2.1* |
| SBP00130 | Greek Ripe Black Olives | *Mesorhizobium sp. M4B.F.Ca.ET.058.02.1.1* |
| SBP00130 | Greek Ripe Black Olives | *Mesorhizobium sp. M4B.F.Ca.ET.058.02.1.1* |
| SBP00130 | Greek Ripe Black Olives | *Mesorhizobium sp. M6A.T.Cr.TU.016.01.1.1* |
| SBP00130 | Greek Ripe Black Olives | *Mesorhizobium sp. M6A.T.Cr.TU.016.01.1.1* |
| SBP00130 | Greek Ripe Black Olives | *Mesorhizobium sp. M7A.F.Ce.TU.012.03.2.1* |
| SBP00130 | Greek Ripe Black Olives | *Mesorhizobium sp. M7A.F.Ce.TU.012.03.2.1* |
| SBP00130 | Greek Ripe Black Olives | *Mesorhizobium sp. M7D.F.Ca.US.005.01.1.1* |
| SBP00130 | Greek Ripe Black Olives | *Mesorhizobium sp. M7D.F.Ca.US.005.01.1.1* |
| SBP00130 | Greek Ripe Black Olives | *Mesorhizobium sp. M9A.F.Ca.ET.002.03.1.2* |
| SBP00130 | Greek Ripe Black Olives | *Mesorhizobium sp. M9A.F.Ca.ET.002.03.1.2* |
| SBP00130 | Greek Ripe Black Olives | *Mesorhizobium sp. WSM1497* |
| SBP00130 | Greek Ripe Black Olives | *Mesorhizobium sp. WSM1497* |
| SBP00130 | Greek Ripe Black Olives | *Metakosakonia sp. MRY16-398* |
| SBP00130 | Greek Ripe Black Olives | *Metakosakonia sp. MRY16-398* |
| SBP00130 | Greek Ripe Black Olives | *Methylibium petroleiphilum* |
| SBP00130 | Greek Ripe Black Olives | *Methylibium petroleiphilum* |
| SBP00130 | Greek Ripe Black Olives | *Methylobacillus flagellatus* |
| SBP00130 | Greek Ripe Black Olives | *Methylobacillus flagellatus* |
| SBP00130 | Greek Ripe Black Olives | *Methylobacterium aquaticum* |
| SBP00130 | Greek Ripe Black Olives | *Methylobacterium aquaticum* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Methylobacterium brachiatum* |
| SBP00130 | Greek Ripe Black Olives | *Methylobacterium brachiatum* |
| SBP00130 | Greek Ripe Black Olives | *Methylobacterium currus* |
| SBP00130 | Greek Ripe Black Olives | *Methylobacterium currus* |
| SBP00130 | Greek Ripe Black Olives | *Methylobacterium nodulans* |
| SBP00130 | Greek Ripe Black Olives | *Methylobacterium nodulans* |
| SBP00130 | Greek Ripe Black Olives | *Methylobacterium radiotolerans* |
| SBP00130 | Greek Ripe Black Olives | *Methylobacterium radiotolerans* |
| SBP00130 | Greek Ripe Black Olives | *Methylobacterium* sp. 17Sr1-1 |
| SBP00130 | Greek Ripe Black Olives | *Methylobacterium* sp. 17Sr1-1 |
| SBP00130 | Greek Ripe Black Olives | *Methylobacterium* sp. 17Sr1-43 |
| SBP00130 | Greek Ripe Black Olives | *Methylobacterium* sp. 17Sr1-43 |
| SBP00130 | Greek Ripe Black Olives | *Methylobacterium* sp. 4-46 |
| SBP00130 | Greek Ripe Black Olives | *Methylobacterium* sp. 4-46 |
| SBP00130 | Greek Ripe Black Olives | *Methylobacterium* sp. C1 |
| SBP00130 | Greek Ripe Black Olives | *Methylobacterium* sp. C1 |
| SBP00130 | Greek Ripe Black Olives | *Methylobacterium* sp. DM1 |
| SBP00130 | Greek Ripe Black Olives | *Methylobacterium* sp. DM1 |
| SBP00130 | Greek Ripe Black Olives | *Methylocaldum marinum* |
| SBP00130 | Greek Ripe Black Olives | *Methylocaldum marinum* |
| SBP00130 | Greek Ripe Black Olives | *Methylocella silvestris* |
| SBP00130 | Greek Ripe Black Olives | *Methylocella silvestris* |
| SBP00130 | Greek Ripe Black Olives | *Methylocella tundrae* |
| SBP00130 | Greek Ripe Black Olives | *Methylocella tundrae* |
| SBP00130 | Greek Ripe Black Olives | *Methylomicrobium album* |
| SBP00130 | Greek Ripe Black Olives | *Methylomicrobium album* |
| SBP00130 | Greek Ripe Black Olives | *Methylomicrobium buryatense* |
| SBP00130 | Greek Ripe Black Olives | *Methylomicrobium buryatense* |
| SBP00130 | Greek Ripe Black Olives | *Methylomonas denitrificans* |
| SBP00130 | Greek Ripe Black Olives | *Methylomonas denitrificans* |
| SBP00130 | Greek Ripe Black Olives | *Methylomonas methanica* |
| SBP00130 | Greek Ripe Black Olives | *Methylomonas methanica* |
| SBP00130 | Greek Ripe Black Olives | *Methylomonas* sp. LW13 |
| SBP00130 | Greek Ripe Black Olives | *Methylomonas* sp. LW13 |
| SBP00130 | Greek Ripe Black Olives | *Methylophaga frappieri* |
| SBP00130 | Greek Ripe Black Olives | *Methylophaga frappieri* |
| SBP00130 | Greek Ripe Black Olives | *Methylophaga nitratireducenticrescens* |
| SBP00130 | Greek Ripe Black Olives | *Methylophaga nitratireducenticrescens* |
| SBP00130 | Greek Ripe Black Olives | *Methylorubrum extorquens* |
| SBP00130 | Greek Ripe Black Olives | *Methylorubrum extorquens* |
| SBP00130 | Greek Ripe Black Olives | *Methylorubrum populi* |
| SBP00130 | Greek Ripe Black Olives | *Methylorubrum populi* |
| SBP00130 | Greek Ripe Black Olives | *Methyloversatilis* sp. RAC08 |
| SBP00130 | Greek Ripe Black Olives | *Methyloversatilis* sp. RAC08 |
| SBP00130 | Greek Ripe Black Olives | *Methylovorus glucosotrophus* |
| SBP00130 | Greek Ripe Black Olives | *Methylovorus glucosotrophus* |
| SBP00130 | Greek Ripe Black Olives | *Methylovulum psychrotolerans* |
| SBP00130 | Greek Ripe Black Olives | *Methylovulum psychrotolerans* |
| SBP00130 | Greek Ripe Black Olives | *Microbacterium hominis* |
| SBP00130 | Greek Ripe Black Olives | *Microbacterium hominis* |
| SBP00130 | Greek Ripe Black Olives | *Microbacterium* sp. PAMC 28756 |
| SBP00130 | Greek Ripe Black Olives | *Microbacterium* sp. PAMC 28756 |
| SBP00130 | Greek Ripe Black Olives | *Microbacterium* sp. PM5 |
| SBP00130 | Greek Ripe Black Olives | *Microbacterium* sp. PM5 |
| SBP00130 | Greek Ripe Black Olives | *Microbacterium* sp. Y-01 |
| SBP00130 | Greek Ripe Black Olives | *Microbacterium* sp. Y-01 |
| SBP00130 | Greek Ripe Black Olives | *Microbulbifer agarilyticus* |
| SBP00130 | Greek Ripe Black Olives | *Microbulbifer agarilyticus* |
| SBP00130 | Greek Ripe Black Olives | *Microbulbifer aggregans* |
| SBP00130 | Greek Ripe Black Olives | *Microbulbifer aggregans* |
| SBP00130 | Greek Ripe Black Olives | *Microbulbifer* sp. A4B17 |
| SBP00130 | Greek Ripe Black Olives | *Microbulbifer* sp. A4B17 |
| SBP00130 | Greek Ripe Black Olives | *Microbulbifer thermotolerans* |
| SBP00130 | Greek Ripe Black Olives | *Microbulbifer thermotolerans* |
| SBP00130 | Greek Ripe Black Olives | *Microlunatus soli* |
| SBP00130 | Greek Ripe Black Olives | *Microlunatus soli* |
| SBP00130 | Greek Ripe Black Olives | *Micromonospora coxensis* |
| SBP00130 | Greek Ripe Black Olives | *Micromonospora coxensis* |
| SBP00130 | Greek Ripe Black Olives | *Micromonospora echinofusca* |
| SBP00130 | Greek Ripe Black Olives | *Micromonospora echinofusca* |
| SBP00130 | Greek Ripe Black Olives | *Micromonospora tulbaghiae* |
| SBP00130 | Greek Ripe Black Olives | *Micromonospora tulbaghiae* |
| SBP00130 | Greek Ripe Black Olives | *Micromonospora viridifaciens* |
| SBP00130 | Greek Ripe Black Olives | *Micromonospora viridifaciens* |
| SBP00130 | Greek Ripe Black Olives | *Microvirga ossetica* |
| SBP00130 | Greek Ripe Black Olives | *Microvirga ossetica* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Microvirga* sp. 17 mud 1-3 |
| SBP00130 | Greek Ripe Black Olives | *Microvirga* sp. 17 mud 1-3 |
| SBP00130 | Greek Ripe Black Olives | *Microvirgula aerodenitrificans* |
| SBP00130 | Greek Ripe Black Olives | *Microvirgula aerodenitrificans* |
| SBP00130 | Greek Ripe Black Olives | *Mitsuaria* sp. 7 |
| SBP00130 | Greek Ripe Black Olives | *Mitsuaria* sp. 7 |
| SBP00130 | Greek Ripe Black Olives | *Mixta gaviniae* |
| SBP00130 | Greek Ripe Black Olives | *Mixta gaviniae* |
| SBP00130 | Greek Ripe Black Olives | *Moraxella catarrhalis* |
| SBP00130 | Greek Ripe Black Olives | *Moraxella catarrhalis* |
| SBP00130 | Greek Ripe Black Olives | *Moraxella cuniculi* |
| SBP00130 | Greek Ripe Black Olives | *Moraxella cuniculi* |
| SBP00130 | Greek Ripe Black Olives | *Moraxella osloensis* |
| SBP00130 | Greek Ripe Black Olives | *Moraxella osloensis* |
| SBP00130 | Greek Ripe Black Olives | *Moraxella ovis* |
| SBP00130 | Greek Ripe Black Olives | *Moraxella ovis* |
| SBP00130 | Greek Ripe Black Olives | *Moraxellaceae bacterium* HYN0046 |
| SBP00130 | Greek Ripe Black Olives | *Moraxellaceae bacterium* HYN0046 |
| SBP00130 | Greek Ripe Black Olives | *Morganella morganii* |
| SBP00130 | Greek Ripe Black Olives | *Morganella morganil* |
| SBP00130 | Greek Ripe Black Olives | *Moritella viscosa* |
| SBP00130 | Greek Ripe Black Olives | *Moritella viscosa* |
| SBP00130 | Greek Ripe Black Olives | *Mycoavidus cysteinexigens* |
| SBP00130 | Greek Ripe Black Olives | *Mycoavidus cysteinexigens* |
| SBP00130 | Greek Ripe Black Olives | *Mycobacterium kansasii* |
| SBP00130 | Greek Ripe Black Olives | *Mycobacterium kansasii* |
| SBP00130 | Greek Ripe Black Olives | *Mycobacterium phage* Whirlwind |
| SBP00130 | Greek Ripe Black Olives | *Mycobacterium phage* Whirlwind |
| SBP00130 | Greek Ripe Black Olives | *Mycobacterium* sp. EPa45 |
| SBP00130 | Greek Ripe Black Olives | *Mycobacterium* sp. EPa45 |
| SBP00130 | Greek Ripe Black Olives | *Mycobacterium* sp. MS1601 |
| SBP00130 | Greek Ripe Black Olives | *Mycobacterium* sp. MS1601 |
| SBP00130 | Greek Ripe Black Olives | *Mycobacterium* sp. PYR15 |
| SBP00130 | Greek Ripe Black Olives | *Mycobacterium* sp. PYR15 |
| SBP00130 | Greek Ripe Black Olives | *Mycobacteroides saopaulense* |
| SBP00130 | Greek Ripe Black Olives | *Mycobacteroides saopaulense* |
| SBP00130 | Greek Ripe Black Olives | *Mycolicibacterium flavescens* |
| SBP00130 | Greek Ripe Black Olives | *Mycolicibacterium flavescens* |
| SBP00130 | Greek Ripe Black Olives | *Mycolicibacterium hassiacum* |
| SBP00130 | Greek Ripe Black Olives | *Mycolicibacterium hassiacum* |
| SBP00130 | Greek Ripe Black Olives | *Mycolicibacterium smegmatis* |
| SBP00130 | Greek Ripe Black Olives | *Mycolicibacterium smegmatis* |
| SBP00130 | Greek Ripe Black Olives | *Mycolicibacterium thermoresistibile* |
| SBP00130 | Greek Ripe Black Olives | *Mycolicibacterium thermoresistibile* |
| SBP00130 | Greek Ripe Black Olives | *Mycolicibacterium vaccae* |
| SBP00130 | Greek Ripe Black Olives | *Mycolicibacterium vaccae* |
| SBP00130 | Greek Ripe Black Olives | *Myxococcus fulvus* |
| SBP00130 | Greek Ripe Black Olives | *Myxococcus fulvus* |
| SBP00130 | Greek Ripe Black Olives | *Neisseria elongata* |
| SBP00130 | Greek Ripe Black Olives | *Neisseria elongata* |
| SBP00130 | Greek Ripe Black Olives | *Neisseria gonorrhoeae* |
| SBP00130 | Greek Ripe Black Olives | *Neisseria gonorrhoeae* |
| SBP00130 | Greek Ripe Black Olives | *Neisseria polysaccharea* |
| SBP00130 | Greek Ripe Black Olives | *Neisseria polysaccharea* |
| SBP00130 | Greek Ripe Black Olives | *Neisseria* sp. 10022 |
| SBP00130 | Greek Ripe Black Olives | *Neisseria* sp. 10022 |
| SBP00130 | Greek Ripe Black Olives | *Neisseria* sp. oral taxon 014 |
| SBP00130 | Greek Ripe Black Olives | *Neisseria* sp. oral taxon 014 |
| SBP00130 | Greek Ripe Black Olives | *Neisseria subflava* |
| SBP00130 | Greek Ripe Black Olives | *Neisseria subflava* |
| SBP00130 | Greek Ripe Black Olives | *Neisseria weaveri* |
| SBP00130 | Greek Ripe Black Olives | *Neisseria weaveri* |
| SBP00130 | Greek Ripe Black Olives | *Neoasaia chiangmaiensis* |
| SBP00130 | Greek Ripe Black Olives | *Neoasaia chiangmaiensis* |
| SBP00130 | Greek Ripe Black Olives | *Neokomagataea tanensis* |
| SBP00130 | Greek Ripe Black Olives | *Neokomagataea tanensis* |
| SBP00130 | Greek Ripe Black Olives | *Neorhizobium galegae* |
| SBP00130 | Greek Ripe Black Olives | *Neorhizobium galegae* |
| SBP00130 | Greek Ripe Black Olives | *Neorhizobium* sp. NCHU2750 |
| SBP00130 | Greek Ripe Black Olives | *Neorhizobium* sp. NCHU2750 |
| SBP00130 | Greek Ripe Black Olives | *Neorhizobium* sp. SOG26 |
| SBP00130 | Greek Ripe Black Olives | *Neorhizobium* sp. SOG26 |
| SBP00130 | Greek Ripe Black Olives | *Nissabacter* sp. SGAir0207 |
| SBP00130 | Greek Ripe Black Olives | *Nissabacter* sp. SGAir0207 |
| SBP00130 | Greek Ripe Black Olives | *Nitratireductor basaltis* |
| SBP00130 | Greek Ripe Black Olives | *Nitratireductor basaltis* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Nitratireductor* sp. OM-1 |
| SBP00130 | Greek Ripe Black Olives | *Nitratireductor* sp. OM-1 |
| SBP00130 | Greek Ripe Black Olives | *Nitrosomonas ureae* |
| SBP00130 | Greek Ripe Black Olives | *Nitrosomonas ureae* |
| SBP00130 | Greek Ripe Black Olives | *Nitrosospira briensis* |
| SBP00130 | Greek Ripe Black Olives | *Nitrosospira briensis* |
| SBP00130 | Greek Ripe Black Olives | *Nitrosospira lacus* |
| SBP00130 | Greek Ripe Black Olives | *Nitrosospira lacus* |
| SBP00130 | Greek Ripe Black Olives | *Niveispirillum cyanobacteriorum* |
| SBP00130 | Greek Ripe Black Olives | *Niveispirillum cyanobacteriorum* |
| SBP00130 | Greek Ripe Black Olives | *Nocardia asteroides* |
| SBP00130 | Greek Ripe Black Olives | *Nocardia asteroides* |
| SBP00130 | Greek Ripe Black Olives | *Nocardia brasiliensis* |
| SBP00130 | Greek Ripe Black Olives | *Nocardia brasiliensis* |
| SBP00130 | Greek Ripe Black Olives | *Nocardia cyriacigeorgica* |
| SBP00130 | Greek Ripe Black Olives | *Nocardia cyriacigeorgica* |
| SBP00130 | Greek Ripe Black Olives | *Nocardia nova* |
| SBP00130 | Greek Ripe Black Olives | *Nocardia nova* |
| SBP00130 | Greek Ripe Black Olives | *Nocardia seriolae* |
| SBP00130 | Greek Ripe Black Olives | *Nocardia seriolae* |
| SBP00130 | Greek Ripe Black Olives | *Nocardia* sp. CFHS0054 |
| SBP00130 | Greek Ripe Black Olives | *Nocardia* sp. CFHS0054 |
| SBP00130 | Greek Ripe Black Olives | *Nocardia* sp. CS682 |
| SBP00130 | Greek Ripe Black Olives | *Nocardia* sp. CS682 |
| SBP00130 | Greek Ripe Black Olives | *Nocardia* sp. Y48 |
| SBP00130 | Greek Ripe Black Olives | *Nocardia* sp. Y48 |
| SBP00130 | Greek Ripe Black Olives | *Nocardiopsis dassonvillei* |
| SBP00130 | Greek Ripe Black Olives | *Nocardiopsis dassonvillei* |
| SBP00130 | Greek Ripe Black Olives | *Nostoc carneum* |
| SBP00130 | Greek Ripe Black Olives | *Nostoc carneum* |
| SBP00130 | Greek Ripe Black Olives | *Nostoc flagelliforme* |
| SBP00130 | Greek Ripe Black Olives | *Nostoc flagelliforme* |
| SBP00130 | Greek Ripe Black Olives | *Novosphingobium resinovorum* |
| SBP00130 | Greek Ripe Black Olives | *Novosphingobium resinovorum* |
| SBP00130 | Greek Ripe Black Olives | *Novosphingobium* sp. P6W |
| SBP00130 | Greek Ripe Black Olives | *Novosphingobium* sp. P6W |
| SBP00130 | Greek Ripe Black Olives | *Obesumbacterium proteus* |
| SBP00130 | Greek Ripe Black Olives | *Obesumbacterium proteus* |
| SBP00130 | Greek Ripe Black Olives | *Oblitimonas alkaliphila* |
| SBP00130 | Greek Ripe Black Olives | *Oblitimonas alkaliphila* |
| SBP00130 | Greek Ripe Black Olives | *Oceanicoccus sagamiensis* |
| SBP00130 | Greek Ripe Black Olives | *Oceanicoccus sagamiensis* |
| SBP00130 | Greek Ripe Black Olives | *Oceanimonas* sp. GK1 |
| SBP00130 | Greek Ripe Black Olives | *Oceanimonas* sp. GK1 |
| SBP00130 | Greek Ripe Black Olives | *Oceanisphaera profunda* |
| SBP00130 | Greek Ripe Black Olives | *Oceanisphaera profunda* |
| SBP00130 | Greek Ripe Black Olives | *Ochrobactrum anthropi* |
| SBP00130 | Greek Ripe Black Olives | *Ochrobactrum anthropi* |
| SBP00130 | Greek Ripe Black Olives | *Ochrobactrum pseudogrignonense* |
| SBP00130 | Greek Ripe Black Olives | *Ochrobactrum pseudogrignonense* |
| SBP00130 | Greek Ripe Black Olives | *Oenococcus oeni* |
| SBP00130 | Greek Ripe Black Olives | *Oenococcus oeni* |
| SBP00130 | Greek Ripe Black Olives | *Oenococcus* sp. UCMA 16435 |
| SBP00130 | Greek Ripe Black Olives | *Oenococcus* sp. UCMA 16435 |
| SBP00130 | Greek Ripe Black Olives | *Oleispira antarctica* |
| SBP00130 | Greek Ripe Black Olives | *Oleispira antarctica* |
| SBP00130 | Greek Ripe Black Olives | *Oligella urethralis* |
| SBP00130 | Greek Ripe Black Olives | *Oligella urethralis* |
| SBP00130 | Greek Ripe Black Olives | *Oligotropha carboxidovorans* |
| SBP00130 | Greek Ripe Black Olives | *Oligotropha carboxidovorans* |
| SBP00130 | Greek Ripe Black Olives | *Orrella dioscoreae* |
| SBP00130 | Greek Ripe Black Olives | *Orrella dioscoreae* |
| SBP00130 | Greek Ripe Black Olives | *Ottowia oryzae* |
| SBP00130 | Greek Ripe Black Olives | *Ottowia oryzae* |
| SBP00130 | Greek Ripe Black Olives | *Ottowia* sp. ora taxon 894 |
| SBP00130 | Greek Ripe Black Olives | *Ottowia* sp. ora taxon 894 |
| SBP00130 | Greek Ripe Black Olives | *Paenibacillus beijingensis* |
| SBP00130 | Greek Ripe Black Olives | *Paenibacillus beijingensis* |
| SBP00130 | Greek Ripe Black Olives | *Paenibacillus crassostreae* |
| SBP00130 | Greek Ripe Black Olives | *Paenibacillus crassostreae* |
| SBP00130 | Greek Ripe Black Olives | *Paenibacillus* sp. 320-W |
| SBP00130 | Greek Ripe Black Olives | *Paenibacillus* sp. 320-W |
| SBP00130 | Greek Ripe Black Olives | *Paenibacillus* sp. FSL R5-0345 |
| SBP00130 | Greek Ripe Black Olives | *Paenibacillus* sp. FSL R5-0345 |
| SBP00130 | Greek Ripe Black Olives | *Paenibacillus* sp. FSL R7-0273 |
| SBP00130 | Greek Ripe Black Olives | *Paenibacillus* sp. FSL R7-0273 |

TABLE 3-continued

List of species identified in each metagenomic sample of each SBP Sample

| SBP ID | SBP Host Common Name | Genus sp. |
| --- | --- | --- |
| SBP00130 | Greek Ripe Black Olives | *Paenibacillus* sp. JDR-2 |
| SBP00130 | Greek Ripe Black Olives | *Paenibacillus* sp. JDR-2 |
| SBP00130 | Greek Ripe Black Olives | *Pandoraea norimbergensis* |
| SBP00130 | Greek Ripe Black Olives | *Pandoraea norimbergensis* |
| SBP00130 | Greek Ripe Black Olives | *Pandoraea oxalativorans* |
| SBP00130 | Greek Ripe Black Olives | *Pandoraea oxalativorans* |
| SBP00130 | Greek Ripe Black Olives | *Pandoraea pnomenusa* |
| SBP00130 | Greek Ripe Black Olives | *Pandoraea pnomenusa* |
| SBP00130 | Greek Ripe Black Olives | *Pandoraea pulmonicola* |
| SBP00130 | Greek Ripe Black Olives | *Pandoraea pulmonicola* |
| SBP00130 | Greek Ripe Black Olives | *Pandoraea sputorum* |
| SBP00130 | Greek Ripe Black Olives | *Pandoraea sputorum* |
| SBP00130 | Greek Ripe Black Olives | *Pandoraea vervacti* |
| SBP00130 | Greek Ripe Black Olives | *Pandoraea vervacti* |
| SBP00130 | Greek Ripe Black Olives | *Pannonibacter phragmitetus* |
| SBP00130 | Greek Ripe Black Olives | *Pannonibacter phragmitetus* |
| SBP00130 | Greek Ripe Black Olives | *Pantoea agglomerans* |
| SBP00130 | Greek Ripe Black Olives | *Pantoea agglomerans* |
| SBP00130 | Greek Ripe Black Olives | *Pantoea alhagi* |
| SBP00130 | Greek Ripe Black Olives | *Pantoea alhagi* |
| SBP00130 | Greek Ripe Black Olives | *Pantoea ananatis* |
| SBP00130 | Greek Ripe Black Olives | *Pantoea ananatis* |
| SBP00130 | Greek Ripe Black Olives | *Pantoea rwandensis* |
| SBP00130 | Greek Ripe Black Olives | *Pantoea rwandensis* |
| SBP00130 | Greek Ripe Black Olives | *Pantoea* sp. At-9b |
| SBP00130 | Greek Ripe Black Olives | *Pantoea* sp. At-9b |
| SBP00130 | Greek Ripe Black Olives | *Pantoea* sp. PSNIH1 |
| SBP00130 | Greek Ripe Black Olives | *Pantoea* sp. PSNIH1 |
| SBP00130 | Greek Ripe Black Olives | *Pantoea stewartii* |
| SBP00130 | Greek Ripe Black Olives | *Pantoea stewartii* |
| SBP00130 | Greek Ripe Black Olives | *Pantoea vagans* |
| SBP00130 | Greek Ripe Black Olives | *Pantoea vagans* |
| SBP00130 | Greek Ripe Black Olives | *Paraburkholderia caffeinilytica* |
| SBP00130 | Greek Ripe Black Olives | *Paraburkholderia caffeinilytica* |
| SBP00130 | Greek Ripe Black Olives | *Paraburkholderia caledonica* |
| SBP00130 | Greek Ripe Black Olives | *Paraburkholderia caledonica* |
| SBP00130 | Greek Ripe Black Olives | *Paraburkholderia caribensis* |
| SBP00130 | Greek Ripe Black Olives | *Paraburkholderia caribensis* |
| SBP00130 | Greek Ripe Black Olives | *Paraburkholderia fungorum* |
| SBP00130 | Greek Ripe Black Olives | *Paraburkholderia fungorum* |
| SBP00130 | Greek Ripe Black Olives | *Paraburkholderia hospita* |
| SBP00130 | Greek Ripe Black Olives | *Paraburkholderia hospita* |
| SBP00130 | Greek Ripe Black Olives | *Paraburkholderia phenoliruptrix* |
| SBP00130 | Greek Ripe Black Olives | *Paraburkholderia phenoliruptrix* |
| SBP00130 | Greek Ripe Black Olives | *Paraburkholderia phymatum* |
| SBP00130 | Greek Ripe Black Olives | *Paraburkholderia phymatum* |
| SBP00130 | Greek Ripe Black Olives | *Paraburkholderia phytofirmans* |
| SBP00130 | Greek Ripe Black Olives | *Paraburkholderia phytofirmans* |
| SBP00130 | Greek Ripe Black Olives | *Paraburkholderia rhizoxinica* |
| SBP00130 | Greek Ripe Black Olives | *Paraburkholderia rhizoxinica* |
| SBP00130 | Greek Ripe Black Olives | *Paraburkholderia* sp. SOS3 |
| SBP00130 | Greek Ripe Black Olives | *Paraburkholderia* sp. SOS3 |
| SBP00130 | Greek Ripe Black Olives | *Paraburkholderia sprentiae* |
| SBP00130 | Greek Ripe Black Olives | *Paraburkholderia sprentiae* |
| SBP00130 | Greek Ripe Black Olives | *Paraburkholderia xenovorans* |
| SBP00130 | Greek Ripe Black Olives | *Paraburkholderia xenovorans* |
| SBP00130 | Greek Ripe Black Olives | *Paracoccus aminophilus* |
| SBP00130 | Greek Ripe Black Olives | *Paracoccus aminophilus* |
| SBP00130 | Greek Ripe Black Olives | *Paracoccus* sp. Arc7-R13 |
| SBP00130 | Greek Ripe Black Olives | *Paracoccus* sp. Arc7-R13 |
| SBP00130 | Greek Ripe Black Olives | *Paracoccus* sp. CBA4604 |
| SBP00130 | Greek Ripe Black Olives | *Paracoccus* sp. CBA4604 |
| SBP00130 | Greek Ripe Black Olives | *Paracoccus zhejiangensis* |
| SBP00130 | Greek Ripe Black Olives | *Paracoccus zhejiangensis* |
| SBP00130 | Greek Ripe Black Olives | *Pararhodospirillum photometricum* |
| SBP00130 | Greek Ripe Black Olives | *Pararhodospirillum photometricum* |
| SBP00130 | Greek Ripe Black Olives | *Pasteurella multocida* |
| SBP00130 | Greek Ripe Black Olives | *Pasteurella multocida* |
| SBP00130 | Greek Ripe Black Olives | *Paucibacter* sp. KCTC 42545 |
| SBP00130 | Greek Ripe Black Olives | *Paucibacter* sp. KCTC 42545 |
| SBP00130 | Greek Ripe Black Olives | *Pectobacterium atrosepticum* |
| SBP00130 | Greek Ripe Black Olives | *Pectobacterium atrosepticum* |
| SBP00130 | Greek Ripe Black Olives | *Pectobacterium carotovorum* |
| SBP00130 | Greek Ripe Black Olives | *Pectobacterium carotovorum* |
| SBP00130 | Greek Ripe Black Olives | *Pectobacterium parmentieri* |
| SBP00130 | Greek Ripe Black Olives | *Pectobacterium parmentieri* |

TABLE 3-continued

List of species identified in each metagenomic sample of each SBP Sample

| SBP ID | SBP Host Common Name | Genus sp. |
| --- | --- | --- |
| SBP00130 | Greek Ripe Black Olives | *Pectobacterium polaris* |
| SBP00130 | Greek Ripe Black Olives | *Pectobacterium polaris* |
| SBP00130 | Greek Ripe Black Olives | *Pectobacterium wasabiae* |
| SBP00130 | Greek Ripe Black Olives | *Pectobacterium wasabiae* |
| SBP00130 | Greek Ripe Black Olives | *Pediococcus acidilactici* |
| SBP00130 | Greek Ripe Black Olives | *Pediococcus acidilactici* |
| SBP00130 | Greek Ripe Black Olives | *Pediococcus claussenii* |
| SBP00130 | Greek Ripe Black Olives | *Pediococcus claussenii* |
| SBP00130 | Greek Ripe Black Olives | *Pediococcus damnosus* |
| SBP00130 | Greek Ripe Black Olives | *Pediococcus damnosus* |
| SBP00130 | Greek Ripe Black Olives | *Pediococcus inopinatus* |
| SBP00130 | Greek Ripe Black Olives | *Pediococcus inopinatus* |
| SBP00130 | Greek Ripe Black Olives | *Pediococcus pentosaceus* |
| SBP00130 | Greek Ripe Black Olives | *Pediococcus pentosaceus* |
| SBP00130 | Greek Ripe Black Olives | *Pedobacter* sp. eg |
| SBP00130 | Greek Ripe Black Olives | *Pedobacter* sp. eg |
| SBP00130 | Greek Ripe Black Olives | *Pelobacter carbinolicus* |
| SBP00130 | Greek Ripe Black Olives | *Pelobacter carbinolicus* |
| SBP00130 | Greek Ripe Black Olives | *Phaeobacter inhibens* |
| SBP00130 | Greek Ripe Black Olives | *Phaeobacter inhibens* |
| SBP00130 | Greek Ripe Black Olives | *Phaeobacter piscinae* |
| SBP00130 | Greek Ripe Black Olives | *Phaeobacter piscinae* |
| SBP00130 | Greek Ripe Black Olives | *Phenylobacterium* sp. HYN0004 |
| SBP00130 | Greek Ripe Black Olives | *Phenylobacterium* sp. HYN0004 |
| SBP00130 | Greek Ripe Black Olives | *Photobacterium darselae* |
| SBP00130 | Greek Ripe Black Olives | *Photobacterium damselae* |
| SBP00130 | Greek Ripe Black Olives | *Photobacterium profundum* |
| SBP00130 | Greek Ripe Black Olives | *Photobacterium profundum* |
| SBP00130 | Greek Ripe Black Olives | *Phreatobacter cathodiphilus* |
| SBP00130 | Greek Ripe Black Olives | *Phreatobacter cathodiphilus* |
| SBP00130 | Greek Ripe Black Olives | *Phreatobacter stygius* |
| SBP00130 | Greek Ripe Black Olives | *Phreatobacter stygius* |
| SBP00130 | Greek Ripe Black Olives | *Phycicoccus dokdonensis* |
| SBP00130 | Greek Ripe Black Olives | *Phycicoccus dokdonensis* |
| SBP00130 | Greek Ripe Black Olives | *Phytobacter* sp. SCO41 |
| SBP00130 | Greek Ripe Black Olives | *Phytobacter* sp. SCO41 |
| SBP00130 | Greek Ripe Black Olives | *Phytobacter ursingii* |
| SBP00130 | Greek Ripe Black Olives | *Phytobacter ursingii* |
| SBP00130 | Greek Ripe Black Olives | *Pigmentiphaga* sp. H8 |
| SBP00130 | Greek Ripe Black Olives | *Pigmentiphaga* sp. H8 |
| SBP00130 | Greek Ripe Black Olives | *Pirellula staleyi* |
| SBP00130 | Greek Ripe Black Olives | *Pirellula staleyi* |
| SBP00130 | Greek Ripe Black Olives | *Plautia stali* |
| SBP00130 | Greek Ripe Black Olives | *Plautia stali* |
| SBP00130 | Greek Ripe Black Olives | *Plesiomonas shigelioides* |
| SBP00130 | Greek Ripe Black Olives | *Plesiomonas shigelloides* |
| SBP00130 | Greek Ripe Black Olives | *Pluralibacter gergoviae* |
| SBP00130 | Greek Ripe Black Olives | *Pluralibacter gergoviae* |
| SBP00130 | Greek Ripe Black Olives | *Polaribacter* sp. KT25b |
| SBP00130 | Greek Ripe Black Olives | *Polaribacter* sp. KT25b |
| SBP00130 | Greek Ripe Black Olives | *Polaribacter* sp. MED152 |
| SBP00130 | Greek Ripe Black Olives | *Polaribacter* sp. MED152 |
| SBP00130 | Greek Ripe Black Olives | *Polaromonas naphthalenivorans* |
| SBP00130 | Greek Ripe Black Olives | *Polaromonas naphthalenivorans* |
| SBP00130 | Greek Ripe Black Olives | *Polaromonas* sp. JS666 |
| SBP00130 | Greek Ripe Black Olives | *Polaromonas* sp. JS666 |
| SBP00130 | Greek Ripe Black Olives | *Polymorphum gilvum* |
| SBP00130 | Greek Ripe Black Olives | *Polymorphum gilvum* |
| SBP00130 | Greek Ripe Black Olives | *Polynucleobacter necessarius* |
| SBP00130 | Greek Ripe Black Olives | *Polynucleobacter necessarius* |
| SBP00130 | Greek Ripe Black Olives | *Porphyrobacter* HT-58-2 |
| SBP00130 | Greek Ripe Black Olives | *Porphyrobacter* HT-58-2 |
| SBP00130 | Greek Ripe Black Olives | *Porphyrobacter* sp. CACIAM 03H1 |
| SBP00130 | Greek Ripe Black Olives | *Porphyrobacter* sp. CACIAM 03H1 |
| SBP00130 | Greek Ripe Black Olives | *Pragia fontium* |
| SBP00130 | Greek Ripe Black Olives | *Pragia fontium* |
| SBP00130 | Greek Ripe Black Olives | *Prochlorococcus marinus* |
| SBP00130 | Greek Ripe Black Olives | *Prochlorococcus marinus* |
| SBP00130 | Greek Ripe Black Olives | *Proteus vulgaris* |
| SBP00130 | Greek Ripe Black Olives | *Proteus vulgaris* |
| SBP00130 | Greek Ripe Black Olives | *Providencia heimbachae* |
| SBP00130 | Greek Ripe Black Olives | *Providencia heimbachae* |
| SBP00130 | Greek Ripe Black Olives | *Providencia rettgeri* |
| SBP00130 | Greek Ripe Black Olives | *Providencia rettgeri* |
| SBP00130 | Greek Ripe Black Olives | *Providencia rustigianii* |
| SBP00130 | Greek Ripe Black Olives | *Providencia rustigianii* |

TABLE 3-continued

List of species identified in each metagenomic sample of each SBP Sample

| SBP ID | SBP Host Common Name | Genus sp. |
| --- | --- | --- |
| SBP00130 | Greek Ripe Black Olives | *Providencia sneebia* |
| SBP00130 | Greek Ripe Black Olives | *Providencia sneebia* |
| SBP00130 | Greek Ripe Black Olives | *Pseudanabaena* sp. ABRG5-3 |
| SBP00130 | Greek Ripe Black Olives | *Pseudanabaena* sp. ABRG5-3 |
| SBP00130 | Greek Ripe Black Olives | *Pseudoalteromonas agarivorans* |
| SBP00130 | Greek Ripe Black Olives | *Pseudoalteromonas agarivorans* |
| SBP00130 | Greek Ripe Black Olives | *Pseudoalteromonas aliena* |
| SBP00130 | Greek Ripe Black Olives | *Pseudoalteromonas aliena* |
| SBP00130 | Greek Ripe Black Olives | *Pseudoalteromonas arctica* |
| SBP00130 | Greek Ripe Black Olives | *Pseudoalteromonas arctica* |
| SBP00130 | Greek Ripe Black Olives | *Pseudoalteromonas atlantica* |
| SBP00130 | Greek Ripe Black Olives | *Pseudoalteromonas atlantica* |
| SBP00130 | Greek Ripe Black Olives | *Pseudoalteromonas carrageenovora* |
| SBP00130 | Greek Ripe Black Olives | *Pseudoalteromonas carrageenovora* |
| SBP00130 | Greek Ripe Black Olives | *Pseudoalteromonas donghaensis* |
| SBP00130 | Greek Ripe Black Olives | *Pseudoalteromonas donghaensis* |
| SBP00130 | Greek Ripe Black Olives | *Pseudoalteromonas espejiana* |
| SBP00130 | Greek Ripe Black Olives | *Pseudoalteromonas espejiana* |
| SBP00130 | Greek Ripe Black Olives | *Pseudoalteromonas haloplanktis* |
| SBP00130 | Greek Ripe Black Olives | *Pseudoalteromonas haloplanktis* |
| SBP00130 | Greek Ripe Black Olives | *Pseudoalteromonas luteoviolacea* |
| SBP00130 | Greek Ripe Black Olives | *Pseudoalteromonas luteoviolacea* |
| SBP00130 | Greek Ripe Black Olives | *Pseudoalteromonas marina* |
| SBP00130 | Greek Ripe Black Olives | *Pseudoalteromonas marina* |
| SBP00130 | Greek Ripe Black Olives | *Pseudoalteromonas nigrifaciens* |
| SBP00130 | Greek Ripe Black Olives | *Pseudoalteromonas nigrifaciens* |
| SBP00130 | Greek Ripe Black Olives | *Pseudoalteromonas piscicida* |
| SBP00130 | Greek Ripe Black Olives | *Pseudoalteromonas piscicida* |
| SBP00130 | Greek Ripe Black Olives | *Pseudoalteromonas rubra* |
| SBP00130 | Greek Ripe Black Olives | *Pseudoalteromonas rubra* |
| SBP00130 | Greek Ripe Black Olives | *Pseudoalteromonas* sp. 1_2015MBL_MicDiv |
| SBP00130 | Greek Ripe Black Olives | *Pseudoalteromonas* sp. 1_2015MBL_MicDiv |
| SBP00130 | Greek Ripe Black Olives | *Pseudoalteromonas* sp. 13-15 |
| SBP00130 | Greek Ripe Black Olives | *Pseudoalteromonas* sp. 13-15 |
| SBP00130 | Greek Ripe Black Olives | *Pseudoalteromonas* sp. Bsw20308 |
| SBP00130 | Greek Ripe Black Olives | *Pseudoalteromonas* sp. Bsw20308 |
| SBP00130 | Greek Ripe Black Olives | *Pseudoalteromonas* sp. DL-6 |
| SBP00130 | Greek Ripe Black Olives | *Pseudoalteromonas* sp. DL-6 |
| SBP00130 | Greek Ripe Black Olives | *Pseudoalteromonas* sp. R3 |
| SBP00130 | Greek Ripe Black Olives | *Pseudoalteromonas* sp. R3 |
| SBP00130 | Greek Ripe Black Olives | *Pseudoalteromonas* sp. SM9913 |
| SBP00130 | Greek Ripe Black Olives | *Pseudoalteromonas* sp. SM9913 |
| SBP00130 | Greek Ripe Black Olives | *Pseudoalteromonas* sp. Xi13 |
| SBP00130 | Greek Ripe Black Olives | *Pseudoalteromonas* sp. Xi13 |
| SBP00130 | Greek Ripe Black Olives | *Pseudoalteromonas spongiae* |
| SBP00130 | Greek Ripe Black Olives | *Pseudoalteromonas spongiae* |
| SBP00130 | Greek Ripe Black Olives | *Pseudoalteromonas tetraodonis* |
| SBP00130 | Greek Ripe Black Olives | *Pseudoalteromonas tetraodonis* |
| SBP00130 | Greek Ripe Black Olives | *Pseudoalteromonas translucida* |
| SBP00130 | Greek Ripe Black Olives | *Pseudoalteromonas translucida* |
| SBP00130 | Greek Ripe Black Olives | *Pseudoalteromonas tunicata* |
| SBP00130 | Greek Ripe Black Olives | *Pseudoalteromonas tunicata* |
| SBP00130 | Greek Ripe Black Olives | *Pseudocowpox* virus |
| SBP00130 | Greek Ripe Black Olives | *Pseudocowpox* virus |
| SBP00130 | Greek Ripe Black Olives | *Pseudodesulfovibrio aespoeensis* |
| SBP00130 | Greek Ripe Black Olives | *Pseudodesulfovibrio aespoeensis* |
| SBP00130 | Greek Ripe Black Olives | *Pseudodesulfovibrio profundus* |
| SBP00130 | Greek Ripe Black Olives | *Pseudodesulfovibrio profundus* |
| SBP00130 | Greek Ripe Black Olives | *Pseudogulbenkiania* sp. NH8B |
| SBP00130 | Greek Ripe Black Olives | *Pseudogulbenkiania* sp. NH8B |
| SBP00130 | Greek Ripe Black Olives | *Pseudolabrys taiwanensis* |
| SBP00130 | Greek Ripe Black Olives | *Pseudolabrys taiwanensis* |
| SBP00130 | Greek Ripe Black Olives | *Pseudomonadaceae bacterium* SI-3 |
| SBP00130 | Greek Ripe Black Olives | *Pseudomonadaceae bacterium* SI-3 |
| SBP00130 | Greek Ripe Black Olives | *Pseudomonas aeruginosa* |
| SBP00130 | Greek Ripe Black Olives | *Pseudomonas aeruginosa* |
| SBP00130 | Greek Ripe Black Olives | *Pseudomonas agarici* |
| SBP00130 | Greek Ripe Black Olives | *Pseudomonas agarici* |
| SBP00130 | Greek Ripe Black Olives | *Pseudomonas alcaligenes* |
| SBP00130 | Greek Ripe Black Olives | *Pseudomonas alcaligenes* |
| SBP00130 | Greek Ripe Black Olives | *Pseudomonas alcaliphila* |
| SBP00130 | Greek Ripe Black Olives | *Pseudomonas alcaliphila* |
| SBP00130 | Greek Ripe Black Olives | *Pseudomonas alkylphenolica* |
| SBP00130 | Greek Ripe Black Olives | *Pseudomonas alkylphenolica* |
| SBP00130 | Greek Ripe Black Olives | *Pseudomonas amygdali* |
| SBP00130 | Greek Ripe Black Olives | *Pseudomonas amygdali* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Pseudomonas antarctica* |
| SBP00130 | Greek Ripe Black Olives | *Pseudomonas antarctica* |
| SBP00130 | Greek Ripe Black Olives | *Pseudomonas arsenicoxydans* |
| SBP00130 | Greek Ripe Black Olives | *Pseudomonas arsenicoxydans* |
| SBP00130 | Greek Ripe Black Olives | *Pseudomonas asplenii* |
| SBP00130 | Greek Ripe Black Olives | *Pseudomonas asplenii* |
| SBP00130 | Greek Ripe Black Olives | *Pseudomonas avellanae* |
| SBP00130 | Greek Ripe Black Olives | *Pseudomonas avellanae* |
| SBP00130 | Greek Ripe Black Olives | *Pseudomonas azotoformans* |
| SBP00130 | Greek Ripe Black Olives | *Pseudomonas azotoformans* |
| SBP00130 | Greek Ripe Black Olives | *Pseudomonas balearica* |
| SBP00130 | Greek Ripe Black Olives | *Pseudomonas balearica* |
| SBP00130 | Greek Ripe Black Olives | *Pseudomonas brassicacearum* |
| SBP00130 | Greek Ripe Black Olives | *Pseudomonas brassicacearum* |
| SBP00130 | Greek Ripe Black Olives | *Pseudomonas brenneri* |
| SBP00130 | Greek Ripe Black Olives | *Pseudomonas brenneri* |
| SBP00130 | Greek Ripe Black Olives | *Pseudomonas cedrina* |
| SBP00130 | Greek Ripe Black Olives | *Pseudomonas cedrina* |
| SBP00130 | Greek Ripe Black Olives | *Pseudomonas cerasi* |
| SBP00130 | Greek Ripe Black Olives | *Pseudomonas cerasi* |
| SBP00130 | Greek Ripe Black Olives | *Pseudomonas chlororaphis* |
| SBP00130 | Greek Ripe Black Olives | *Pseudomonas chlororaphis* |
| SBP00130 | Greek Ripe Black Olives | *Pseudomonas cichorii* |
| SBP00130 | Greek Ripe Black Olives | *Pseudomonas cichorii* |
| SBP00130 | Greek Ripe Black Olives | *Pseudomonas citronellolis* |
| SBP00130 | Greek Ripe Black Olives | *Pseudomonas citronellolis* |
| SBP00130 | Greek Ripe Black Olives | *Pseudomonas corrugata* |
| SBP00130 | Greek Ripe Black Olives | *Pseudomonas corrugata* |
| SBP00130 | Greek Ripe Black Olives | *Pseudomonas cremoricolorata* |
| SBP00130 | Greek Ripe Black Olives | *Pseudomonas cremoricolorata* |
| SBP00130 | Greek Ripe Black Olives | *Pseudomonas entomophila* |
| SBP00130 | Greek Ripe Black Olives | *Pseudomonas entomophila* |
| SBP00130 | Greek Ripe Black Olives | *Pseudomonas extremaustralis* |
| SBP00130 | Greek Ripe Black Olives | *Pseudomonas extremaustralis* |
| SBP00130 | Greek Ripe Black Olives | *Pseudomonas extremorientalis* |
| SBP00130 | Greek Ripe Black Olives | *Pseudomonas extremorientalis* |
| SBP00130 | Greek Ripe Black Olives | *Pseudomonas fluorescens* |
| SBP00130 | Greek Ripe Black Olives | *Pseudomonas fluorescens* |
| SBP00130 | Greek Ripe Black Olives | *Pseudomonas fragi* |
| SBP00130 | Greek Ripe Black Olives | *Pseudomonas fragi* |
| SBP00130 | Greek Ripe Black Olives | *Pseudomonas frederiksbergensis* |
| SBP00130 | Greek Ripe Black Olives | *Pseudomonas frederiksbergensis* |
| SBP00130 | Greek Ripe Black Olives | *Pseudomonas fulva* |
| SBP00130 | Greek Ripe Black Olives | *Pseudomonas fulva* |
| SBP00130 | Greek Ripe Black Olives | *Pseudomonas furukawaii* |
| SBP00130 | Greek Ripe Black Olives | *Pseudomonas furukawaii* |
| SBP00130 | Greek Ripe Black Olives | *Pseudomonas fuscovaginae* |
| SBP00130 | Greek Ripe Black Olives | *Pseudomonas fuscovaginae* |
| SBP00130 | Greek Ripe Black Olives | *Pseudomonas granadensis* |
| SBP00130 | Greek Ripe Black Olives | *Pseudomonas granadensis* |
| SBP00130 | Greek Ripe Black Olives | *Pseudomonas guangdongensis* |
| SBP00130 | Greek Ripe Black Olives | *Pseudomonas guangdongensis* |
| SBP00130 | Greek Ripe Black Olives | *Pseudomonas knackmussii* |
| SBP00130 | Greek Ripe Black Olives | *Pseudomonas knackmussii* |
| SBP00130 | Greek Ripe Black Olives | *Pseudomonas koreensis* |
| SBP00130 | Greek Ripe Black Olives | *Pseudomonas koreensis* |
| SBP00130 | Greek Ripe Black Olives | *Pseudomonas kribbensis* |
| SBP00130 | Greek Ripe Black Olives | *Pseudomonas kribbensis* |
| SBP00130 | Greek Ripe Black Olives | *Pseudomonas libanensis* |
| SBP00130 | Greek Ripe Black Olives | *Pseudomonas libanensis* |
| SBP00130 | Greek Ripe Black Olives | *Pseudomonas lini* |
| SBP00130 | Greek Ripe Black Olives | *Pseudomonas lini* |
| SBP00130 | Greek Ripe Black Olives | *Pseudomonas litoralis* |
| SBP00130 | Greek Ripe Black Olives | *Pseudomonas litoralis* |
| SBP00130 | Greek Ripe Black Olives | *Pseudomonas lurida* |
| SBP00130 | Greek Ripe Black Olives | *Pseudomonas lurida* |
| SBP00130 | Greek Ripe Black Olives | *Pseudomonas mandelii* |
| SBP00130 | Greek Ripe Black Olives | *Pseudomonas mandelii* |
| SBP00130 | Greek Ripe Black Olives | *Pseudomonas mediterranea* |
| SBP00130 | Greek Ripe Black Olives | *Pseudomonas mediterranea* |
| SBP00130 | Greek Ripe Black Olives | *Pseudomonas mendocina* |
| SBP00130 | Greek Ripe Black Olives | *Pseudomonas mendocina* |
| SBP00130 | Greek Ripe Black Olives | *Pseudomonas migulae* |
| SBP00130 | Greek Ripe Black Olives | *Pseudomonas migulae* |
| SBP00130 | Greek Ripe Black Olives | *Pseudomonas monteilii* |
| SBP00130 | Greek Ripe Black Olives | *Pseudomonas monteilii* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Pseudomonas moraviensis* |
| SBP00130 | Greek Ripe Black Olives | *Pseudomonas moraviensis* |
| SBP00130 | Greek Ripe Black Olives | *Pseudomonas mosselii* |
| SBP00130 | Greek Ripe Black Olives | *Pseudomonas mosselii* |
| SBP00130 | Greek Ripe Black Olives | *Pseudomonas mucidolens* |
| SBP00130 | Greek Ripe Black Olives | *Pseudomonas mucidolens* |
| SBP00130 | Greek Ripe Black Olives | *Pseudomonas orientalis* |
| SBP00130 | Greek Ripe Black Olives | *Pseudomonas orientalis* |
| SBP00130 | Greek Ripe Black Olives | *Pseudomonas oryzae* |
| SBP00130 | Greek Ripe Black Olives | *Pseudomonas oryzae* |
| SBP00130 | Greek Ripe Black Olives | *Pseudomonas oryzihabitans* |
| SBP00130 | Greek Ripe Black Olives | *Pseudomonas oryzihabitans* |
| SBP00130 | Greek Ripe Black Olives | *Pseudomonas palleroniana* |
| SBP00130 | Greek Ripe Black Olives | *Pseudomonas palieroniana* |
| SBP00130 | Greek Ripe Black Olives | *Pseudomonas parafulva* |
| SBP00130 | Greek Ripe Black Olives | *Pseudomonas parafulva* |
| SBP00130 | Greek Ripe Black Olives | *Pseudomonas phage* Pf-10 |
| SBP00130 | Greek Ripe Black Olives | *Pseudomonas phage* Pf-10 |
| SBP00130 | Greek Ripe Black Olives | *Pseudomonas phage* Phi-S1 |
| SBP00130 | Greek Ripe Black Olives | *Pseudomonas phage* Phi-S1 |
| SBP00130 | Greek Ripe Black Olives | *Pseudomonas phage* phiBB-PF7A |
| SBP00130 | Greek Ripe Black Olives | *Pseudomonas phage* phiBB-PF7A |
| SBP00130 | Greek Ripe Black Olives | *Pseudomonas phage* phiPSA1 |
| SBP00130 | Greek Ripe Black Olives | *Pseudomonas phage* phiPSA1 |
| SBP00130 | Greek Ripe Black Olives | *Pseudomonas phage* PS-1 |
| SBP00130 | Greek Ripe Black Olives | *Pseudomonas phage* PS-1 |
| SBP00130 | Greek Ripe Black Olives | *Pseudomonas plecoglossicida* |
| SBP00130 | Greek Ripe Black Olives | *Pseudomonas plecoglossicida* |
| SBP00130 | Greek Ripe Black Olives | *Pseudomonas poae* |
| SBP00130 | Greek Ripe Black Olives | *Pseudomonas poae* |
| SBP00130 | Greek Ripe Black Olives | *Pseudomonas pohangensis* |
| SBP00130 | Greek Ripe Black Olives | *Pseudomonas pohangensis* |
| SBP00130 | Greek Ripe Black Olives | *Pseudomonas prosekii* |
| SBP00130 | Greek Ripe Black Olives | *Pseudomonas prosekii* |
| SBP00130 | Greek Ripe Black Olives | *Pseudomonas protegens* |
| SBP00130 | Greek Ripe Black Olives | *Pseudomonas protegens* |
| SBP00130 | Greek Ripe Black Olives | *Pseudomonas psychrophila* |
| SBP00130 | Greek Ripe Black Olives | *Pseudomonas psychrophila* |
| SBP00130 | Greek Ripe Black Olives | *Pseudomonas psychrotolerans* |
| SBP00130 | Greek Ripe Black Olives | *Pseudomonas psychrotolerans* |
| SBP00130 | Greek Ripe Black Olives | *Pseudomonas putida* |
| SBP00130 | Greek Ripe Black Olives | *Pseudomonas putida* |
| SBP00130 | Greek Ripe Black Olives | *Pseudomonas reinekei* |
| SBP00130 | Greek Ripe Black Olives | *Pseudomonas reinekei* |
| SBP00130 | Greek Ripe Black Olives | *Pseudomonas resinovorans* |
| SBP00130 | Greek Ripe Black Olives | *Pseudomonas resinovorans* |
| SBP00130 | Greek Ripe Black Olives | *Pseudomonas rhizosphaerae* |
| SBP00130 | Greek Ripe Black Olives | *Pseudomonas rhizosphaerae* |
| SBP00130 | Greek Ripe Black Olives | *Pseudomonas rhodesiae* |
| SBP00130 | Greek Ripe Black Olives | *Pseudomonas rhodesiae* |
| SBP00130 | Greek Ripe Black Olives | *Pseudomonas sabulinigri* |
| SBP00130 | Greek Ripe Black Olives | *Pseudomonas sabulinigri* |
| SBP00130 | Greek Ripe Black Olives | *Pseudomonas salegens* |
| SBP00130 | Greek Ripe Black Olives | *Pseudomonas salegens* |
| SBP00130 | Greek Ripe Black Olives | *Pseudomonas saudiphocaensis* |
| SBP00130 | Greek Ripe Black Olives | *Pseudomonas saudiphocaensis* |
| SBP00130 | Greek Ripe Black Olives | *Pseudomonas savastanoi* |
| SBP00130 | Greek Ripe Black Olives | *Pseudomonas savastanoi* |
| SBP00130 | Greek Ripe Black Olives | *Pseudomonas sihuiensis* |
| SBP00130 | Greek Ripe Black Olives | *Pseudomonas sihuiensis* |
| SBP00130 | Greek Ripe Black Olives | *Pseudomonas silesiensis* |
| SBP00130 | Greek Ripe Black Olives | *Pseudomonas silesiensis* |
| SBP00130 | Greek Ripe Black Olives | *Pseudomonas simiae* |
| SBP00130 | Greek Ripe Black Olives | *Pseudomonas simiae* |
| SBP00130 | Greek Ripe Black Olives | *Pseudomonas soli* |
| SBP00130 | Greek Ripe Black Olives | *Pseudomonas soli* |
| SBP00130 | Greek Ripe Black Olives | *Pseudomonas sp.* |
| SBP00130 | Greek Ripe Black Olives | *Pseudomonas sp.* |
| SBP00130 | Greek Ripe Black Olives | *Pseudomonas sp.* 02C 26 |
| SBP00130 | Greek Ripe Black Olives | *Pseudomonas sp.* 02C 26 |
| SBP00130 | Greek Ripe Black Olives | *Pseudomonas sp.* 09C 129 |
| SBP00130 | Greek Ripe Black Olives | *Pseudomonas sp.* 09C 129 |
| SBP00130 | Greek Ripe Black Olives | *Pseudomonas sp.* 31-12 |
| SBP00130 | Greek Ripe Black Olives | *Pseudomonas sp.* 31-12 |
| SBP00130 | Greek Ripe Black Olives | *Pseudomonas sp.* 7SR1 |
| SBP00130 | Greek Ripe Black Olives | *Pseudomonas sp.* 7SR1 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Pseudomonas* sp. A214 |
| SBP00130 | Greek Ripe Black Olives | *Pseudomonas* sp. A214 |
| SBP00130 | Greek Ripe Black Olives | *Pseudomonas* sp. ATCC 13867 |
| SBP00130 | Greek Ripe Black Olives | *Pseudomonas* sp. ATCC 13867 |
| SBP00130 | Greek Ripe Black Olives | *Pseudomonas* sp. B10 |
| SBP00130 | Greek Ripe Black Olives | *Pseudomonas* sp. B10 |
| SBP00130 | Greek Ripe Black Olives | *Pseudomonas* sp. bs2935 |
| SBP00130 | Greek Ripe Black Olives | *Pseudomonas* sp. bs2935 |
| SBP00130 | Greek Ripe Black Olives | *Pseudomonas* sp. CC6-YY-74 |
| SBP00130 | Greek Ripe Black Olives | *Pseudomonas* sp. CC6-YY-74 |
| SBP00130 | Greek Ripe Black Olives | *Pseudomonas* sp. CCOS 191 |
| SBP00130 | Greek Ripe Black Olives | *Pseudomonas* sp. CCOS 191 |
| SBP00130 | Greek Ripe Black Olives | *Pseudomonas* sp. CMR12a |
| SBP00130 | Greek Ripe Black Olives | *Pseudomonas* sp. CMR12a |
| SBP00130 | Greek Ripe Black Olives | *Pseudomonas* sp. CMR5c |
| SBP00130 | Greek Ripe Black Olives | *Pseudomonas* sp. CMR5c |
| SBP00130 | Greek Ripe Black Olives | *Pseudomonas* sp. DR 5-09 |
| SBP00130 | Greek Ripe Black Olives | *Pseudomonas* sp. DR 5-09 |
| SBP00130 | Greek Ripe Black Olives | *Pseudomonas* sp. DY-1 |
| SBP00130 | Greek Ripe Black Olives | *Pseudomonas* sp. DY-1 |
| SBP00130 | Greek Ripe Black Olives | *Pseudomonas* sp. FDAARGOS_380 |
| SBP00130 | Greek Ripe Black Olives | *Pseudomonas* sp. FDAARGOS_380 |
| SBP00130 | Greek Ripe Black Olives | *Pseudomonas* sp. FGI182 |
| SBP00130 | Greek Ripe Black Olives | *Pseudomonas* sp. FGI182 |
| SBP00130 | Greek Ripe Black Olives | *Pseudomonas* sp. GLE121 |
| SBP00130 | Greek Ripe Black Olives | *Pseudomonas* sp. GLE121 |
| SBP00130 | Greek Ripe Black Olives | *Pseudomonas* sp. GR 6-02 |
| SBP00130 | Greek Ripe Black Olives | *Pseudomonas* sp. GR 6-02 |
| SBP00130 | Greek Ripe Black Olives | *Pseudomonas* sp. HLS-6 |
| SBP00130 | Greek Ripe Black Olives | *Pseudomonas* sp. HLS-6 |
| SBP00130 | Greek Ripe Black Olives | *Pseudomonas* sp. JY-Q |
| SBP00130 | Greek Ripe Black Olives | *Pseudomonas* sp. JY-Q |
| SBP00130 | Greek Ripe Black Olives | *Pseudomonas* sp. K2W315-8 |
| SBP00130 | Greek Ripe Black Olives | *Pseudomonas* sp. K2W315-8 |
| SBP00130 | Greek Ripe Black Olives | *Pseudomonas* sp. LAB-08 |
| SBP00130 | Greek Ripe Black Olives | *Pseudomonas* sp. LAB-08 |
| SBP00130 | Greek Ripe Black Olives | *Pseudomonas* sp. LBUM920 |
| SBP00130 | Greek Ripe Black Olives | *Pseudomonas* sp. LBUM920 |
| SBP00130 | Greek Ripe Black Olives | *Pseudomonas* sp. Leaf58 |
| SBP00130 | Greek Ripe Black Olives | *Pseudomonas* sp. Leaf58 |
| SBP00130 | Greek Ripe Black Olives | *Pseudomonas* sp. LG1D9 |
| SBP00130 | Greek Ripe Black Olives | *Pseudomonas* sp. LG1D9 |
| SBP00130 | Greek Ripe Black Olives | *Pseudomonas* sp. LG1E9 |
| SBP00130 | Greek Ripe Black Olives | *Pseudomonas* sp. LG1E9 |
| SBP00130 | Greek Ripe Black Olives | *Pseudomonas* sp. LH1G9 |
| SBP00130 | Greek Ripe Black Olives | *Pseudomonas* sp. LH1G9 |
| SBP00130 | Greek Ripe Black Olives | *Pseudomonas* sp. LPH1 |
| SBP00130 | Greek Ripe Black Olives | *Pseudomonas* sp. LPH1 |
| SBP00130 | Greek Ripe Black Olives | *Pseudomonas* sp. LTGT-11-2Z |
| SBP00130 | Greek Ripe Black Olives | *Pseudomonas* sp. LTGT-11-2Z |
| SBP00130 | Greek Ripe Black Olives | *Pseudomonas* sp. LTJR-52 |
| SBP00130 | Greek Ripe Black Olives | *Pseudomonas* sp. LTJR-52 |
| SBP00130 | Greek Ripe Black Olives | *Pseudomonas* sp. Lz4W |
| SBP00130 | Greek Ripe Black Olives | *Pseudomonas* sp. Lz4W |
| SBP00130 | Greek Ripe Black Olives | *Pseudomonas* sp. M30-35 |
| SBP00130 | Greek Ripe Black Olives | *Pseudomonas* sp. M30-35 |
| SBP00130 | Greek Ripe Black Olives | *Pseudomonas* sp. MRSN12121 |
| SBP00130 | Greek Ripe Black Olives | *Pseudomonas* sp. MRSN12121 |
| SBP00130 | Greek Ripe Black Olives | *Pseudomonas* sp. MT-1 |
| SBP00130 | Greek Ripe Black Olives | *Pseudomonas* sp. MT-1 |
| SBP00130 | Greek Ripe Black Olives | *Pseudomonas* sp. MYb193 |
| SBP00130 | Greek Ripe Black Olives | *Pseudomonas* sp. MYb193 |
| SBP00130 | Greek Ripe Black Olives | *Pseudomonas* sp. NC02 |
| SBP00130 | Greek Ripe Black Olives | *Pseudomonas* sp. NC02 |
| SBP00130 | Greek Ripe Black Olives | *Pseudomonas* sp. NS1(2017) |
| SBP00130 | Greek Ripe Black Olives | *Pseudomonas* sp. NS1(2017) |
| SBP00130 | Greek Ripe Black Olives | *Pseudomonas* sp. Os17 |
| SBP00130 | Greek Ripe Black Olives | *Pseudomonas* sp. Os17 |
| SBP00130 | Greek Ripe Black Olives | *Pseudomonas* sp. phDV1 |
| SBP00130 | Greek Ripe Black Olives | *Pseudomonas* sp. phDV1 |
| SBP00130 | Greek Ripe Black Olives | *Pseudomonas* sp. PONIH3 |
| SBP00130 | Greek Ripe Black Olives | *Pseudomonas* sp. PONIH3 |
| SBP00130 | Greek Ripe Black Olives | *Pseudomonas* sp. R1-43-08 |
| SBP00130 | Greek Ripe Black Olives | *Pseudomonas* sp. R1-43-08 |
| SBP00130 | Greek Ripe Black Olives | *Pseudomonas* sp. R11-23-07 |
| SBP00130 | Greek Ripe Black Olives | *Pseudomonas* sp. R11-23-07 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Pseudomonas* sp. R2-37-08W |
| SBP00130 | Greek Ripe Black Olives | *Pseudomonas* sp. R2-37-08W |
| SBP00130 | Greek Ripe Black Olives | *Pseudomonas* sp. R2-60-08W |
| SBP00130 | Greek Ripe Black Olives | *Pseudomonas* sp. R2-60-08W |
| SBP00130 | Greek Ripe Black Olives | *Pseudomonas* sp. R2-7-07 |
| SBP00130 | Greek Ripe Black Olives | *Pseudomonas* sp. R2-7-07 |
| SBP00130 | Greek Ripe Black Olives | *Pseudomonas* sp. R2A2 |
| SBP00130 | Greek Ripe Black Olives | *Pseudomonas* sp. R2A2 |
| SBP00130 | Greek Ripe Black Olives | *Pseudomonas* sp. R3-18-08 |
| SBP00130 | Greek Ripe Black Olives | *Pseudomonas* sp. R3-18-08 |
| SBP00130 | Greek Ripe Black Olives | *Pseudomonas* sp. R3-52-08 |
| SBP00130 | Greek Ripe Black Olives | *Pseudomonas* sp. R3-52-08 |
| SBP00130 | Greek Ripe Black Olives | *Pseudomonas* sp. R4-34-07 |
| SBP00130 | Greek Ripe Black Olives | *Pseudomonas* sp. R4-34-07 |
| SBP00130 | Greek Ripe Black Olives | *Pseudomonas* sp. R4-35-07 |
| SBP00130 | Greek Ripe Black Olives | *Pseudomonas* sp. R4-35-07 |
| SBP00130 | Greek Ripe Black Olives | *Pseudomonas* sp. R4-39-08 |
| SBP00130 | Greek Ripe Black Olives | *Pseudomonas* sp. R4-39-08 |
| SBP00130 | Greek Ripe Black Olives | *Pseudomonas* sp. R5-89-07 |
| SBP00130 | Greek Ripe Black Olives | *Pseudomonas* sp. R5-89-07 |
| SBP00130 | Greek Ripe Black Olives | *Pseudomonas* sp. RU47 |
| SBP00130 | Greek Ripe Black Olives | *Pseudomonas* sp. RU47 |
| SBP00130 | Greek Ripe Black Olives | *Pseudomonas* sp. S-6-2 |
| SBP00130 | Greek Ripe Black Olives | *Pseudomonas* sp. S-6-2 |
| SBP00130 | Greek Ripe Black Olives | *Pseudomonas* sp. 509G 359 |
| SBP00130 | Greek Ripe Black Olives | *Pseudomonas* sp. 509G 359 |
| SBP00130 | Greek Ripe Black Olives | *Pseudomonas* sp. 5211(2017) |
| SBP00130 | Greek Ripe Black Olives | *Pseudomonas* sp. s211(2017) |
| SBP00130 | Greek Ripe Black Olives | *Pseudomonas* sp. SGAir0191 |
| SBP00130 | Greek Ripe Black Olives | *Pseudomonas* sp. SGAir0191 |
| SBP00130 | Greek Ripe Black Olives | *Pseudomonas* sp. St29 |
| SBP00130 | Greek Ripe Black Olives | *Pseudomonas* sp. St29 |
| SBP00130 | Greek Ripe Black Olives | *Pseudomonas* sp. StFLB209 |
| SBP00130 | Greek Ripe Black Olives | *Pseudomonas* sp. StFLB209 |
| SBP00130 | Greek Ripe Black Olives | *Pseudomonas* sp. SWI36 |
| SBP00130 | Greek Ripe Black Olives | *Pseudomonas* sp. SWI36 |
| SBP00130 | Greek Ripe Black Olives | *Pseudomonas* sp. SWI44 |
| SBP00130 | Greek Ripe Black Olives | *Pseudomonas* sp. SWI44 |
| SBP00130 | Greek Ripe Black Olives | *Pseudomonas* sp. SWI6 |
| SBP00130 | Greek Ripe Black Olives | *Pseudomonas* sp. SWI6 |
| SBP00130 | Greek Ripe Black Olives | *Pseudomonas* sp. SXM-1 |
| SBP00130 | Greek Ripe Black Olives | *Pseudomonas* sp. SXM-1 |
| SBP00130 | Greek Ripe Black Olives | *Pseudomonas* sp. TCU-HL1 |
| SBP00130 | Greek Ripe Black Olives | *Pseudomonas* sp. TCU-HL1 |
| SBP00130 | Greek Ripe Black Olives | *Pseudomonas* sp. TKP |
| SBP00130 | Greek Ripe Black Olives | *Pseudomonas* sp. TKP |
| SBP00130 | Greek Ripe Black Olives | *Pseudomonas* sp. TMW 2.1634 |
| SBP00130 | Greek Ripe Black Olives | *Pseudomonas* sp. TMW 2,1634 |
| SBP00130 | Greek Ripe Black Olives | *Pseudomonas* sp. URMO17WK12:I11 |
| SBP00130 | Greek Ripe Black Olives | *Pseudomonas* sp. URMO17WK12:I11 |
| SBP00130 | Greek Ripe Black Olives | *Pseudomonas* sp. UW4 |
| SBP00130 | Greek Ripe Black Olives | *Pseudomonas* sp. UW4 |
| SBP00130 | Greek Ripe Black Olives | *Pseudomonas* sp. VLB120 |
| SBP00130 | Greek Ripe Black Olives | *Pseudomonas* sp. VLB120 |
| SBP00130 | Greek Ripe Black Olives | *Pseudomonas* sp. WCS374 |
| SBP00130 | Greek Ripe Black Olives | *Pseudomonas* sp. WCS374 |
| SBP00130 | Greek Ripe Black Olives | *Pseudomonas* sp. XWY-1 |
| SBP00130 | Greek Ripe Black Olives | *Pseudomonas* sp. XWY-1 |
| SBP00130 | Greek Ripe Black Olives | *Pseudomonas* sp. Z003-0.4C(8344-21) |
| SBP00130 | Greek Ripe Black Olives | *Pseudomonas* sp. Z003-0.4C(8344-21) |
| SBP00130 | Greek Ripe Black Olives | *Pseudomonas stutzeri* |
| SBP00130 | Greek Ripe Black Olives | *Pseudomonas stutzeri* |
| SBP00130 | Greek Ripe Black Olives | *Pseudomonas synxantha* |
| SBP00130 | Greek Ripe Black Olives | *Pseudomonas synxantha* |
| SBP00130 | Greek Ripe Black Olives | *Pseudomonas syringae* |
| SBP00130 | Greek Ripe Black Olives | *Pseudomonas syringae* |
| SBP00130 | Greek Ripe Black Olives | *Pseudomonas syringae* group genomosp. 3 |
| SBP00130 | Greek Ripe Black Olives | *Pseudomonas syringae* group genomosp. 3 |
| SBP00130 | Greek Ripe Black Olives | *Pseudomonas taetrolens* |
| SBP00130 | Greek Ripe Black Olives | *Pseudomonas taetrolens* |
| SBP00130 | Greek Ripe Black Olives | *Pseudomonas thivervalensis* |
| SBP00130 | Greek Ripe Black Olives | *Pseudomonas thivervalensis* |
| SBP00130 | Greek Ripe Black Olives | *Pseudomonas tolaasii* |
| SBP00130 | Greek Ripe Black Olives | *Pseudomonas tolaasii* |
| SBP00130 | Greek Ripe Black Olives | *Pseudomonas trivialis* |
| SBP00130 | Greek Ripe Black Olives | *Pseudomonas trivialis* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | Pseudomonas umsongensis |
| SBP00130 | Greek Ripe Black Olives | Pseudomonas umsongensis |
| SBP00130 | Greek Ripe Black Olives | Pseudomonas vancouverensis |
| SBP00130 | Greek Ripe Black Olives | Pseudomonas vancouverensis |
| SBP00130 | Greek Ripe Black Olives | Pseudomonas veronii |
| SBP00130 | Greek Ripe Black Olives | Pseudomonas veronii |
| SBP00130 | Greek Ripe Black Olives | Pseudomonas versuta |
| SBP00130 | Greek Ripe Black Olives | Pseudomonas versuta |
| SBP00130 | Greek Ripe Black Olives | Pseudomonas viridiflava |
| SBP00130 | Greek Ripe Black Olives | Pseudomonas viridiflava |
| SBP00130 | Greek Ripe Black Olives | Pseudomonas xanthomarina |
| SBP00130 | Greek Ripe Black Olives | Pseudomonas xanthomarina |
| SBP00130 | Greek Ripe Black Olives | Pseudomonas xinjiangensis |
| SBP00130 | Greek Ripe Black Olives | Pseudomonas xinjiangensis |
| SBP00130 | Greek Ripe Black Olives | Pseudomonas yamanorum |
| SBP00130 | Greek Ripe Black Olives | Pseudomonas yamanorum |
| SBP00130 | Greek Ripe Black Olives | Pseudonocardia autotrophica |
| SBP00130 | Greek Ripe Black Olives | Pseudonocardia autotrophica |
| SBP00130 | Greek Ripe Black Olives | Pseudorhodoplanes sinuspersici |
| SBP00130 | Greek Ripe Black Olives | Pseudorhodoplanes sinuspersici |
| SBP00130 | Greek Ripe Black Olives | Pseudovibrio sp. FO-BEG1 |
| SBP00130 | Greek Ripe Black Olives | Pseudovibrio sp. FO-BEG1 |
| SBP00130 | Greek Ripe Black Olives | Pseudoxanthomonas spadix |
| SBP00130 | Greek Ripe Black Olives | Pseudoxanthomonas spadix |
| SBP00130 | Greek Ripe Black Olives | Pseudoxanthomonas suwonensis |
| SBP00130 | Greek Ripe Black Olives | Pseudoxanthomonas suwonensis |
| SBP00130 | Greek Ripe Black Olives | Psychrobacter alimentarius |
| SBP00130 | Greek Ripe Black Olives | Psychrobacter alimentarius |
| SBP00130 | Greek Ripe Black Olives | Psychrobacter arcticus |
| SBP00130 | Greek Ripe Black Olives | Psychrobacter arcticus |
| SBP00130 | Greek Ripe Black Olives | Psychrobacter cryohalolentis |
| SBP00130 | Greek Ripe Black Olives | Psychrobacter cryohalolentis |
| SBP00130 | Greek Ripe Black Olives | Psychrobacter sp. AntiMn-1 |
| SBP00130 | Greek Ripe Black Olives | Psychrobacter sp. AntiMn-1 |
| SBP00130 | Greek Ripe Black Olives | Psychrobacter sp. DAB_AL43B |
| SBP00130 | Greek Ripe Black Olives | Psychrobacter sp. DAB_AL438 |
| SBP00130 | Greek Ripe Black Olives | Psychrobacter sp. G |
| SBP00130 | Greek Ripe Black Olives | Psychrobacter sp. G |
| SBP00130 | Greek Ripe Black Olives | Psychrobacter sp. P11F6 |
| SBP00130 | Greek Ripe Black Olives | Psychrobacter sp. P11F6 |
| SBP00130 | Greek Ripe Black Olives | Psychrobacter sp. P11G3 |
| SBP00130 | Greek Ripe Black Olives | Psychrobacter sp. P11G3 |
| SBP00130 | Greek Ripe Black Olives | Psychrobacter sp. P11G5 |
| SBP00130 | Greek Ripe Black Olives | Psychrobacter sp. P11G5 |
| SBP00130 | Greek Ripe Black Olives | Psychrobacter sp. P2G3 |
| SBP00130 | Greek Ripe Black Olives | Psychrobacter sp. P2G3 |
| SBP00130 | Greek Ripe Black Olives | Psychrobacter sp. YP14 |
| SBP00130 | Greek Ripe Black Olives | Psychrobacter sp. YP14 |
| SBP00130 | Greek Ripe Black Olives | Psychrobacter urativorans |
| SBP00130 | Greek Ripe Black Olives | Psychrobacter urativorans |
| SBP00130 | Greek Ripe Black Olives | Psychromicrobium lacuslunae |
| SBP00130 | Greek Ripe Black Olives | Psychromicrobium lacuslunae |
| SBP00130 | Greek Ripe Black Olives | Psychromonas ingrahamii |
| SBP00130 | Greek Ripe Black Olives | Psychromonas ingrahamii |
| SBP00130 | Greek Ripe Black Olives | Pusillimonas sp. T7-7 |
| SBP00130 | Greek Ripe Black Olives | Pusillimonas sp. T7-7 |
| SBP00130 | Greek Ripe Black Olives | Qipengyuania sediminis |
| SBP00130 | Greek Ripe Black Olives | Qipengyuania sediminis |
| SBP00130 | Greek Ripe Black Olives | Rahnella aquatilis |
| SBP00130 | Greek Ripe Black Olives | Rahnella aquatilis |
| SBP00130 | Greek Ripe Black Olives | Rahnella sp. ERMR1:05 |
| SBP00130 | Greek Ripe Black Olives | Rahnella sp. ERMR1:05 |
| SBP00130 | Greek Ripe Black Olives | Rahnella sp. Y9602 |
| SBP00130 | Greek Ripe Black Olives | Rahnella sp. Y9602 |
| SBP00130 | Greek Ripe Black Olives | Ralstonia insidiosa |
| SBP00130 | Greek Ripe Black Olives | Ralstonia insidiosa |
| SBP00130 | Greek Ripe Black Olives | Ralstonia mannitolilytica |
| SBP00130 | Greek Ripe Black Olives | Ralstonia mannitolilytica |
| SBP00130 | Greek Ripe Black Olives | Ralstonia pickettii |
| SBP00130 | Greek Ripe Black Olives | Ralstonia pickettii |
| SBP00130 | Greek Ripe Black Olives | Ralstonia solanacearum |
| SBP00130 | Greek Ripe Black Olives | Ralstonia solanacearum |
| SBP00130 | Greek Ripe Black Olives | Ramlibacter tataouinensis |
| SBP00130 | Greek Ripe Black Olives | Ramlibacter tataouinensis |
| SBP00130 | Greek Ripe Black Olives | Raoultella ornithinolytica |
| SBP00130 | Greek Ripe Black Olives | Raoultella ornithinolytica |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Raoultella planticola* |
| SBP00130 | Greek Ripe Black Olives | *Raoultella planticola* |
| SBP00130 | Greek Ripe Black Olives | *Raoultella terrigena* |
| SBP00130 | Greek Ripe Black Olives | *Raoultella terrigena* |
| SBP00130 | Greek Ripe Black Olives | *Rheinheimera* sp. LHK132 |
| SBP00130 | Greek Ripe Black Olives | *Rheinheimera* sp. LHK132 |
| SBP00130 | Greek Ripe Black Olives | *Rhizobacter gummiphilus* |
| SBP00130 | Greek Ripe Black Olives | *Rhizobacter gummiphilus* |
| SBP00130 | Greek Ripe Black Olives | *Rhizobium acidisoli* |
| SBP00130 | Greek Ripe Black Olives | *Rhizobium acidisoli* |
| SBP00130 | Greek Ripe Black Olives | *Rhizobium etli* |
| SBP00130 | Greek Ripe Black Olives | *Rhizobium etli* |
| SBP00130 | Greek Ripe Black Olives | *Rhizobium gallicum* |
| SBP00130 | Greek Ripe Black Olives | *Rhizobium gallicum* |
| SBP00130 | Greek Ripe Black Olives | *Rhizobium jaguaris* |
| SBP00130 | Greek Ripe Black Olives | *Rhizobium jaguaris* |
| SBP00130 | Greek Ripe Black Olives | *Rhizobium leguminosarum* |
| SBP00130 | Greek Ripe Black Olives | *Rhizobium leguminosarum* |
| SBP00130 | Greek Ripe Black Olives | *Rhizobium phaseoli* |
| SBP00130 | Greek Ripe Black Olives | *Rhizobium phaseoli* |
| SBP00130 | Greek Ripe Black Olives | *Rhizobium* sp. NT-26 |
| SBP00130 | Greek Ripe Black Olives | *Rhizobium* sp. NT-26 |
| SBP00130 | Greek Ripe Black Olives | *Rhizobium* sp. NXC14 |
| SBP00130 | Greek Ripe Black Olives | *Rhizobium* sp. NXC14 |
| SBP00130 | Greek Ripe Black Olives | *Rhizobium tropici* |
| SBP00130 | Greek Ripe Black Olives | *Rhizobium tropici* |
| SBP00130 | Greek Ripe Black Olives | *Rhodanobacter denitrificans* |
| SBP00130 | Greek Ripe Black Olives | *Rhodanobacter denitrificans* |
| SBP00130 | Greek Ripe Black Olives | *Rhodanobacteraceae bacterium* Dysh456 |
| SBP00130 | Greek Ripe Black Olives | *Rhodanobacteraceae bacterium* Dysh456 |
| SBP00130 | Greek Ripe Black Olives | *Rhodobacter capsulatus* |
| SBP00130 | Greek Ripe Black Olives | *Rhodobacter capsulatus* |
| SBP00130 | Greek Ripe Black Olives | *Rhodobacter* sp. LPB0142 |
| SBP00130 | Greek Ripe Black Olives | *Rhodobacter* sp. LPB0142 |
| SBP00130 | Greek Ripe Black Olives | *Rhodobacter sphaeroides* |
| SBP00130 | Greek Ripe Black Olives | *Rhodobacter sphaeroides* |
| SBP00130 | Greek Ripe Black Olives | *Rhodobacteraceae bacterium* BAR1 |
| SBP00130 | Greek Ripe Black Olives | *Rhodobacteraceae bacterium* BAR1 |
| SBP00130 | Greek Ripe Black Olives | *Rhodobacteraceae bacterium* QY30 |
| SBP00130 | Greek Ripe Black Olives | *Rhodobacteraceae bacterium* QY30 |
| SBP00130 | Greek Ripe Black Olives | *Rhodobiaceae bacterium* |
| SBP00130 | Greek Ripe Black Olives | *Rhodobiaceae bacterium* |
| SBP00130 | Greek Ripe Black Olives | *Rhodococcus coprophilus* |
| SBP00130 | Greek Ripe Black Olives | *Rhodococcus coprophilus* |
| SBP00130 | Greek Ripe Black Olives | *Rhodococcus erythropolis* |
| SBP00130 | Greek Ripe Black Olives | *Rhodococcus erythropolis* |
| SBP00130 | Greek Ripe Black Olives | *Rhodococcus fascians* |
| SBP00130 | Greek Ripe Black Olives | *Rhodococcus fascians* |
| SBP00130 | Greek Ripe Black Olives | *Rhodococcus* sp. 2G |
| SBP00130 | Greek Ripe Black Olives | *Rhodococcus* sp. 2G |
| SBP00130 | Greek Ripe Black Olives | *Rhodococcus* sp. H-CA8f |
| SBP00130 | Greek Ripe Black Olives | *Rhodococcus* sp. H-CA8f |
| SBP00130 | Greek Ripe Black Olives | *Rhodococcus* sp. S2-17 |
| SBP00130 | Greek Ripe Black Olives | *Rhodococcus* sp. S2-17 |
| SBP00130 | Greek Ripe Black Olives | *Rhodoferax antarcticus* |
| SBP00130 | Greek Ripe Black Olives | *Rhodoferax antarcticus* |
| SBP00130 | Greek Ripe Black Olives | *Rhodoferax ferrireducens* |
| SBP00130 | Greek Ripe Black Olives | *Rhodoferax ferrireducens* |
| SBP00130 | Greek Ripe Black Olives | *Rhodoferax koreense* |
| SBP00130 | Greek Ripe Black Olives | *Rhodoferax koreense* |
| SBP00130 | Greek Ripe Black Olives | *Rhodomicrobium vannielii* |
| SBP00130 | Greek Ripe Black Olives | *Rhodomicrobium vannielii* |
| SBP00130 | Greek Ripe Black Olives | *Rhodoplanes* sp. Z2-YC6860 |
| SBP00130 | Greek Ripe Black Olives | *Rhodoplanes* sp. Z2-YC6860 |
| SBP00130 | Greek Ripe Black Olives | *Rhodopseudomonas palustris* |
| SBP00130 | Greek Ripe Black Olives | *Rhodopseudomonas palustris* |
| SBP00130 | Greek Ripe Black Olives | *Rhodovulum* sp. MB263 |
| SBP00130 | Greek Ripe Black Olives | *Rhodovulum* sp. MB263 |
| SBP00130 | Greek Ripe Black Olives | *Rhodovulum sulfidophilum* |
| SBP00130 | Greek Ripe Black Olives | *Rhodovulum sulfidophilum* |
| SBP00130 | Greek Ripe Black Olives | *Roseateles depolymerans* |
| SBP00130 | Greek Ripe Black Olives | *Roseateles depolymerans* |
| SBP00130 | Greek Ripe Black Olives | *Roseobacter denitrificans* |
| SBP00130 | Greek Ripe Black Olives | *Roseobacter denitrificans* |
| SBP00130 | Greek Ripe Black Olives | *Rubrivivax gelatinosus* |
| SBP00130 | Greek Ripe Black Olives | *Rubrivivax gelatinosus* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Rufibacter* sp. DG31D |
| SBP00130 | Greek Ripe Black Olives | *Rufibacter* sp. DG31D |
| SBP00130 | Greek Ripe Black Olives | *Rummeliibacillus stabekisii* |
| SBP00130 | Greek Ripe Black Olives | *Rummeliibacillus stabekisii* |
| SBP00130 | Greek Ripe Black Olives | *Saccharolobus solfataricus* |
| SBP00130 | Greek Ripe Black Olives | *Saccharolobus solfataricus* |
| SBP00130 | Greek Ripe Black Olives | *Saccharophagus degradans* |
| SBP00130 | Greek Ripe Black Olives | *Saccharophagus degradans* |
| SBP00130 | Greek Ripe Black Olives | *Saccharopolyspora erythraea* |
| SBP00130 | Greek Ripe Black Olives | *Saccharopolyspora erythraea* |
| SBP00130 | Greek Ripe Black Olives | *Saccharospirillum mangrovi* |
| SBP00130 | Greek Ripe Black Olives | *Saccharospirillum mangrovi* |
| SBP00130 | Greek Ripe Black Olives | *Salinicola tamaricis* |
| SBP00130 | Greek Ripe Black Olives | *Salinicola tamaricis* |
| SBP00130 | Greek Ripe Black Olives | *Salinisphaera* sp. LB1 |
| SBP00130 | Greek Ripe Black Olives | *Salinisphaera* sp. LB1 |
| SBP00130 | Greek Ripe Black Olives | *Salinispora arenicola* |
| SBP00130 | Greek Ripe Black Olives | *Salinispora arenicola* |
| SBP00130 | Greek Ripe Black Olives | *Salinivibrio kushneri* |
| SBP00130 | Greek Ripe Black Olives | *Salinivibrio kushneri* |
| SBP00130 | Greek Ripe Black Olives | *Satipiger profundus* |
| SBP00130 | Greek Ripe Black Olives | *Salipiger profundus* |
| SBP00130 | Greek Ripe Black Olives | *Salmonella bongori* |
| SBP00130 | Greek Ripe Black Olives | *Salmonella bongori* |
| SBP00130 | Greek Ripe Black Olives | *Salmonella enterica* |
| SBP00130 | Greek Ripe Black Olives | *Salmonella enterica* |
| SBP00130 | Greek Ripe Black Olives | *Sandaracinus amylolyticus* |
| SBP00130 | Greek Ripe Black Olives | *Sandaracinus amylolyticus* |
| SBP00130 | Greek Ripe Black Olives | *Scytonema* sp. NIES-4073 |
| SBP00130 | Greek Ripe Black Olives | *Scytonema* sp. NIES-4073 |
| SBP00130 | Greek Ripe Black Olives | *Sedimenticola thiotaurini* |
| SBP00130 | Greek Ripe Black Olives | *Sedimenticola thiotaurini* |
| SBP00130 | Greek Ripe Black Olives | *Sedimentitalea* sp. W43 |
| SBP00130 | Greek Ripe Black Olives | *Sedimentitalea* sp. W43 |
| SBP00130 | Greek Ripe Black Olives | *Selenomonas* sp. oral taxon 920 |
| SBP00130 | Greek Ripe Black Olives | *Selenomonas* sp. oral taxon 920 |
| SBP00130 | Greek Ripe Black Olives | *Serpentinomonas mccroryi* |
| SBP00130 | Greek Ripe Black Olives | *Serpentinomonas mccroryi* |
| SBP00130 | Greek Ripe Black Olives | *Serratia ficaria* |
| SBP00130 | Greek Ripe Black Olives | *Serratia ficaria* |
| SBP00130 | Greek Ripe Black Olives | *Serratia fonticola* |
| SBP00130 | Greek Ripe Black Olives | *Serratia fonticola* |
| SBP00130 | Greek Ripe Black Olives | *Serratia liquefaciens* |
| SBP00130 | Greek Ripe Black Olives | *Serratia liquefaciens* |
| SBP00130 | Greek Ripe Black Olives | *Serratia marcescens* |
| SBP00130 | Greek Ripe Black Olives | *Serratia marcescens* |
| SBP00130 | Greek Ripe Black Olives | *Serratia odorifera* |
| SBP00130 | Greek Ripe Black Olives | *Serratia odorifera* |
| SBP00130 | Greek Ripe Black Olives | *Serratia plymuthica* |
| SBP00130 | Greek Ripe Black Olives | *Serratia plymuthica* |
| SBP00130 | Greek Ripe Black Olives | *Serratia proteamaculans* |
| SBP00130 | Greek Ripe Black Olives | *Serratia proteamaculans* |
| SBP00130 | Greek Ripe Black Olives | *Serratia quinivorans* |
| SBP00130 | Greek Ripe Black Olives | *Serratia quinivorans* |
| SBP00130 | Greek Ripe Black Olives | *Serratia rubidaea* |
| SBP00130 | Greek Ripe Black Olives | *Serratia rubidaea* |
| SBP00130 | Greek Ripe Black Olives | *Serratia* sp. |
| SBP00130 | Greek Ripe Black Olives | *Serratia* sp. |
| SBP00130 | Greek Ripe Black Olives | *Serratia* sp. 3ACOL1 |
| SBP00130 | Greek Ripe Black Olives | *Serratia* sp. 3ACOL1 |
| SBP00130 | Greek Ripe Black Olives | *Serratia* sp. ATCC 39006 |
| SBP00130 | Greek Ripe Black Olives | *Serratia* sp. ATCC 39006 |
| SBP00130 | Greek Ripe Black Olives | *Serratia* sp. FDAARGOS_506 |
| SBP00130 | Greek Ripe Black Olives | *Serratia* sp. FDAARGOS_506 |
| SBP00130 | Greek Ripe Black Olives | *Serratia* sp. FS14 |
| SBP00130 | Greek Ripe Black Olives | *Serratia* sp. FS14 |
| SBP00130 | Greek Ripe Black Olives | *Serratia* sp. YD25 |
| SBP00130 | Greek Ripe Black Olives | *Serratia* sp. YD25 |
| SBP00130 | Greek Ripe Black Olives | *Shewanella algae* |
| SBP00130 | Greek Ripe Black Olives | *Shewanella algae* |
| SBP00130 | Greek Ripe Black Olives | *Shewanella amazonensis* |
| SBP00130 | Greek Ripe Black Olives | *Shewanella amazonensis* |
| SBP00130 | Greek Ripe Black Olives | *Shewanella baltica* |
| SBP00130 | Greek Ripe Black Olives | *Shewanella baltica* |
| SBP00130 | Greek Ripe Black Olives | *Shewanella decolorationis* |
| SBP00130 | Greek Ripe Black Olives | *Shewanella decolorationis* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Shewanella denitrificans* |
| SBP00130 | Greek Ripe Black Olives | *Shewanella denitrificans* |
| SBP00130 | Greek Ripe Black Olives | *Shewanella frigidimarina* |
| SBP00130 | Greek Ripe Black Olives | *Shewanella frigidimarina* |
| SBP00130 | Greek Ripe Black Olives | *Shewanella japonica* |
| SBP00130 | Greek Ripe Black Olives | *Shewanella japonica* |
| SBP00130 | Greek Ripe Black Olives | *Shewanella livingstonensis* |
| SBP00130 | Greek Ripe Black Olives | *Shewanella livingstonensis* |
| SBP00130 | Greek Ripe Black Olives | *Shewanella marisflavi* |
| SBP00130 | Greek Ripe Black Olives | *Shewanella marisflavi* |
| SBP00130 | Greek Ripe Black Olives | *Shewanella oneidensis* |
| SBP00130 | Greek Ripe Black Olives | *Shewanella oneidensis* |
| SBP00130 | Greek Ripe Black Olives | *Shewanella psychrophila* |
| SBP00130 | Greek Ripe Black Olives | *Shewanella psychrophila* |
| SBP00130 | Greek Ripe Black Olives | *Shewanella putrefaciens* |
| SBP00130 | Greek Ripe Black Olives | *Shewanella putrefaciens* |
| SBP00130 | Greek Ripe Black Olives | *Shewanella sediminis* |
| SBP00130 | Greek Ripe Black Olives | *Shewanella sediminis* |
| SBP00130 | Greek Ripe Black Olives | *Shewanella* sp. 33B |
| SBP00130 | Greek Ripe Black Olives | *Shewanella* sp. 33B |
| SBP00130 | Greek Ripe Black Olives | *Shewanella* sp. ANA-3 |
| SBP00130 | Greek Ripe Black Olives | *Shewanella* sp. ANA-3 |
| SBP00130 | Greek Ripe Black Olives | *Shewanella* sp. FDAARGOS_354 |
| SBP00130 | Greek Ripe Black Olives | *Shewanella* sp. FDAARGOS_354 |
| SBP00130 | Greek Ripe Black Olives | *Shewanella* sp. M2 |
| SBP00130 | Greek Ripe Black Olives | *Shewanella* sp. M2 |
| SBP00130 | Greek Ripe Black Olives | *Shewanella* sp. TH2012 |
| SBP00130 | Greek Ripe Black Olives | *Shewanella* sp. TH2012 |
| SBP00130 | Greek Ripe Black Olives | *Shewanella violacea* |
| SBP00130 | Greek Ripe Black Olives | *Shewanella violacea* |
| SBP00130 | Greek Ripe Black Olives | *Shimwellia blattae* |
| SBP00130 | Greek Ripe Black Olives | *Shimwellia blattae* |
| SBP00130 | Greek Ripe Black Olives | *Shinella* sp. HZN7 |
| SBP00130 | Greek Ripe Black Olives | *Shinella* sp. HZN7 |
| SBP00130 | Greek Ripe Black Olives | *Simplicispira suum* |
| SBP00130 | Greek Ripe Black Olives | *Simplicispira suum* |
| SBP00130 | Greek Ripe Black Olives | *Sinorhizobium americanum* |
| SBP00130 | Greek Ripe Black Olives | *Sinorhizobium americanum* |
| SBP00130 | Greek Ripe Black Olives | *Sinorhizobium fredii* |
| SBP00130 | Greek Ripe Black Olives | *Sinorhizobium fredii* |
| SBP00130 | Greek Ripe Black Olives | *Sinorhizobium meliloti* |
| SBP00130 | Greek Ripe Black Olives | *Sinorhizobium meliloti* |
| SBP00130 | Greek Ripe Black Olives | *Sodalis glossinidius* |
| SBP00130 | Greek Ripe Black Olives | *Sodalis glossinidius* |
| SBP00130 | Greek Ripe Black Olives | *Sodalis praecaptivus* |
| SBP00130 | Greek Ripe Black Olives | *Sodalis praecaptivus* |
| SBP00130 | Greek Ripe Black Olives | *Solimonas* sp. K1W22B-7 |
| SBP00130 | Greek Ripe Black Olives | *Solimonas* sp. K1W22B-7 |
| SBP00130 | Greek Ripe Black Olives | *Sorangium cellulosum* |
| SBP00130 | Greek Ripe Black Olives | *Sorangium cellulosum* |
| SBP00130 | Greek Ripe Black Olives | *Sphaerospermopsis kisseleviana* |
| SBP00130 | Greek Ripe Black Olives | *Sphaerospermopsis kisseleviana* |
| SBP00130 | Greek Ripe Black Olives | *Sphingobium fuliginis* |
| SBP00130 | Greek Ripe Black Olives | *Sphingobium fuliginis* |
| SBP00130 | Greek Ripe Black Olives | *Sphingobium hydrophobicum* |
| SBP00130 | Greek Ripe Black Olives | *Sphingobium hydrophobicum* |
| SBP00130 | Greek Ripe Black Olives | *Sphingobium* sp. EP60837 |
| SBP00130 | Greek Ripe Black Olives | *Sphingobium* sp. EP60837 |
| SBP00130 | Greek Ripe Black Olives | *Sphingobium* sp. RAC03 |
| SBP00130 | Greek Ripe Black Olives | *Sphingobium* sp. RAC03 |
| SBP00130 | Greek Ripe Black Olives | *Sphingobium* sp. SCG-1 |
| SBP00130 | Greek Ripe Black Olives | *Sphingobium* sp. SCG-1 |
| SBP00130 | Greek Ripe Black Olives | *Sphingobium* sp. TKS |
| SBP00130 | Greek Ripe Black Olives | *Sphingobium* sp. TKS |
| SBP00130 | Greek Ripe Black Olives | *Sphingobium* sp. YG1 |
| SBP00130 | Greek Ripe Black Olives | *Sphingobium* sp. YG1 |
| SBP00130 | Greek Ripe Black Olives | *Sphingobium yanoikuyae* |
| SBP00130 | Greek Ripe Black Olives | *Sphingobium yanoikuyae* |
| SBP00130 | Greek Ripe Black Olives | *Sphingomonas* sp. AAP5 |
| SBP00130 | Greek Ripe Black Olives | *Sphingomonas* sp. AAP5 |
| SBP00130 | Greek Ripe Black Olives | *Sphingomonas* sp. JJ-A5 |
| SBP00130 | Greek Ripe Black Olives | *Sphingomonas* sp. JJ-A5 |
| SBP00130 | Greek Ripe Black Olives | *Sphingomonas* sp. KC8 |
| SBP00130 | Greek Ripe Black Olives | *Sphingomonas* sp. KC8 |
| SBP00130 | Greek Ripe Black Olives | *Sphingomonas taxi* |
| SBP00130 | Greek Ripe Black Olives | *Sphingomonas taxi* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Sphingomonas wittichii* |
| SBP00130 | Greek Ripe Black Olives | *Sphingomonas wittichii* |
| SBP00130 | Greek Ripe Black Olives | *Sphingopyxis fribergensis* |
| SBP00130 | Greek Ripe Black Olives | *Sphingopyxis fribergensis* |
| SBP00130 | Greek Ripe Black Olives | *Sphingopyxis* sp. QXT-31 |
| SBP00130 | Greek Ripe Black Olives | *Sphingopyxis* sp. QXT-31 |
| SBP00130 | Greek Ripe Black Olives | *Spirosoma pollinicola* |
| SBP00130 | Greek Ripe Black Olives | *Spirosoma pollinicola* |
| SBP00130 | Greek Ripe Black Olives | *Staphylococcus aureus* |
| SBP00130 | Greek Ripe Black Olives | *Staphylococcus aureus* |
| SBP00130 | Greek Ripe Black Olives | *Staphylococcus condimenti* |
| SBP00130 | Greek Ripe Black Olives | *Staphylococcus condimenti* |
| SBP00130 | Greek Ripe Black Olives | *Staphylococcus pseudintermedius* |
| SBP00130 | Greek Ripe Black Olives | *Staphylococcus pseudintermedius* |
| SBP00130 | Greek Ripe Black Olives | *Starkeya novella* |
| SBP00130 | Greek Ripe Black Olives | *Starkeya novella* |
| SBP00130 | Greek Ripe Black Olives | *Stella humosa* |
| SBP00130 | Greek Ripe Black Olives | *Stella humosa* |
| SBP00130 | Greek Ripe Black Olives | *Stella vacuolata* |
| SBP00130 | Greek Ripe Black Olives | *Stella vacuolata* |
| SBP00130 | Greek Ripe Black Olives | *Stenotrophomonas acidaminiphila* |
| SBP00130 | Greek Ripe Black Olives | *Stenotrophomonas acidaminiphila* |
| SBP00130 | Greek Ripe Black Olives | *Stenotrophomonas maltophilia* |
| SBP00130 | Greek Ripe Black Olives | *Stenotrophomonas maltophilia* |
| SBP00130 | Greek Ripe Black Olives | *Stenotrophomonas rhizophila* |
| SBP00130 | Greek Ripe Black Olives | *Stenotrophomonas rhizophila* |
| SBP00130 | Greek Ripe Black Olives | *Stenotrophomonas* sp. |
| SBP00130 | Greek Ripe Black Olives | *Stenotrophomonas* sp. |
| SBP00130 | Greek Ripe Black Olives | *Stenotrophomonas* sp. ESTM1D_MKCIP4_1 |
| SBP00130 | Greek Ripe Black Olives | *Stenotrophomonas* sp. ESTM1D_MKCIP4_1 |
| SBP00130 | Greek Ripe Black Olives | *Stenotrophomonas* sp. SAU14A_NAIMI4_5 |
| SBP00130 | Greek Ripe Black Olives | *Stenotrophomonas* sp. SAU14A_NAIMI4_5 |
| SBP00130 | Greek Ripe Black Olives | *Stenotrophomonas* sp. SAU14A_NAIMI4_8 |
| SBP00130 | Greek Ripe Black Olives | *Stenotrophomonas* sp. SAU14A_NAIMI4_8 |
| SBP00130 | Greek Ripe Black Olives | *Steroidobacter denitrificans* |
| SBP00130 | Greek Ripe Black Olives | *Steroidobacter denitrificans* |
| SBP00130 | Greek Ripe Black Olives | *Sterolibacteriaceae bacterium* J5B |
| SBP00130 | Greek Ripe Black Olives | *Sterolibacteriaceae bacterium* J5B |
| SBP00130 | Greek Ripe Black Olives | *Streptococcus urinalis* |
| SBP00130 | Greek Ripe Black Olives | *Streptococcus urinalis* |
| SBP00130 | Greek Ripe Black Olives | *Streptomyces alboflavus* |
| SBP00130 | Greek Ripe Black Olives | *Streptomyces alboflavus* |
| SBP00130 | Greek Ripe Black Olives | *Streptomyces ambofaciens* |
| SBP00130 | Greek Ripe Black Olives | *Streptomyces ambofaciens* |
| SBP00130 | Greek Ripe Black Olives | *Streptomyces antibioticus* |
| SBP00130 | Greek Ripe Black Olives | *Streptomyces antibioticus* |
| SBP00130 | Greek Ripe Black Olives | *Streptomyces clavuligerus* |
| SBP00130 | Greek Ripe Black Olives | *Streptomyces clavuligerus* |
| SBP00130 | Greek Ripe Black Olives | *Streptomyces formicae* |
| SBP00130 | Greek Ripe Black Olives | *Streptomyces formicae* |
| SBP00130 | Greek Ripe Black Olives | *Streptomyces griseorubiginosus* |
| SBP00130 | Greek Ripe Black Olives | *Streptomyces griseorubiginosus* |
| SBP00130 | Greek Ripe Black Olives | *Streptomyces hygroscopicus* |
| SBP00130 | Greek Ripe Black Olives | *Streptomyces hygroscopicus* |
| SBP00130 | Greek Ripe Black Olives | *Streptomyces lincolnensis* |
| SBP00130 | Greek Ripe Black Olives | *Streptomyces lincolnensis* |
| SBP00130 | Greek Ripe Black Olives | *Streptomyces luteoverticillatus* |
| SBP00130 | Greek Ripe Black Olives | *Streptomyces luteoverticillatus* |
| SBP00130 | Greek Ripe Black Olives | *Streptomyces lydicus* |
| SBP00130 | Greek Ripe Black Olives | *Streptomyces lydicus* |
| SBP00130 | Greek Ripe Black Olives | *Streptomyces olivoreticuli* |
| SBP00130 | Greek Ripe Black Olives | *Streptomyces olivoreticuli* |
| SBP00130 | Greek Ripe Black Olives | *Streptomyces pactum* |
| SBP00130 | Greek Ripe Black Olives | *Streptomyces pactum* |
| SBP00130 | Greek Ripe Black Olives | *Streptomyces puniciscabiei* |
| SBP00130 | Greek Ripe Black Olives | *Streptomyces puniciscabiei* |
| SBP00130 | Greek Ripe Black Olives | *Streptomyces* sp. CNQ-509 |
| SBP00130 | Greek Ripe Black Olives | *Streptomyces* sp. CNQ-509 |
| SBP00130 | Greek Ripe Black Olives | *Streptomyces* sp. ICC1 |
| SBP00130 | Greek Ripe Black Olives | *Streptomyces* sp. ICC1 |
| SBP00130 | Greek Ripe Black Olives | *Streptomyces* sp. KPB2 |
| SBP00130 | Greek Ripe Black Olives | *Streptomyces* sp. KPB2 |
| SBP00130 | Greek Ripe Black Olives | *Streptomyces* sp. MK45 |
| SBP00130 | Greek Ripe Black Olives | *Streptomyces* sp. MK45 |
| SBP00130 | Greek Ripe Black Olives | *Streptomyces* sp. SCSIO 03032 |
| SBP00130 | Greek Ripe Black Olives | *Streptomyces* sp. SCSIO 03032 |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Streptomyces* sp. Sge12 |
| SBP00130 | Greek Ripe Black Olives | *Streptomyces* sp. Sge12 |
| SBP00130 | Greek Ripe Black Olives | *Streptomyces* sp. TLI_053 |
| SBP00130 | Greek Ripe Black Olives | *Streptomyces* sp. TLI_053 |
| SBP00130 | Greek Ripe Black Olives | *Streptomyces* sp. ZFG47 |
| SBP00130 | Greek Ripe Black Olives | *Streptomyces* sp. ZFG47 |
| SBP00130 | Greek Ripe Black Olives | *Sulfitobacter pseudonitzschiae* |
| SBP00130 | Greek Ripe Black Olives | *Sulfitobacter pseudonitzschiae* |
| SBP00130 | Greek Ripe Black Olives | *Sulfurospirillum multivorans* |
| SBP00130 | Greek Ripe Black Olives | *Sulfurospirillum multivorans* |
| SBP00130 | Greek Ripe Black Olives | *Synechococcus lividus* |
| SBP00130 | Greek Ripe Black Olives | *Synechococcus lividus* |
| SBP00130 | Greek Ripe Black Olives | *Synechococcus* sp. JA-2-3B'a(2-13) |
| SBP00130 | Greek Ripe Black Olives | *Synechococcus* sp. JA-2-3B'a(2-13) |
| SBP00130 | Greek Ripe Black Olives | *Synechococcus* sp. KORDI-52 |
| SBP00130 | Greek Ripe Black Olives | *Synechococcus* sp. KORDI-52 |
| SBP00130 | Greek Ripe Black Olives | *Synechococcus* sp. PCC 7336 |
| SBP00130 | Greek Ripe Black Olives | *Synechococcus* sp. PCC 7336 |
| SBP00130 | Greek Ripe Black Olives | *Synechococcus* sp. WH 8109 |
| SBP00130 | Greek Ripe Black Olives | *Synechococcus* sp. WH 8109 |
| SBP00130 | Greek Ripe Black Olives | *Teredinibacter turnerae* |
| SBP00130 | Greek Ripe Black Olives | *Teredinibacter turnerae* |
| SBP00130 | Greek Ripe Black Olives | *Terriglobus saanensis* |
| SBP00130 | Greek Ripe Black Olives | *Terriglobus saanensis* |
| SBP00130 | Greek Ripe Black Olives | *Tetragenococcus halophilus* |
| SBP00130 | Greek Ripe Black Olives | *Tetragenococcus halophilus* |
| SBP00130 | Greek Ripe Black Olives | *Tetragenococcus osmophilus* |
| SBP00130 | Greek Ripe Black Olives | *Tetragenococcus osmophilus* |
| SBP00130 | Greek Ripe Black Olives | *Thalassococcus* sp. S3 |
| SBP00130 | Greek Ripe Black Olives | *Thalassococcus* sp. S3 |
| SBP00130 | Greek Ripe Black Olives | *Thalassolituus oleivorans* |
| SBP00130 | Greek Ripe Black Olives | *Thalassolituus oleivorans* |
| SBP00130 | Greek Ripe Black Olives | *Thalassospira indica* |
| SBP00130 | Greek Ripe Black Olives | *Thalassospira indica* |
| SBP00130 | Greek Ripe Black Olives | *Thalassospira marina* |
| SBP00130 | Greek Ripe Black Olives | *Thalassospira marina* |
| SBP00130 | Greek Ripe Black Olives | *Thauera chlorobenzoica* |
| SBP00130 | Greek Ripe Black Olives | *Thauera chlorobenzoica* |
| SBP00130 | Greek Ripe Black Olives | *Thauera humireducens* |
| SBP00130 | Greek Ripe Black Olives | *Thauera humireducens* |
| SBP00130 | Greek Ripe Black Olives | *Thauera* sp. K11 |
| SBP00130 | Greek Ripe Black Olives | *Thauera* sp. K11 |
| SBP00130 | Greek Ripe Black Olives | *Thermodesulfovibrio yellowstonii* |
| SBP00130 | Greek Ripe Black Olives | *Thermodesulfovibrio yellowstonii* |
| SBP00130 | Greek Ripe Black Olives | *Thioalkalivibrio sulfidiphilus* |
| SBP00130 | Greek Ripe Black Olives | *Thioalkalivibrio sulfidiphilus* |
| SBP00130 | Greek Ripe Black Olives | *Thiocystis violascens* |
| SBP00130 | Greek Ripe Black Olives | *Thiocystis violascens* |
| SBP00130 | Greek Ripe Black Olives | *Thioflavicoccus mobilis* |
| SBP00130 | Greek Ripe Black Olives | *Thioflavicoccus mobilis* |
| SBP00130 | Greek Ripe Black Olives | *Thiolapillus brandeum* |
| SBP00130 | Greek Ripe Black Olives | *Thiolapillus brandeum* |
| SBP00130 | Greek Ripe Black Olives | *Thiomonas arsenitoxydans* |
| SBP00130 | Greek Ripe Black Olives | *Thiomonas arsenitoxydans* |
| SBP00130 | Greek Ripe Black Olives | *Treponema* sp. OMZ 838 |
| SBP00130 | Greek Ripe Black Olives | *Treponema* sp. OMZ 838 |
| SBP00130 | Greek Ripe Black Olives | *Tsukamurella paurometabola* |
| SBP00130 | Greek Ripe Black Olives | *Tsukamurella paurometabola* |
| SBP00130 | Greek Ripe Black Olives | uncultured *bacterium* AST2 |
| SBP00130 | Greek Ripe Black Olives | uncultured *bacterium* AST2 |
| SBP00130 | Greek Ripe Black Olives | *Undibacterium parvum* |
| SBP00130 | Greek Ripe Black Olives | *Undibacterium parvum* |
| SBP00130 | Greek Ripe Black Olives | *Variibacter gotjawalensis* |
| SBP00130 | Greek Ripe Black Olives | *Variibacter gotjawalensis* |
| SBP00130 | Greek Ripe Black Olives | *Variovorax boronicumulans* |
| SBP00130 | Greek Ripe Black Olives | *Variovorax boronicumulans* |
| SBP00130 | Greek Ripe Black Olives | *Variovorax paradoxus* |
| SBP00130 | Greek Ripe Black Olives | *Variovorax paradoxus* |
| SBP00130 | Greek Ripe Black Olives | *Variovorax* sp. HW608 |
| SBP00130 | Greek Ripe Black Olives | *Variovorax* sp. HW608 |
| SBP00130 | Greek Ripe Black Olives | *Variovorax* sp. PAMC 28711 |
| SBP00130 | Greek Ripe Black Olives | *Variovorax* sp. PAMC 28711 |
| SBP00130 | Greek Ripe Black Olives | *Variovorax* sp. PMC12 |
| SBP00130 | Greek Ripe Black Olives | *Variovorax* sp. PMC12 |
| SBP00130 | Greek Ripe Black Olives | *Veillonella parvula* |
| SBP00130 | Greek Ripe Black Olives | *Veillonella parvula* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Verminephrobacter eiseniae* |
| SBP00130 | Greek Ripe Black Olives | *Verminephrobacter eiseniae* |
| SBP00130 | Greek Ripe Black Olives | *Vibrio alfacsensis* |
| SBP00130 | Greek Ripe Black Olives | *Vibrio alfacsensis* |
| SBP00130 | Greek Ripe Black Olives | *Vibrio anguillarum* |
| SBP00130 | Greek Ripe Black Olives | *Vibrio anguillarum* |
| SBP00130 | Greek Ripe Black Olives | *Vibrio aphrogenes* |
| SBP00130 | Greek Ripe Black Olives | *Vibrio aphrogenes* |
| SBP00130 | Greek Ripe Black Olives | *Vibrio breoganii* |
| SBP00130 | Greek Ripe Black Olives | *Vibrio breoganii* |
| SBP00130 | Greek Ripe Black Olives | *Vibrio campbellii* |
| SBP00130 | Greek Ripe Black Olives | *Vibrio campbellii* |
| SBP00130 | Greek Ripe Black Olives | *Vibrio casei* |
| SBP00130 | Greek Ripe Black Olives | *Vibrio casei* |
| SBP00130 | Greek Ripe Black Olives | *Vibrio cholerae* |
| SBP00130 | Greek Ripe Black Olives | *Vibrio cholerae* |
| SBP00130 | Greek Ripe Black Olives | *Vibrio coralliilyticus* |
| SBP00130 | Greek Ripe Black Olives | *Vibrio coralliilyticus* |
| SBP00130 | Greek Ripe Black Olives | *Vibrio fluvialis* |
| SBP00130 | Greek Ripe Black Olives | *Vibrio fluvialis* |
| SBP00130 | Greek Ripe Black Olives | *Vibrio furnissii* |
| SBP00130 | Greek Ripe Black Olives | *Vibrio furnissii* |
| SBP00130 | Greek Ripe Black Olives | *Vibrio gazogenes* |
| SBP00130 | Greek Ripe Black Olives | *Vibrio gazogenes* |
| SBP00130 | Greek Ripe Black Olives | *Vibrio harveyi* |
| SBP00130 | Greek Ripe Black Olives | *Vibrio harveyi* |
| SBP00130 | Greek Ripe Black Olives | *Vibrio hyugaensis* |
| SBP00130 | Greek Ripe Black Olives | *Vibrio hyugaensis* |
| SBP00130 | Greek Ripe Black Olives | *Vibrio mediterranei* |
| SBP00130 | Greek Ripe Black Olives | *Vibrio mediterranei* |
| SBP00130 | Greek Ripe Black Olives | *Vibrio mimicus* |
| SBP00130 | Greek Ripe Black Olives | *Vibrio mimicus* |
| SBP00130 | Greek Ripe Black Olives | *Vibrio nigripulchritudo* |
| SBP00130 | Greek Ripe Black Olives | *Vibrio nigripulchritudo* |
| SBP00130 | Greek Ripe Black Olives | *Vibrio owensii* |
| SBP00130 | Greek Ripe Black Olives | *Vibrio owensii* |
| SBP00130 | Greek Ripe Black Olives | *Vibrio parahaemolyticus* |
| SBP00130 | Greek Ripe Black Olives | *Vibrio parahaemolyticus* |
| SBP00130 | Greek Ripe Black Olives | *Vibrio rumoiensis* |
| SBP00130 | Greek Ripe Black Olives | *Vibrio rumoiensis* |
| SBP00130 | Greek Ripe Black Olives | *Vibrio* sp. HBUAS61001 |
| SBP00130 | Greek Ripe Black Olives | *Vibrio* sp. HBUAS61001 |
| SBP00130 | Greek Ripe Black Olives | *Vibrio tritonius* |
| SBP00130 | Greek Ripe Black Olives | *Vibrio tritonius* |
| SBP00130 | Greek Ripe Black Olives | *Vibrio tubiashii* |
| SBP00130 | Greek Ripe Black Olives | *Vibrio tubiashii* |
| SBP00130 | Greek Ripe Black Olives | *Vibrio vulnificus* |
| SBP00130 | Greek Ripe Black Olives | *Vibrio vulnificus* |
| SBP00130 | Greek Ripe Black Olives | *Virgibacillus* sp. Bac332 |
| SBP00130 | Greek Ripe Black Olives | *Virgibacillus* sp. Bac332 |
| SBP00130 | Greek Ripe Black Olives | *Vitreoscilla filiformis* |
| SBP00130 | Greek Ripe Black Olives | *Vitreoscilla filiformis* |
| SBP00130 | Greek Ripe Black Olives | *Vitreoscilla* sp. C1 |
| SBP00130 | Greek Ripe Black Olives | *Vitreoscilla* sp. C1 |
| SBP00130 | Greek Ripe Black Olives | *Vogesella* sp. LIG4 |
| SBP00130 | Greek Ripe Black Olives | *Vogesella* sp. LIG4 |
| SBP00130 | Greek Ripe Black Olives | *Weissella cibaria* |
| SBP00130 | Greek Ripe Black Olives | *Weissella cibaria* |
| SBP00130 | Greek Ripe Black Olives | *Weissella hellenica* |
| SBP00130 | Greek Ripe Black Olives | *Weissella hellenica* |
| SBP00130 | Greek Ripe Black Olives | *Weissella jogaejeotgali* |
| SBP00130 | Greek Ripe Black Olives | *Weissella jogaejeotgali* |
| SBP00130 | Greek Ripe Black Olives | *Weissella paramesenteroides* |
| SBP00130 | Greek Ripe Black Olives | *Weissella paramesenteroides* |
| SBP00130 | Greek Ripe Black Olives | *Xanthobacter autotrophicus* |
| SBP00130 | Greek Ripe Black Olives | *Xanthobacter autotrophicus* |
| SBP00130 | Greek Ripe Black Olives | *Xanthomonas albilineans* |
| SBP00130 | Greek Ripe Black Olives | *Xanthomonas albilineans* |
| SBP00130 | Greek Ripe Black Olives | *Xanthomonas campestris* |
| SBP00130 | Greek Ripe Black Olives | *Xanthomonas campestris* |
| SBP00130 | Greek Ripe Black Olives | *Xanthomonas cassavae* |
| SBP00130 | Greek Ripe Black Olives | *Xanthomonas cassavae* |
| SBP00130 | Greek Ripe Black Olives | *Xanthomonas citri* |
| SBP00130 | Greek Ripe Black Olives | *Xanthomonas citri* |
| SBP00130 | Greek Ripe Black Olives | *Xanthomonas euvesicatoria* |
| SBP00130 | Greek Ripe Black Olives | *Xanthomonas euvesicatoria* |

TABLE 3-continued

List of species identified in each metagenomic sample of each SBP Sample

| SBP ID | SBP Host Common Name | Genus sp. |
|---|---|---|
| SBP00130 | Greek Ripe Black Olives | *Xanthomonas fragariae* |
| SBP00130 | Greek Ripe Black Olives | *Xanthomonas fragariae* |
| SBP00130 | Greek Ripe Black Olives | *Xanthomonas gardneri* |
| SBP00130 | Greek Ripe Black Olives | *Xanthomonas gardneri* |
| SBP00130 | Greek Ripe Black Olives | *Xanthomonas sacchari* |
| SBP00130 | Greek Ripe Black Olives | *Xanthomonas sacchari* |
| SBP00130 | Greek Ripe Black Olives | *Xanthomonas translucens* |
| SBP00130 | Greek Ripe Black Olives | *Xanthomonas translucens* |
| SBP00130 | Greek Ripe Black Olives | *Xanthomonas vesicatoria* |
| SBP00130 | Greek Ripe Black Olives | *Xanthomonas vesicatoria* |
| SBP00130 | Greek Ripe Black Olives | *Xenorhabdus bovienii* |
| SBP00130 | Greek Ripe Black Olives | *Xenorhabdus bovienii* |
| SBP00130 | Greek Ripe Black Olives | *Xenorhabdus doucetiae* |
| SBP00130 | Greek Ripe Black Olives | *Xenorhabdus doucetiae* |
| SBP00130 | Greek Ripe Black Olives | *Xenorhabdus hominickii* |
| SBP00130 | Greek Ripe Black Olives | *Xenorhabdus hominickii* |
| SBP00130 | Greek Ripe Black Olives | *Xenorhabdus nematophila* |
| SBP00130 | Greek Ripe Black Olives | *Xenorhabdus nematophila* |
| SBP00130 | Greek Ripe Black Olives | *Xenorhabdus poinarii* |
| SBP00130 | Greek Ripe Black Olives | *Xenorhabdus poinarii* |
| SBP00130 | Greek Ripe Black Olives | *Xylanimonas cellulosilytica* |
| SBP00130 | Greek Ripe Black Olives | *Xylanimonas cellulosilytica* |
| SBP00130 | Greek Ripe Black Olives | *Yangia pacifica* |
| SBP00130 | Greek Ripe Black Olives | *Yangia pacifica* |
| SBP00130 | Greek Ripe Black Olives | *Yangia* sp. CCB-MM3 |
| SBP00130 | Greek Ripe Black Olives | *Yangia* sp. CCB-MM3 |
| SBP00130 | Greek Ripe Black Olives | *Yersinia aldovae* |
| SBP00130 | Greek Ripe Black Olives | *Yersinia aldovae* |
| SBP00130 | Greek Ripe Black Olives | *Yersinia aleksiciae* |
| SBP00130 | Greek Ripe Black Olives | *Yersinia aleksiciae* |
| SBP00130 | Greek Ripe Black Olives | *Yersinia enterocolitica* |
| SBP00130 | Greek Ripe Black Olives | *Yersinia enterocolitica* |
| SBP00130 | Greek Ripe Black Olives | *Yersinia entomophaga* |
| SBP00130 | Greek Ripe Black Olives | *Yersinia entomophaga* |
| SBP00130 | Greek Ripe Black Olives | *Yersinia frederiksenii* |
| SBP00130 | Greek Ripe Black Olives | *Yersinia frederiksenii* |
| SBP00130 | Greek Ripe Black Olives | *Yersinia intermedia* |
| SBP00130 | Greek Ripe Black Olives | *Yersinia intermedia* |
| SBP00130 | Greek Ripe Black Olives | *Yersinia kristensenii* |
| SBP00130 | Greek Ripe Black Olives | *Yersinia kristensenii* |
| SBP00130 | Greek Ripe Black Olives | *Yersinia massiliensis* |
| SBP00130 | Greek Ripe Black Olives | *Yersinia massiliensis* |
| SBP00130 | Greek Ripe Black Olives | *Yersinia pseudotuberculosis* |
| SBP00130 | Greek Ripe Black Olives | *Yersinia pseudotuberculosis* |
| SBP00130 | Greek Ripe Black Olives | *Yersinia rohdei* |
| SBP00130 | Greek Ripe Black Olives | *Yersinia rohdei* |
| SBP00130 | Greek Ripe Black Olives | *Yersinia ruckeri* |
| SBP00130 | Greek Ripe Black Olives | *Yersinia ruckeri* |
| SBP00130 | Greek Ripe Black Olives | *Yersinia similis* |
| SBP00130 | Greek Ripe Black Olives | *Yersinia similis* |
| SBP00130 | Greek Ripe Black Olives | *Yoonia vestfoldensis* |
| SBP00130 | Greek Ripe Black Olives | *Yoonia vestfoldensis* |
| SBP00130 | Greek Ripe Black Olives | *Zhihengliuella* sp. ISTPL4 |
| SBP00130 | Greek Ripe Black Olives | *Zhihengliuella* sp. ISTPL4 |
| SBP00130 | Greek Ripe Black Olives | *Zhongshania aliphaticivorans* |
| SBP00130 | Greek Ripe Black Olives | *Zhongshania aliphaticivorans* |
| SBP00130 | Greek Ripe Black Olives | *Zobellella denitrificans* |
| SBP00130 | Greek Ripe Black Olives | *Zobellella denitrificans* |
| SBP00130 | Greek Ripe Black Olives | *Zymobacter palmae* |
| SBP00130 | Greek Ripe Black Olives | *Zymobacter palmae* |
| SBP00135 | Grean beans | [*Enterobacter*] *lignolyticus* |
| SBP00135 | Grean beans | [*Mannheimia*] *succiniciproducens* |
| SBP00135 | Grean beans | [*Polyangium*] *brachysporum* |
| SBP00135 | Grean beans | *Achromobacter denitrificans* |
| SBP00135 | Grean beans | *Achromobacter insolitus* |
| SBP00135 | Grean beans | *Achromobacter* sp. 87 |
| SBP00135 | Grean beans | *Achromobacter* sp. MFA1 R4 |
| SBP00135 | Grean beans | *Achromobacter spanius* |
| SBP00135 | Grean beans | *Achromobacter xylosoxidans* |
| SBP00135 | Grean beans | *Acidihalobacter prosperus* |
| SBP00135 | Grean beans | *Acidovorax avenae* |
| SBP00135 | Grean beans | *Acidovorax carolinensis* |
| SBP00135 | Grean beans | *Acidovorax* sp. 1608163 |
| SBP00135 | Grean beans | *Acidovorax* sp. KKS102 |
| SBP00135 | Grean beans | *Acidovorax* sp. RAC01 |
| SBP00135 | Grean beans | *Acidovorax* sp. T1 |

TABLE 3-continued

List of species identified in each metagenomic sample of each SBP Sample

| SBP ID | SBP Host Common Name | Genus sp. |
| --- | --- | --- |
| SBP00135 | Grean beans | *Acinetobacter baumannii* |
| SBP00135 | Grean beans | *Acinetobacter calcoaceticus* |
| SBP00135 | Grean beans | *Acinetobacter guillouiae* |
| SBP00135 | Grean beans | *Acinetobacter johnsonii* |
| SBP00135 | Grean beans | *Acinetobacter lactucae* |
| SBP00135 | Grean beans | *Acinetobacter lwoffii* |
| SBP00135 | Grean beans | *Acinetobacter nosocomialis* |
| SBP00135 | Grean beans | *Acinetobacter oleivorans* |
| SBP00135 | Grean beans | *Acinetobacter pittii* |
| SBP00135 | Grean beans | *Acinetobacter radioresistens* |
| SBP00135 | Grean beans | *Acinetobacter sp. ACNIH1* |
| SBP00135 | Grean beans | *Acinetobacter sp. ACNIH2* |
| SBP00135 | Grean beans | *Acinetobacter sp. TGL-Y2* |
| SBP00135 | Grean beans | *Acinetobacter sp. WCHA55* |
| SBP00135 | Grean beans | *Acinetobacter sp. WCHAc010034* |
| SBP00135 | Grean beans | *Acinetobacter wuhouensis* |
| SBP00135 | Grean beans | *Actinoplanes sp. ATCC 31351* |
| SBP00135 | Grean beans | *Advenella kashmirensis* |
| SBP00135 | Grean beans | *Advenella mimigardefordensis* |
| SBP00135 | Grean beans | *Aerococcus urinae* |
| SBP00135 | Grean beans | *Aeromonas caviae* |
| SBP00135 | Grean beans | *Aeromonas dhakensis* |
| SBP00135 | Grean beans | *Aeromonas encheleia* |
| SBP00135 | Grean beans | *Aeromonas hydrophila* |
| SBP00135 | Grean beans | *Aeromonas media* |
| SBP00135 | Grean beans | *Aeromonas rivipollensis* |
| SBP00135 | Grean beans | *Aeromonas salmonicida* |
| SBP00135 | Grean beans | *Aeromonas schubertii* |
| SBP00135 | Grean beans | *Aeromonas sp.* |
| SBP00135 | Grean beans | *Aeromonas sp. CA23* |
| SBP00135 | Grean beans | *Aeromonas sp. CU5* |
| SBP00135 | Grean beans | *Aeromonas veronii* |
| SBP00135 | Grean beans | *Aggregatibacter aphrophilus* |
| SBP00135 | Grean beans | *Agrobacterium fabrum* |
| SBP00135 | Grean beans | *Agrobacterium larrymoorei* |
| SBP00135 | Grean beans | *Agrobacterium sp.* |
| SBP00135 | Grean beans | *Agrobacterium sp. H13-3* |
| SBP00135 | Grean beans | *Agrobacterium tumefaciens* |
| SBP00135 | Grean beans | *Agrococcus carbonis* |
| SBP00135 | Grean beans | *Agrococcus jejuensis* |
| SBP00135 | Grean beans | *Agrococcus sp. SGAir0287* |
| SBP00135 | Grean beans | *Agromyces aureus* |
| SBP00135 | Grean beans | *Agromyces flavus* |
| SBP00135 | Grean beans | *Agromyces sp. 30A* |
| SBP00135 | Grean beans | *Agromyces sp. LHK192* |
| SBP00135 | Grean beans | *Alcaligenes faecalis* |
| SBP00135 | Grean beans | *Alcanivorax dieselolei* |
| SBP00135 | Grean beans | *Alcanivorax sp. N3-2A* |
| SBP00135 | Grean beans | *Alicycliphilus denitrificans* |
| SBP00135 | Grean beans | *Alicyclobacillus acidocaldarius* |
| SBP00135 | Grean beans | *Alkalilimnicola ehrlichii* |
| SBP00135 | Grean beans | *Aminobacter aminovorans* |
| SBP00135 | Grean beans | *Aquabacterium olei* |
| SBP00135 | Grean beans | *Aquitalea magnusonii* |
| SBP00135 | Grean beans | *Archangium gephyra* |
| SBP00135 | Grean beans | *Arenibacter algicola* |
| SBP00135 | Grean beans | *Arthrobacter alpinus* |
| SBP00135 | Grean beans | *Arthrobacter crystallopoietes* |
| SBP00135 | Grean beans | *Arthrobacter sp. DCT-5* |
| SBP00135 | Grean beans | *Arthrobacter sp. FB24* |
| SBP00135 | Grean beans | *Arthrobacter sp. PGP41* |
| SBP00135 | Grean beans | *Arthrobacter sp. QXT-31* |
| SBP00135 | Grean beans | *Arthrobacter sp. Rue61a* |
| SBP00135 | Grean beans | *Arthrobacter sp. U41* |
| SBP00135 | Grean beans | *Arthrobacter sp. YN* |
| SBP00135 | Grean beans | *Atlantibacter hermannii* |
| SBP00135 | Grean beans | *Azoarcus sp. DN11* |
| SBP00135 | Grean beans | *Azoarcus sp. KH32C* |
| SBP00135 | Grean beans | *Azospirillum brasilense* |
| SBP00135 | Grean beans | *Azospirillum humicireducens* |
| SBP00135 | Grean beans | *Azospirillum lipoferum* |
| SBP00135 | Grean beans | *Azospirillum sp. CFH 70021* |
| SBP00135 | Grean beans | *Azotobacter chroococcum* |
| SBP00135 | Grean beans | *Azotobacter vinelandii* |
| SBP00135 | Grean beans | *Bacillus foraminis* |
| SBP00135 | Grean beans | *Bacillus safensis* |

TABLE 3-continued

List of species identified in each metagenomic sample of each SBP Sample

| SBP ID | SBP Host Common Name | Genus sp. |
|---|---|---|
| SBP00135 | Grean beans | *Bacillus subtilis* |
| SBP00135 | Grean beans | *Bacillus thuringiensis* |
| SBP00135 | Grean beans | BeAn 58058 virus |
| SBP00135 | Grean beans | *Bibersteinia trehalosi* |
| SBP00135 | Grean beans | *Bordetella bronchialis* |
| SBP00135 | Grean beans | *Bordetella petrii* |
| SBP00135 | Grean beans | *Bordetella pseudohinzii* |
| SBP00135 | Grean beans | *Bordetella* sp. N |
| SBP00135 | Grean beans | *Bordetella trematum* |
| SBP00135 | Grean beans | *Bosea* sp. Tri-49 |
| SBP00135 | Grean beans | *Bradyrhizobium diazoefficiens* |
| SBP00135 | Grean beans | *Bradyrhizobium erythrophlei* |
| SBP00135 | Grean beans | *Bradyrhizobium oligotrophicum* |
| SBP00135 | Grean beans | *Bradyrhizobium* sp. BTAi1 |
| SBP00135 | Grean beans | *Bradyrhizobium* sp. CCBAU 51670 |
| SBP00135 | Grean beans | *Bradyrhizobium* sp. ORS 285 |
| SBP00135 | Grean beans | *Bradyrhizobium* sp. S23321 |
| SBP00135 | Grean beans | *Bradyrhizobium* sp. SK17 |
| SBP00135 | Grean beans | *Brenneria goodwinii* |
| SBP00135 | Grean beans | *Brenneria rubrifaciens* |
| SBP00135 | Grean beans | *Burkholderia ambifaria* |
| SBP00135 | Grean beans | *Burkholderia cenocepacia* |
| SBP00135 | Grean beans | *Burkholderia cepacia* |
| SBP00135 | Grean beans | *Burkholderia contaminans* |
| SBP00135 | Grean beans | *Burkholderia gladioli* |
| SBP00135 | Grean beans | *Burkholderia lata* |
| SBP00135 | Grean beans | *Burkholderia multivorans* |
| SBP00135 | Grean beans | *Burkholderia pseudomallei* |
| SBP00135 | Grean beans | *Burkholderia* sp. CCGE1002 |
| SBP00135 | Grean beans | *Burkholderia* sp. OLGA172 |
| SBP00135 | Grean beans | *Burkholderia stabilis* |
| SBP00135 | Grean beans | *Burkholderia ubonensis* |
| SBP00135 | Grean beans | *Burkholderiales* bacterium JOSHI_001 |
| SBP00135 | Grean beans | *Buttiauxella* sp. 3AFRM03 |
| SBP00135 | Grean beans | *Candidatus Fukatsuia symbiotica* |
| SBP00135 | Grean beans | *Candidatus Hamiltonella defensa* |
| SBP00135 | Grean beans | *Candidatus Puniceispirillum marinum* |
| SBP00135 | Grean beans | *Candidatus Sodalis pierantonius* |
| SBP00135 | Grean beans | *Capnocytophaga* sp. ChDC OS43 |
| SBP00135 | Grean beans | *Carnobacterium divergens* |
| SBP00135 | Grean beans | *Castellaniella defragrans* |
| SBP00135 | Grean beans | *Catenovulum* sp. CCB-QB4 |
| SBP00135 | Grean beans | *Caulobacter segnis* |
| SBP00135 | Grean beans | *Cedecea lapagei* |
| SBP00135 | Grean beans | *Cedecea neteri* |
| SBP00135 | Grean beans | *Cellulosilyticum lentocellum* |
| SBP00135 | Grean beans | *Cellulosimicrobium cellulans* |
| SBP00135 | Grean beans | *Chania multitudinisentens* |
| SBP00135 | Grean beans | *Chloroflexus aggregans* |
| SBP00135 | Grean beans | *Chromobacterium vaccinii* |
| SBP00135 | Grean beans | *Chryseobacterium indoltheticum* |
| SBP00135 | Grean beans | *Chthonomonas calidirosea* |
| SBP00135 | Grean beans | *Citrobacter amalonaticus* |
| SBP00135 | Grean beans | *Citrobacter braakii* |
| SBP00135 | Grean beans | *Citrobacter farmeri* |
| SBP00135 | Grean beans | *Citrobacter freundii* |
| SBP00135 | Grean beans | *Citrobacter freundii* complex sp. CFNIH2 |
| SBP00135 | Grean beans | *Citrobacter freundii* complex sp. CFNIH3 |
| SBP00135 | Grean beans | *Citrobacter freundii* complex sp. CFNIH4 |
| SBP00135 | Grean beans | *Citrobacter freundii* complex sp. CFNIH9 |
| SBP00135 | Grean beans | *Citrobacter koseri* |
| SBP00135 | Grean beans | *Citrobacter pasteurii* |
| SBP00135 | Grean beans | *Citrobacter portucalensis* |
| SBP00135 | Grean beans | *Citrobacter rodentium* |
| SBP00135 | Grean beans | *Citrobacter* sp. CFNIH10 |
| SBP00135 | Grean beans | *Citrobacter* sp. CRE-46 |
| SBP00135 | Grean beans | *Citrobacter* sp. FDAARGOS_156 |
| SBP00135 | Grean beans | *Citrobacter werkmanii* |
| SBP00135 | Grean beans | *Citrobacter youngae* |
| SBP00135 | Grean beans | *Clavibacter michiganensis* |
| SBP00135 | Grean beans | *Clostridium aceticum* |
| SBP00135 | Grean beans | *Clostridium botulinum* |
| SBP00135 | Grean beans | *Clostridium cellulovorans* |
| SBP00135 | Grean beans | *Collimonas arenae* |
| SBP00135 | Grean beans | *Collimonas fungivorans* |
| SBP00135 | Grean beans | *Collimonas pratensis* |

TABLE 3-continued

List of species identified in each metagenomic sample of each SBP Sample

| SBP ID | SBP Host Common Name | Genus sp. |
|---|---|---|
| SBP00135 | Grean beans | *Comamonas aquatica* |
| SBP00135 | Grean beans | *Comamonas kerstersii* |
| SBP00135 | Grean beans | *Comamonas serinivorans* |
| SBP00135 | Grean beans | *Comamonas terrigena* |
| SBP00135 | Grean beans | *Congregibacter litoralis* |
| SBP00135 | Grean beans | *Corynebacterium aurimucosum* |
| SBP00135 | Grean beans | *Corynebacterium segmentosum* |
| SBP00135 | Grean beans | *Cronobacter condimenti* |
| SBP00135 | Grean beans | *Cronobacter dublinensis* |
| SBP00135 | Grean beans | *Cronobacter malonaticus* |
| SBP00135 | Grean beans | *Cronobacter muytjensii* |
| SBP00135 | Grean beans | *Cronobacter sakazakii* |
| SBP00135 | Grean beans | *Cronobacter turicensis* |
| SBP00135 | Grean beans | *Cronobacter universalis* |
| SBP00135 | Grean beans | *Cupriavidus basilensis* |
| SBP00135 | Grean beans | *Cupriavidus gilardii* |
| SBP00135 | Grean beans | *Cupriavidus metallidurans* |
| SBP00135 | Grean beans | *Cupriavidus necator* |
| SBP00135 | Grean beans | *Cupriavidus oxalaticus* |
| SBP00135 | Grean beans | *Cupriavidus pauculus* |
| SBP00135 | Grean beans | *Cupriavidus pinatubonensis* |
| SBP00135 | Grean beans | *Cupriavidus taiwanensis* |
| SBP00135 | Grean beans | *Curtobacterium pusillum* |
| SBP00135 | Grean beans | *Curtobacterium* sp. BH-2-1-1 |
| SBP00135 | Grean beans | *Curtobacterium* sp. MR_MD2014 |
| SBP00135 | Grean beans | *Curtobacterium* sp. SGAir0471 |
| SBP00135 | Grean beans | *Curvibacter* sp. AEP1-3 |
| SBP00135 | Grean beans | *Cutibacterium acnes* |
| SBP00135 | Grean beans | *Cyanobacterium aponinum* |
| SBP00135 | Grean beans | *Cystobacter fuscus* |
| SBP00135 | Grean beans | *Dechloromonas* sp. HYN0024 |
| SBP00135 | Grean beans | *Delftia acidovorans* |
| SBP00135 | Grean beans | *Delftia* sp. |
| SBP00135 | Grean beans | *Delftia tsuruhatensis* |
| SBP00135 | Grean beans | *Desulfovibrio vulgaris* |
| SBP00135 | Grean beans | *Devosia* sp. A16 |
| SBP00135 | Grean beans | *Dickeya chrysanthemi* |
| SBP00135 | Grean beans | *Dickeya dadantii* |
| SBP00135 | Grean beans | *Dickeya dianthicola* |
| SBP00135 | Grean beans | *Dickeya fangzhongdai* |
| SBP00135 | Grean beans | *Dickeya paradisiaca* |
| SBP00135 | Grean beans | *Dickeya solani* |
| SBP00135 | Grean beans | *Dickeya* sp. NCPPB 3274 |
| SBP00135 | Grean beans | *Dickeya* sp. NCPPB 569 |
| SBP00135 | Grean beans | *Dickeya* sp. Secpp 1600 |
| SBP00135 | Grean beans | *Dickeya zeae* |
| SBP00135 | Grean beans | *Diptera* sp. BOLD: AAB3286 |
| SBP00135 | Grean beans | *Edwardsiella hoshinae* |
| SBP00135 | Grean beans | *Edwardsiella ictaluri* |
| SBP00135 | Grean beans | *Edwardsiella piscicida* |
| SBP00135 | Grean beans | *Edwardsiella tarda* |
| SBP00135 | Grean beans | *Eggerthella lenta* |
| SBP00135 | Grean beans | *Ensifer sojae* |
| SBP00135 | Grean beans | *Enterobacter asburiae* |
| SBP00135 | Grean beans | *Enterobacter bugandensis* |
| SBP00135 | Grean beans | *Enterobacter cancerogenus* |
| SBP00135 | Grean beans | *Enterobacter cloacae* |
| SBP00135 | Grean beans | *Enterobacter cloacae* complex sp. |
| SBP00135 | Grean beans | *Enterobacter cloacae* complex sp. ECNIH7 |
| SBP00135 | Grean beans | *Enterobacter cloacae* complex sp. FDA-CDC-AR_0132 |
| SBP00135 | Grean beans | *Enterobacter cloacae* complex sp. FDA-CDC-AR_0164 |
| SBP00135 | Grean beans | *Enterobacter hormaechei* |
| SBP00135 | Grean beans | *Enterobacter kobei* |
| SBP00135 | Grean beans | *Enterobacter ludwigii* |
| SBP00135 | Grean beans | *Enterobacter roggenkampii* |
| SBP00135 | Grean beans | *Enterobacter soli* |
| SBP00135 | Grean beans | *Enterobacter* sp. 638 |
| SBP00135 | Grean beans | *Enterobacter* sp. Crenshaw |
| SBP00135 | Grean beans | *Enterobacter* sp. E20 |
| SBP00135 | Grean beans | *Enterobacter* sp. FY-07 |
| SBP00135 | Grean beans | *Enterobacter* sp. HK169 |
| SBP00135 | Grean beans | *Enterobacter* sp. N18-03635 |
| SBP00135 | Grean beans | *Enterobacter* sp. ODB01 |
| SBP00135 | Grean beans | *Enterobacter* sp. R4-368 |
| SBP00135 | Grean beans | *Enterobacter* sp. SA187 |
| SBP00135 | Grean beans | *Enterobacteriaceae bacterium* ENNIH1 |

TABLE 3-continued

List of species identified in each metagenomic sample of each SBP Sample

| SBP ID | SBP Host Common Name | Genus sp. |
|---|---|---|
| SBP00135 | Grean beans | *Enterobacteriaceae bacterium* strain FGI 57 |
| SBP00135 | Grean beans | *Enterobacteriaceae bacterium* w17 |
| SBP00135 | Grean beans | *Enterobacteriaceae bacterium* w6 |
| SBP00135 | Grean beans | *Enterococcus gilvus* |
| SBP00135 | Grean beans | *Erwinia amylovora* |
| SBP00135 | Grean beans | *Erwinia billingiae* |
| SBP00135 | Grean beans | *Erwinia gerundensis* |
| SBP00135 | Grean beans | *Erwinia persicina* |
| SBP00135 | Grean beans | *Erwinia pyrifoliae* |
| SBP00135 | Grean beans | *Erwinia* sp. |
| SBP00135 | Grean beans | *Erwinia* sp. Ejp617 |
| SBP00135 | Grean beans | *Erwinia tasmaniensis* |
| SBP00135 | Grean beans | *Erythrobacter flavus* |
| SBP00135 | Grean beans | *Escherichia albertii* |
| SBP00135 | Grean beans | *Escherichia coli* |
| SBP00135 | Grean beans | *Escherichia fergusonii* |
| SBP00135 | Grean beans | *Escherichia marmotae* |
| SBP00135 | Grean beans | *Escherichia* sp. E4742 |
| SBP00135 | Grean beans | *Escherichia* virus If1 |
| SBP00135 | Grean beans | *Exiguobacterium antarcticum* |
| SBP00135 | Grean beans | *Exiguobacterium mexicanum* |
| SBP00135 | Grean beans | *Exiguobacterium sibiricum* |
| SBP00135 | Grean beans | *Exiguobacterium* sp. MH3 |
| SBP00135 | Grean beans | *Exiguobacterium* sp. N4-1P |
| SBP00135 | Grean beans | *Exiguobacterium* sp. U13-1 |
| SBP00135 | Grean beans | *Exiguobacterium* sp. ZWU0009 |
| SBP00135 | Grean beans | *Ferrimonas balearica* |
| SBP00135 | Grean beans | *Flammeovirga* sp. MY04 |
| SBP00135 | Grean beans | *Flavobacterium crassostreae* |
| SBP00135 | Grean beans | *Frankia inefficax* |
| SBP00135 | Grean beans | *Frankia* sp. EAN1pec |
| SBP00135 | Grean beans | *Frateuria aurantia* |
| SBP00135 | Grean beans | *Frondihabitans* sp. 762G35 |
| SBP00135 | Grean beans | *Frondihabitans* sp. PAMC 28766 |
| SBP00135 | Grean beans | *Fusobacterium nucleatum* |
| SBP00135 | Grean beans | *Gemella haemolysans* |
| SBP00135 | Grean beans | *Gemmata obscuriglobus* |
| SBP00135 | Grean beans | *Geobacter lovleyi* |
| SBP00135 | Grean beans | *Geodermatophilus obscurus* |
| SBP00135 | Grean beans | *Gibbsiella quercinecans* |
| SBP00135 | Grean beans | *Glaciecola nitratireducens* |
| SBP00135 | Grean beans | *Glaciecola* sp. THG-3.7 |
| SBP00135 | Grean beans | *Gluconacetobacter diazotrophicus* |
| SBP00135 | Grean beans | *Glutamicibacter halophytocola* |
| SBP00135 | Grean beans | *Glutamicibacter nicotianae* |
| SBP00135 | Grean beans | *Gryllotalpicola* sp. 2DFW10M-S |
| SBP00135 | Grean beans | *Haemophilus haemolyticus* |
| SBP00135 | Grean beans | *Hafnia alvei* |
| SBP00135 | Grean beans | *Hafnia paralvei* |
| SBP00135 | Grean beans | *Hafnia* sp. CBA7124 |
| SBP00135 | Grean beans | *Hahella chejuensis* |
| SBP00135 | Grean beans | *Hahella* sp. KA22 |
| SBP00135 | Grean beans | *Halomonas hydrothermalis* |
| SBP00135 | Grean beans | *Halomonas* sp. GFAJ-1 |
| SBP00135 | Grean beans | *Halomonas* sp. JS92-SW72 |
| SBP00135 | Grean beans | *Halorientalis* sp. IM1011 |
| SBP00135 | Grean beans | *Halotalea alkalilenta* |
| SBP00135 | Grean beans | *Herbaspirillum hiltneri* |
| SBP00135 | Grean beans | *Herbaspirillum huttiense* |
| SBP00135 | Grean beans | *Herbaspirillum robiniae* |
| SBP00135 | Grean beans | *Herbaspirillum rubrisubalbicans* |
| SBP00135 | Grean beans | *Herbaspirillum seropedicae* |
| SBP00135 | Grean beans | *Herbaspirillum* sp. meg3 |
| SBP00135 | Grean beans | *Hydrogenophaga* sp. PBC |
| SBP00135 | Grean beans | *Idiomarina loihiensis* |
| SBP00135 | Grean beans | *Inhella inkyongensis* |
| SBP00135 | Grean beans | *Janthinobacterium agaricidamnosum* |
| SBP00135 | Grean beans | *Janthinobacterium* sp. 1_2014MBL_MicDiv |
| SBP00135 | Grean beans | *Janthinobacterium* sp. LM6 |
| SBP00135 | Grean beans | *Janthinobacterium svalbardensis* |
| SBP00135 | Grean beans | *Jeotgalibaca* sp. PTS2502 |
| SBP00135 | Grean beans | *Jiangella* sp. DSM 45060 |
| SBP00135 | Grean beans | *Klebsiella aerogenes* |
| SBP00135 | Grean beans | *Klebsiella michiganensis* |
| SBP00135 | Grean beans | *Klebsiella oxytoca* |
| SBP00135 | Grean beans | *Klebsiella pneumoniae* |

TABLE 3-continued

List of species identified in each metagenomic sample of each SBP Sample

| SBP ID | SBP Host Common Name | Genus sp. |
|---|---|---|
| SBP00135 | Grean beans | *Klebsiella quasipneumoniae* |
| SBP00135 | Grean beans | *Klebsiella quasivariicola* |
| SBP00135 | Grean beans | *Klebsiella* sp. FDAARGOS_511 |
| SBP00135 | Grean beans | *Klebsiella* sp. MSal |
| SBP00135 | Grean beans | *Klebsiella* sp. P1CD1 |
| SBP00135 | Grean beans | *Klebsiella* sp. PO552 |
| SBP00135 | Grean beans | *Klebsiella* sp. WCHKl090001 |
| SBP00135 | Grean beans | *Klebsiella variicola* |
| SBP00135 | Grean beans | *Kluyvera intermedia* |
| SBP00135 | Grean beans | *Kocuria rosea* |
| SBP00135 | Grean beans | *Kosakonia cowanii* |
| SBP00135 | Grean beans | *Kosakonia oryzae* |
| SBP00135 | Grean beans | *Kosakonia radicincitans* |
| SBP00135 | Grean beans | *Kosakonia sacchari* |
| SBP00135 | Grean beans | *Kosakonia* sp. CCTCC M2018092 |
| SBP00135 | Grean beans | *Lactobacillus crispatus* |
| SBP00135 | Grean beans | *Lactobacillus fuchuensis* |
| SBP00135 | Grean beans | *Lactobacillus pentosus* |
| SBP00135 | Grean beans | *Laribacter hongkongensis* |
| SBP00135 | Grean beans | *Leclercia adecarboxylata* |
| SBP00135 | Grean beans | *Leclercia* sp. LSNIH1 |
| SBP00135 | Grean beans | *Leclercia* sp. LSNIH3 |
| SBP00135 | Grean beans | *Leifsonia xyli* |
| SBP00135 | Grean beans | *Lelliottia amnigena* |
| SBP00135 | Grean beans | *Lelliottia jeotgali* |
| SBP00135 | Grean beans | *Lelliottia nimipressuralis* |
| SBP00135 | Grean beans | *Lelliottia* sp. WB101 |
| SBP00135 | Grean beans | *Leminorella richardii* |
| SBP00135 | Grean beans | *Leptothrix cholodnii* |
| SBP00135 | Grean beans | *Limnobaculum parvum* |
| SBP00135 | Grean beans | *Listeria monocytogenes* |
| SBP00135 | Grean beans | *Lonsdalea britannica* |
| SBP00135 | Grean beans | *Luteibacter rhizovicinus* |
| SBP00135 | Grean beans | *Lysinimonas* sp. 2DFWR-13 |
| SBP00135 | Grean beans | *Lysobacter antibioticus* |
| SBP00135 | Grean beans | *Lysobacter enzymogenes* |
| SBP00135 | Grean beans | *Lysobacter gummosus* |
| SBP00135 | Grean beans | *Lysobacter* sp. TY2-98 |
| SBP00135 | Grean beans | *Marinobacterium aestuarii* |
| SBP00135 | Grean beans | *Marinomonas* sp. MWYL1 |
| SBP00135 | Grean beans | *Martelella endophytica* |
| SBP00135 | Grean beans | *Martelella mediterranea* |
| SBP00135 | Grean beans | *Massilia albidiflava* |
| SBP00135 | Grean beans | *Massilia armeniaca* |
| SBP00135 | Grean beans | *Massilia lutea* |
| SBP00135 | Grean beans | *Massilia oculi* |
| SBP00135 | Grean beans | *Massilia plicata* |
| SBP00135 | Grean beans | *Massilia putida* |
| SBP00135 | Grean beans | *Massilia* sp. NR 4-1 |
| SBP00135 | Grean beans | *Massilia* sp. WG5 |
| SBP00135 | Grean beans | *Massilia* sp. YMA4 |
| SBP00135 | Grean beans | *Massilia umbonata* |
| SBP00135 | Grean beans | *Massilia violaceinigra* |
| SBP00135 | Grean beans | *Melaminivora* sp. SC2-7 |
| SBP00135 | Grean beans | *Mesorhizobium australicum* |
| SBP00135 | Grean beans | *Mesorhizobium* sp. M2A.F.Ca.ET.043.02.1.1 |
| SBP00135 | Grean beans | *Mesorhizobium* sp. M4B.F.Ca.ET.058.02.1.1 |
| SBP00135 | Grean beans | *Metakosakonia* sp. MRY16-398 |
| SBP00135 | Grean beans | *Methylocella silvestris* |
| SBP00135 | Grean beans | *Methylomonas methanica* |
| SBP00135 | Grean beans | *Methylomonas* sp. LW13 |
| SBP00135 | Grean beans | *Microbacterium foliorum* |
| SBP00135 | Grean beans | *Microbacterium lemovicicum* |
| SBP00135 | Grean beans | *Microbacterium oxydans* |
| SBP00135 | Grean beans | *Microbacterium* sp. 1.5R |
| SBP00135 | Grean beans | *Microbacterium* sp. CGR1 |
| SBP00135 | Grean beans | *Microbacterium* sp. TPU 3598 |
| SBP00135 | Grean beans | *Microbacterium* sp. Y-01 |
| SBP00135 | Grean beans | *Micrococcus luteus* |
| SBP00135 | Grean beans | *Microcystis panniformis* |
| SBP00135 | Grean beans | *Micromonospora auratinigra* |
| SBP00135 | Grean beans | *Micromonospora echinofusca* |
| SBP00135 | Grean beans | *Micromonospora narathiwatensis* |
| SBP00135 | Grean beans | *Microterricola viridarii* |
| SBP00135 | Grean beans | *Mitsuaria* sp. 7 |
| SBP00135 | Grean beans | *Mixta calida* |

TABLE 3-continued

List of species identified in each metagenomic sample of each SBP Sample

| SBP ID | SBP Host Common Name | Genus sp. |
| --- | --- | --- |
| SBP00135 | Grean beans | *Mixta gaviniae* |
| SBP00135 | Grean beans | *Modestobacter marinus* |
| SBP00135 | Grean beans | *Moraxella osloensis* |
| SBP00135 | Grean beans | *Morganella morganii* |
| SBP00135 | Grean beans | *Mycobacterium colombiense* |
| SBP00135 | Grean beans | *Mycolicibacterium aurum* |
| SBP00135 | Grean beans | *Mycolicibacterium chubuense* |
| SBP00135 | Grean beans | *Myxococcus xanthus* |
| SBP00135 | Grean beans | *Natronobacterium gregoryi* |
| SBP00135 | Grean beans | *Neisseria subflava* |
| SBP00135 | Grean beans | *Neomicrococcus aestuarii* |
| SBP00135 | Grean beans | *Neorhizobium* sp. NCHU2750 |
| SBP00135 | Grean beans | *Nissabacter* sp. SGAir0207 |
| SBP00135 | Grean beans | *Nocardia brasiliensis* |
| SBP00135 | Grean beans | *Nocardia* sp. Y48 |
| SBP00135 | Grean beans | *Nocardia terpenica* |
| SBP00135 | Grean beans | *Nocardioides humi* |
| SBP00135 | Grean beans | *Novosphingobium* sp. PP1Y |
| SBP00135 | Grean beans | *Obesumbacterium proteus* |
| SBP00135 | Grean beans | *Oceanimonas* sp. GK1 |
| SBP00135 | Grean beans | *Ochrobactrum* sp. A44 |
| SBP00135 | Grean beans | Only Syngen Nebraska virus 5 |
| SBP00135 | Grean beans | *Opitutaceae bacterium* TAV5 |
| SBP00135 | Grean beans | *Orrella dioscoreae* |
| SBP00135 | Grean beans | *Paenarthrobacter aurescens* |
| SBP00135 | Grean beans | *Paenibacillus durus* |
| SBP00135 | Grean beans | *Paenibacillus* sp. 32O-W |
| SBP00135 | Grean beans | *Paenibacillus* sp. JDR-2 |
| SBP00135 | Grean beans | *Paenibacillus* sp. RUD330 |
| SBP00135 | Grean beans | *Paenibacillus xylanexedens* |
| SBP00135 | Grean beans | *Pandoraea norimbergensis* |
| SBP00135 | Grean beans | *Pandoraea pnomenusa* |
| SBP00135 | Grean beans | *Pandoraea pulmonicola* |
| SBP00135 | Grean beans | *Pandoraea sputorum* |
| SBP00135 | Grean beans | *Pantoea agglomerans* |
| SBP00135 | Grean beans | *Pantoea alhagi* |
| SBP00135 | Grean beans | *Pantoea ananatis* |
| SBP00135 | Grean beans | *Pantoea rwandensis* |
| SBP00135 | Grean beans | *Pantoea* sp. At-9b |
| SBP00135 | Grean beans | *Pantoea* sp. PSNIH1 |
| SBP00135 | Grean beans | *Pantoea* sp. PSNIH2 |
| SBP00135 | Grean beans | *Pantoea stewartii* |
| SBP00135 | Grean beans | *Pantoea vagans* |
| SBP00135 | Grean beans | *Paraburkholderia caribensis* |
| SBP00135 | Grean beans | *Paraburkholderia fungorum* |
| SBP00135 | Grean beans | *Paraburkholderia phytofirmans* |
| SBP00135 | Grean beans | *Paraburkholderia sprentiae* |
| SBP00135 | Grean beans | *Paraburkholderia terrae* |
| SBP00135 | Grean beans | *Paraburkholderia terricola* |
| SBP00135 | Grean beans | *Parachlamydia acanthamoebae* |
| SBP00135 | Grean beans | *Paracoccus yeei* |
| SBP00135 | Grean beans | *Paraglaciecola psychrophila* |
| SBP00135 | Grean beans | *Pasteurella multocida* |
| SBP00135 | Grean beans | *Paucibacter* sp. KCTC 42545 |
| SBP00135 | Grean beans | *Pectobacterium atrosepticum* |
| SBP00135 | Grean beans | *Pectobacterium carotovorum* |
| SBP00135 | Grean beans | *Pectobacterium parmentieri* |
| SBP00135 | Grean beans | *Pectobacterium polaris* |
| SBP00135 | Grean beans | *Pectobacterium wasabiae* |
| SBP00135 | Grean beans | *Photobacterium damselae* |
| SBP00135 | Grean beans | *Photobacterium gaetbulicola* |
| SBP00135 | Grean beans | *Photorhabdus asymbiotica* |
| SBP00135 | Grean beans | *Photorhabdus laumondii* |
| SBP00135 | Grean beans | *Photorhabdus thracensis* |
| SBP00135 | Grean beans | *Phytobacter* sp. SCO41 |
| SBP00135 | Grean beans | *Phytobacter ursingii* |
| SBP00135 | Grean beans | *Pigmentiphaga* sp. H8 |
| SBP00135 | Grean beans | *Plantibacter flavus* |
| SBP00135 | Grean beans | *Plantibacter* sp. |
| SBP00135 | Grean beans | *Plantibacter* sp. PA-3-X8 |
| SBP00135 | Grean beans | *Plautia stali* |
| SBP00135 | Grean beans | *Plautia stali* symbiont |
| SBP00135 | Grean beans | *Plesiomonas shigelloides* |
| SBP00135 | Grean beans | *Pluralibacter gergoviae* |
| SBP00135 | Grean beans | *Polaromonas naphthalenivorans* |
| SBP00135 | Grean beans | *Polaromonas* sp. SP1 |

TABLE 3-continued

List of species identified in each metagenomic sample of each SBP Sample

| SBP ID | SBP Host Common Name | Genus sp. |
| --- | --- | --- |
| SBP00135 | Grean beans | *Polynucleobacter necessarius* |
| SBP00135 | Grean beans | *Porphyrobacter* sp. CACIAM 03H1 |
| SBP00135 | Grean beans | *Porphyromonas gingivalis* |
| SBP00135 | Grean beans | *Pragia fontium* |
| SBP00135 | Grean beans | *Prevotella dentalis* |
| SBP00135 | Grean beans | *Prevotella intermedia* |
| SBP00135 | Grean beans | *Propionibacterium* sp. oral taxon 193 |
| SBP00135 | Grean beans | *Proteus mirabilis* |
| SBP00135 | Grean beans | *Proteus vulgaris* |
| SBP00135 | Grean beans | *Providencia alcalifaciens* |
| SBP00135 | Grean beans | *Providencia heimbachae* |
| SBP00135 | Grean beans | *Providencia rettgeri* |
| SBP00135 | Grean beans | *Providencia rustigianii* |
| SBP00135 | Grean beans | *Providencia* sp. WCHPr000369 |
| SBP00135 | Grean beans | *Providencia stuartii* |
| SBP00135 | Grean beans | *Pseudarthrobacter chlorophenolicus* |
| SBP00135 | Grean beans | *Pseudarthrobacter equi* |
| SBP00135 | Grean beans | *Pseudarthrobacter phenanthrenivorans* |
| SBP00135 | Grean beans | *Pseudarthrobacter sulfonivorans* |
| SBP00135 | Grean beans | *Pseudoalteromonas luteoviolacea* |
| SBP00135 | Grean beans | *Pseudoalteromonas piscicida* |
| SBP00135 | Grean beans | *Pseudoalteromonas* sp. R3 |
| SBP00135 | Grean beans | *Pseudoalteromonas spongiae* |
| SBP00135 | Grean beans | *Pseudomonadaceae bacterium* SI-3 |
| SBP00135 | Grean beans | *Pseudomonas aeruginosa* |
| SBP00135 | Grean beans | *Pseudomonas agarici* |
| SBP00135 | Grean beans | *Pseudomonas alcaligenes* |
| SBP00135 | Grean beans | *Pseudomonas alcaliphila* |
| SBP00135 | Grean beans | *Pseudomonas alkylphenolica* |
| SBP00135 | Grean beans | *Pseudomonas amygdali* |
| SBP00135 | Grean beans | *Pseudomonas antarctica* |
| SBP00135 | Grean beans | *Pseudomonas arsenicoxydans* |
| SBP00135 | Grean beans | *Pseudomonas asplenii* |
| SBP00135 | Grean beans | *Pseudomonas azotoformans* |
| SBP00135 | Grean beans | *Pseudomonas balearica* |
| SBP00135 | Grean beans | *Pseudomonas brassicacearum* |
| SBP00135 | Grean beans | *Pseudomonas brenneri* |
| SBP00135 | Grean beans | *Pseudomonas cedrina* |
| SBP00135 | Grean beans | *Pseudomonas cerasi* |
| SBP00135 | Grean beans | *Pseudomonas chlororaphis* |
| SBP00135 | Grean beans | *Pseudomonas cichorii* |
| SBP00135 | Grean beans | *Pseudomonas citronellolis* |
| SBP00135 | Grean beans | *Pseudomonas corrugata* |
| SBP00135 | Grean beans | *Pseudomonas cremoricolorata* |
| SBP00135 | Grean beans | *Pseudomonas entomophila* |
| SBP00135 | Grean beans | *Pseudomonas extremaustralis* |
| SBP00135 | Grean beans | *Pseudomonas extremorientalis* |
| SBP00135 | Grean beans | *Pseudomonas fluorescens* |
| SBP00135 | Grean beans | *Pseudomonas fragi* |
| SBP00135 | Grean beans | *Pseudomonas frederiksbergensis* |
| SBP00135 | Grean beans | *Pseudomonas fulva* |
| SBP00135 | Grean beans | *Pseudomonas furukawaii* |
| SBP00135 | Grean beans | *Pseudomonas fuscovaginae* |
| SBP00135 | Grean beans | *Pseudomonas granadensis* |
| SBP00135 | Grean beans | *Pseudomonas guangdongensis* |
| SBP00135 | Grean beans | *Pseudomonas knackmussii* |
| SBP00135 | Grean beans | *Pseudomonas koreensis* |
| SBP00135 | Grean beans | *Pseudomonas kribbensis* |
| SBP00135 | Grean beans | *Pseudomonas libanensis* |
| SBP00135 | Grean beans | *Pseudomonas lini* |
| SBP00135 | Grean beans | *Pseudomonas litoralis* |
| SBP00135 | Grean beans | *Pseudomonas lurida* |
| SBP00135 | Grean beans | *Pseudomonas mandelii* |
| SBP00135 | Grean beans | *Pseudomonas mediterranea* |
| SBP00135 | Grean beans | *Pseudomonas mendocina* |
| SBP00135 | Grean beans | *Pseudomonas monteilii* |
| SBP00135 | Grean beans | *Pseudomonas moraviensis* |
| SBP00135 | Grean beans | *Pseudomonas mosselii* |
| SBP00135 | Grean beans | *Pseudomonas mucidolens* |
| SBP00135 | Grean beans | *Pseudomonas orientalis* |
| SBP00135 | Grean beans | *Pseudomonas oryzae* |
| SBP00135 | Grean beans | *Pseudomonas oryzihabitans* |
| SBP00135 | Grean beans | *Pseudomonas palleroniana* |
| SBP00135 | Grean beans | *Pseudomonas parafulva* |
| SBP00135 | Grean beans | *Pseudomonas plecoglossicida* |
| SBP00135 | Grean beans | *Pseudomonas poae* |

TABLE 3-continued

List of species identified in each metagenomic sample of each SBP Sample

| SBP ID | SBP Host Common Name | Genus sp. |
|---|---|---|
| SBP00135 | Grean beans | *Pseudomonas pohangensis* |
| SBP00135 | Grean beans | *Pseudomonas prosekii* |
| SBP00135 | Grean beans | *Pseudomonas protegens* |
| SBP00135 | Grean beans | *Pseudomonas psychrophila* |
| SBP00135 | Grean beans | *Pseudomonas psychrotolerans* |
| SBP00135 | Grean beans | *Pseudomonas putida* |
| SBP00135 | Grean beans | *Pseudomonas reinekei* |
| SBP00135 | Grean beans | *Pseudomonas resinovorans* |
| SBP00135 | Grean beans | *Pseudomonas rhizosphaerae* |
| SBP00135 | Grean beans | *Pseudomonas rhodesiae* |
| SBP00135 | Grean beans | *Pseudomonas sabulinigri* |
| SBP00135 | Grean beans | *Pseudomonas salegens* |
| SBP00135 | Grean beans | *Pseudomonas saudiphocaensis* |
| SBP00135 | Grean beans | *Pseudomonas savastanoi* |
| SBP00135 | Grean beans | *Pseudomonas sihuiensis* |
| SBP00135 | Grean beans | *Pseudomonas silesiensis* |
| SBP00135 | Grean beans | *Pseudomonas simiae* |
| SBP00135 | Grean beans | *Pseudomonas soli* |
| SBP00135 | Grean beans | *Pseudomonas sp.* |
| SBP00135 | Grean beans | *Pseudomonas sp.* 02C 26 |
| SBP00135 | Grean beans | *Pseudomonas sp.* 09C 129 |
| SBP00135 | Grean beans | *Pseudomonas sp.* 31-12 |
| SBP00135 | Grean beans | *Pseudomonas sp.* 7SR1 |
| SBP00135 | Grean beans | *Pseudomonas sp.* A214 |
| SBP00135 | Grean beans | *Pseudomonas sp.* ATCC 13867 |
| SBP00135 | Grean beans | *Pseudomonas sp.* B10 |
| SBP00135 | Grean beans | *Pseudomonas sp.* bs2935 |
| SBP00135 | Grean beans | *Pseudomonas sp.* CC6-YY-74 |
| SBP00135 | Grean beans | *Pseudomonas sp.* CCOS 191 |
| SBP00135 | Grean beans | *Pseudomonas sp.* CMR12a |
| SBP00135 | Grean beans | *Pseudomonas sp.* CMR5c |
| SBP00135 | Grean beans | *Pseudomonas sp.* DR 5-09 |
| SBP00135 | Grean beans | *Pseudomonas sp.* DY-1 |
| SBP00135 | Grean beans | *Pseudomonas sp.* FDAARGOS_380 |
| SBP00135 | Grean beans | *Pseudomonas sp.* FGI182 |
| SBP00135 | Grean beans | *Pseudomonas sp.* GR 6-02 |
| SBP00135 | Grean beans | *Pseudomonas sp.* HLS-6 |
| SBP00135 | Grean beans | *Pseudomonas sp.* JY-Q |
| SBP00135 | Grean beans | *Pseudomonas sp.* K2W315-8 |
| SBP00135 | Grean beans | *Pseudomonas sp.* LAB-08 |
| SBP00135 | Grean beans | *Pseudomonas sp.* LBUM920 |
| SBP00135 | Grean beans | *Pseudomonas sp.* Leaf58 |
| SBP00135 | Grean beans | *Pseudomonas sp.* LG1D9 |
| SBP00135 | Grean beans | *Pseudomonas sp.* LG1E9 |
| SBP00135 | Grean beans | *Pseudomonas sp.* LH1G9 |
| SBP00135 | Grean beans | *Pseudomonas sp.* LPH1 |
| SBP00135 | Grean beans | *Pseudomonas sp.* LTGT-11-2Z |
| SBP00135 | Grean beans | *Pseudomonas sp.* LTJR-52 |
| SBP00135 | Grean beans | *Pseudomonas sp.* Lz4W |
| SBP00135 | Grean beans | *Pseudomonas sp.* M30-35 |
| SBP00135 | Grean beans | *Pseudomonas sp.* MRSN12121 |
| SBP00135 | Grean beans | *Pseudomonas sp.* MT-1 |
| SBP00135 | Grean beans | *Pseudomonas sp.* MYb193 |
| SBP00135 | Grean beans | *Pseudomonas sp.* NC02 |
| SBP00135 | Grean beans | *Pseudomonas sp.* NS1(2017) |
| SBP00135 | Grean beans | *Pseudomonas sp.* Os17 |
| SBP00135 | Grean beans | *Pseudomonas sp.* phDV1 |
| SBP00135 | Grean beans | *Pseudomonas sp.* PONIH3 |
| SBP00135 | Grean beans | *Pseudomonas sp.* R1-43-08 |
| SBP00135 | Grean beans | *Pseudomonas sp.* R11-23-07 |
| SBP00135 | Grean beans | *Pseudomonas sp.* R2-37-08W |
| SBP00135 | Grean beans | *Pseudomonas sp.* R2-60-08W |
| SBP00135 | Grean beans | *Pseudomonas sp.* R2-7-07 |
| SBP00135 | Grean beans | *Pseudomonas sp.* R2A2 |
| SBP00135 | Grean beans | *Pseudomonas sp.* R3-18-08 |
| SBP00135 | Grean beans | *Pseudomonas sp.* R3-52-08 |
| SBP00135 | Grean beans | *Pseudomonas sp.* R4-34-07 |
| SBP00135 | Grean beans | *Pseudomonas sp.* R4-35-07 |
| SBP00135 | Grean beans | *Pseudomonas sp.* R4-39-08 |
| SBP00135 | Grean beans | *Pseudomonas sp.* R5-89-07 |
| SBP00135 | Grean beans | *Pseudomonas sp.* RU47 |
| SBP00135 | Grean beans | *Pseudomonas sp.* S-6-2 |
| SBP00135 | Grean beans | *Pseudomonas sp.* S09G 359 |
| SBP00135 | Grean beans | *Pseudomonas sp.* s211(2017) |
| SBP00135 | Grean beans | *Pseudomonas sp.* SGAir0191 |
| SBP00135 | Grean beans | *Pseudomonas sp.* St29 |

TABLE 3-continued

List of species identified in each metagenomic sample of each SBP Sample

| SBP ID | SBP Host Common Name | Genus sp. |
|---|---|---|
| SBP00135 | Grean beans | *Pseudomonas* sp. StFLB209 |
| SBP00135 | Grean beans | *Pseudomonas* sp. SWI36 |
| SBP00135 | Grean beans | *Pseudomonas* sp. SWI44 |
| SBP00135 | Grean beans | *Pseudomonas* sp. SWI6 |
| SBP00135 | Grean beans | *Pseudomonas* sp. SXM-1 |
| SBP00135 | Grean beans | *Pseudomonas* sp. TCU-HL1 |
| SBP00135 | Grean beans | *Pseudomonas* sp. TKP |
| SBP00135 | Grean beans | *Pseudomonas* sp. TMW 2.1634 |
| SBP00135 | Grean beans | *Pseudomonas* sp. URMO17WK12:I11 |
| SBP00135 | Grean beans | *Pseudomonas* sp. UW4 |
| SBP00135 | Grean beans | *Pseudomonas* sp. VLB120 |
| SBP00135 | Grean beans | *Pseudomonas* sp. WCS374 |
| SBP00135 | Grean beans | *Pseudomonas* sp. XWY-1 |
| SBP00135 | Grean beans | *Pseudomonas* sp. Z003-0.4C(8344-21) |
| SBP00135 | Grean beans | *Pseudomonas stutzeri* |
| SBP00135 | Grean beans | *Pseudomonas synxantha* |
| SBP00135 | Grean beans | *Pseudomonas syringae* |
| SBP00135 | Grean beans | *Pseudomonas syringae* group genomosp. 3 |
| SBP00135 | Grean beans | *Pseudomonas taetrolens* |
| SBP00135 | Grean beans | *Pseudomonas thivervalensis* |
| SBP00135 | Grean beans | *Pseudomonas tolaasii* |
| SBP00135 | Grean beans | *Pseudomonas trivialis* |
| SBP00135 | Grean beans | *Pseudomonas umsongensis* |
| SBP00135 | Grean beans | *Pseudomonas vancouverensis* |
| SBP00135 | Grean beans | *Pseudomonas veronii* |
| SBP00135 | Grean beans | *Pseudomonas versuta* |
| SBP00135 | Grean beans | *Pseudomonas viridiflava* |
| SBP00135 | Grean beans | *Pseudomonas xanthomarina* |
| SBP00135 | Grean beans | *Pseudomonas xinjiangensis* |
| SBP00135 | Grean beans | *Pseudomonas yamanorum* |
| SBP00135 | Grean beans | *Pseudoxanthomonas spadix* |
| SBP00135 | Grean beans | *Pusillimonas* sp. T7-7 |
| SBP00135 | Grean beans | *Rahnella aquatilis* |
| SBP00135 | Grean beans | *Rahnella* sp. ERMR1:05 |
| SBP00135 | Grean beans | *Rahnella* sp. Y9602 |
| SBP00135 | Grean beans | *Ralstonia insidiosa* |
| SBP00135 | Grean beans | *Ralstonia mannitolilytica* |
| SBP00135 | Grean beans | *Ralstonia* phage RP12 |
| SBP00135 | Grean beans | *Ralstonia pickettii* |
| SBP00135 | Grean beans | *Ralstonia solanacearum* |
| SBP00135 | Grean beans | *Raoultella ornithinolytica* |
| SBP00135 | Grean beans | *Raoultella planticola* |
| SBP00135 | Grean beans | *Raoultella terrigena* |
| SBP00135 | Grean beans | *Rathayibacter festucae* |
| SBP00135 | Grean beans | *Rhizobacter gummiphilus* |
| SBP00135 | Grean beans | *Rhizobium leguminosarum* |
| SBP00135 | Grean beans | *Rhizobium* sp. IRBG74 |
| SBP00135 | Grean beans | *Rhodanobacter denitrificans* |
| SBP00135 | Grean beans | *Rhodobacter sphaeroides* |
| SBP00135 | Grean beans | *Rhodococcus fascians* |
| SBP00135 | Grean beans | *Rhodococcus opacus* |
| SBP00135 | Grean beans | *Rhodoferax koreense* |
| SBP00135 | Grean beans | *Rhodopseudomonas palustris* |
| SBP00135 | Grean beans | *Rhodospirillum rubrum* |
| SBP00135 | Grean beans | *Roseateles depolymerans* |
| SBP00135 | Grean beans | *Roseomonas gilardii* |
| SBP00135 | Grean beans | *Rothia aeria* |
| SBP00135 | Grean beans | *Rummeliibacillus stabekisii* |
| SBP00135 | Grean beans | *Sagittula* sp. P11 |
| SBP00135 | Grean beans | *Salinicola tamaricis* |
| SBP00135 | Grean beans | *Salinivibrio kushneri* |
| SBP00135 | Grean beans | *Salipiger profundus* |
| SBP00135 | Grean beans | *Salmonella bongori* |
| SBP00135 | Grean beans | *Salmonella enterica* |
| SBP00135 | Grean beans | *Sanguibacter keddieii* |
| SBP00135 | Grean beans | *Serpentinomonas mccroryi* |
| SBP00135 | Grean beans | *Serratia entomophila* |
| SBP00135 | Grean beans | *Serratia ficaria* |
| SBP00135 | Grean beans | *Serratia fonticola* |
| SBP00135 | Grean beans | *Serratia liquefaciens* |
| SBP00135 | Grean beans | *Serratia marcescens* |
| SBP00135 | Grean beans | *Serratia odorifera* |
| SBP00135 | Grean beans | *Serratia plymuthica* |
| SBP00135 | Grean beans | *Serratia proteamaculans* |
| SBP00135 | Grean beans | *Serratia quinivorans* |
| SBP00135 | Grean beans | *Serratia rubidaea* |

TABLE 3-continued

List of species identified in each metagenomic sample of each SBP Sample

| SBP ID | SBP Host Common Name | Genus sp. |
|---|---|---|
| SBP00135 | Grean beans | *Serratia* sp. |
| SBP00135 | Grean beans | *Serratia* sp. 1D1416 |
| SBP00135 | Grean beans | *Serratia* sp. 3ACOL1 |
| SBP00135 | Grean beans | *Serratia* sp. ATCC 39006 |
| SBP00135 | Grean beans | *Serratia* sp. FDAARGOS_506 |
| SBP00135 | Grean beans | *Serratia* sp. FGI94 |
| SBP00135 | Grean beans | *Serratia* sp. FS14 |
| SBP00135 | Grean beans | *Serratia* sp. JKS000199 |
| SBP00135 | Grean beans | *Serratia* sp. LS-1 |
| SBP00135 | Grean beans | *Serratia* sp. MYb239 |
| SBP00135 | Grean beans | *Serratia* sp. P2ACOL2 |
| SBP00135 | Grean beans | *Serratia* sp. SCBI |
| SBP00135 | Grean beans | *Serratia* sp. SSNIH1 |
| SBP00135 | Grean beans | *Serratia* sp. YD25 |
| SBP00135 | Grean beans | *Shewanella algae* |
| SBP00135 | Grean beans | *Shewanella japonica* |
| SBP00135 | Grean beans | *Shewanella loihica* |
| SBP00135 | Grean beans | *Shewanella* sp. ANA-3 |
| SBP00135 | Grean beans | *Shigella dysenteriae* |
| SBP00135 | Grean beans | *Shimwellia blattae* |
| SBP00135 | Grean beans | *Sinorhizobium meliloti* |
| SBP00135 | Grean beans | *Sinorhizobium* sp. RAC02 |
| SBP00135 | Grean beans | *Snodgrassella alvi* |
| SBP00135 | Grean beans | *Sodalis glossinidius* |
| SBP00135 | Grean beans | *Sodalis praecaptivus* |
| SBP00135 | Grean beans | *Solitalea canadensis* |
| SBP00135 | Grean beans | *Sorangium cellulosum* |
| SBP00135 | Grean beans | *Sphaerobacter thermophilus* |
| SBP00135 | Grean beans | *Sphingobium yanoikuyae* |
| SBP00135 | Grean beans | *Sphingomonas melonis* |
| SBP00135 | Grean beans | *Sphingomonas panacis* |
| SBP00135 | Grean beans | *Sphingomonas* sp. AAP5 |
| SBP00135 | Grean beans | *Sphingomonas* sp. C8-2 |
| SBP00135 | Grean beans | *Sphingomonas* sp. Cra20 |
| SBP00135 | Grean beans | *Sphingomonas* sp. FARSPH |
| SBP00135 | Grean beans | *Sphingomonas* sp. LK11 |
| SBP00135 | Grean beans | *Sphingomonas* sp. LM7 |
| SBP00135 | Grean beans | *Sphingomonas* sp. MM-1 |
| SBP00135 | Grean beans | *Sphingomonas taxi* |
| SBP0013S | Grean beans | *Staphylococcus aureus* |
| SBP00135 | Grean beans | *Staphylococcus epidermidis* |
| SBP00135 | Grean beans | *Staphylococcus haemolyticus* |
| SBP00135 | Grean beans | *Staphylococcus hominis* |
| SBP00135 | Grean beans | *Staphylococcus simiae* |
| SBP00135 | Grean beans | *Stappia* sp. ES.058 |
| SBP00135 | Grean beans | *Stenotrophomonas acidaminiphila* |
| SBP00135 | Grean beans | *Stenotrophomonas maltophilia* |
| SBP00135 | Grean beans | *Stenotrophomonas rhizophila* |
| SBP00135 | Grean beans | *Stenotrophomonas* sp. |
| SBP00135 | Grean beans | *Stenotrophomonas* sp. ESTM1D_MKCIP4_1 |
| SBP00135 | Grean beans | *Stenotrophomonas* sp. G4 |
| SBP00135 | Grean beans | *Stenotrophomonas* sp. LM091 |
| SBP00135 | Grean beans | *Stenotrophomonas* sp. MYb57 |
| SBP00135 | Grean beans | *Stenotrophomonas* sp. Pemsol |
| SBP00135 | Grean beans | *Stenotrophomonas* sp. SAU14A_NAIMI4_5 |
| SBP00135 | Grean beans | *Stenotrophomonas* sp. SAU14A_NAIMI4_8 |
| SBP00135 | Grean beans | *Stenotrophomonas* sp. WZN-1 |
| SBP00135 | Grean beans | *Stenotrophomonas* sp. YAU14A_MKIMI4_1 |
| SBP00135 | Grean beans | *Stenotrophomonas* sp. YAU14D1_LEIMI4_1 |
| SBP00135 | Grean beans | *Stenotrophomonas* sp. ZAC14A_NAIMI4_1 |
| SBP00135 | Grean beans | *Stenotrophomonas* sp. ZAC14D2_NAIMI4_6 |
| SBP00135 | Grean beans | *Stenotrophomonas* sp. ZAC14D2_NAIMI4_7 |
| SBP00135 | Grean beans | *Streptococcus mitis* |
| SBP00135 | Grean beans | *Streptococcus porcinus* |
| SBP00135 | Grean beans | *Streptomyces albus* |
| SBP00135 | Grean beans | *Streptomyces griseochromogenes* |
| SBP00135 | Grean beans | *Streptomyces niveus* |
| SBP00135 | Grean beans | *Streptomyces pristinaespiralis* |
| SBP00135 | Grean beans | *Streptomyces qaidamensis* |
| SBP00135 | Grean beans | *Streptomyces* sp. SAT1 |
| SBP00135 | Grean beans | *Sulfuricaulis limicola* |
| SBP00135 | Grean beans | *Tatumella citrea* |
| SBP00135 | Grean beans | *Tatumella ptyseos* |
| SBP00135 | Grean beans | *Thalassolituus oleivorans* |
| SBP00135 | Grean beans | *Thermomonas* sp. SY21 |
| SBP00135 | Grean beans | *Thermomonospora curvata* |

TABLE 3-continued

List of species identified in each metagenomic sample of each SBP Sample

| SBP ID | SBP Host Common Name | Genus sp. |
|---|---|---|
| SBP00135 | Grean beans | *Thermus brockianus* |
| SBP00135 | Grean beans | *Thiomicrospira aerophila* |
| SBP00135 | Grean beans | *Thiomonas* sp. X19 |
| SBP00135 | Grean beans | *Tolumonas auensis* |
| SBP00135 | Grean beans | *Variovorax boronicumulans* |
| SBP00135 | Grean beans | *Variovorax paradoxus* |
| SBP00135 | Grean beans | *Variovorax* sp. HW608 |
| SBP00135 | Grean beans | *Variovorax* sp. PAMC 28711 |
| SBP00135 | Grean beans | *Verrucosispora maris* |
| SBP00135 | Grean beans | *Vibrio cholerae* |
| SBP00135 | Grean beans | *Vibrio cyclitrophicus* |
| SBP00135 | Grean beans | *Vibrio fluvialis* |
| SBP00135 | Grean beans | *Vibrio furnissil* |
| SBP00135 | Grean beans | *Vibrio gazogenes* |
| SBP00135 | Grean beans | *Vibrio natriegens* |
| SBP00135 | Grean beans | *Vibrio nigripulchritudo* |
| SBP00135 | Grean beans | *Vibrio parahaemolyticus* |
| SBP00135 | Grean beans | *Vibrio rotiferianus* |
| SBP00135 | Grean beans | *Vibrio vulnificus* |
| SBP00135 | Grean beans | *Vitreoscilla* sp. C1 |
| SBP00135 | Grean beans | *Vogesella* sp. LIG4 |
| SBP00135 | Grean beans | *Xanthomonas campestris* |
| SBP00135 | Grean beans | *Xanthomonas cassavae* |
| SBP00135 | Grean beans | *Xanthomonas citri* |
| SBP00135 | Grean beans | *Xanthomonas euvesicatoria* |
| SBP00135 | Grean beans | *Xanthomonas oryzae* |
| SBP00135 | Grean beans | *Xanthomonas sacchari* |
| SBP00135 | Grean beans | *Xanthomonas translucens* |
| SBP00135 | Grean beans | *Xanthomonas vesicatoria* |
| SBP00135 | Grean beans | *Xenorhabdus bovienii* |
| SBP00135 | Grean beans | *Xenorhabdus doucetiae* |
| SBP00135 | Grean beans | *Xenorhabdus hominickii* |
| SBP00135 | Grean beans | *Xenorhabdus nematophila* |
| SBP00135 | Grean beans | *Xenorhabdus poinarii* |
| SBP00135 | Grean beans | *Xylella fastidiosa* |
| SBP00135 | Grean beans | *Yersinia aldovae* |
| SBP00135 | Grean beans | *Yersinia aleksiciae* |
| SBP00135 | Grean beans | *Yersinia enterocolitica* |
| SBP00135 | Grean beans | *Yersinia entomophaga* |
| SBP00135 | Grean beans | *Yersinia frederiksenii* |
| SBP00135 | Grean beans | *Yersinia intermedia* |
| SBP00135 | Grean beans | *Yersinia kristensenii* |
| SBP00135 | Grean beans | *Yersinia massiliensis* |
| SBP00135 | Grean beans | *Yersinia pestis* |
| SBP00135 | Grean beans | *Yersinia pseudotuberculosis* |
| SBP00135 | Grean beans | *Yersinia rohdei* |
| SBP00135 | Grean beans | *Yersinia ruckeri* |
| SBP00135 | Grean beans | *Yersinia similis* |
| SBP00135 | Grean beans | *Zobellella denitrificans* |
| SBP00142 (SBE00449) | Red prickly pear¬†-tuna roja | [*Enterobacter*] *lignolyticus* |
| SBP00142 (SBE00449) | Red prickly pear¬†-tuna roja | *Acinetobacter baumannii* |
| SBP00142 (SBE00449) | Red prickly pear¬†-tuna roja | *Acinetobacter calcoaceticus* |
| SBP00142 (SBE00449) | Red prickly pear¬†-tuna roja | *Acinetobacter johnsonii* |
| SBP00142 (SBE00449) | Red prickly pear¬†-tuna roja | *Acinetobacter oleivorans* |
| SBP00142 (SBE00449) | Red prickly pear¬†-tuna roja | *Acinetobacter pittii* |
| SBP00142 (SBE00449) | Red prickly pear¬†-tuna roja | *Aeromonas salmonicida* |
| SBP00142 (SBE00449) | Red prickly pear¬†-tuna roja | *Aeromonas* sp. CA23 |
| SBP00142 (SBE00449) | Red prickly pear¬†-tuna roja | *Atlantibacter hermannii* |
| SBP00142 (SBE00449) | Red prickly pear¬†-tuna roja | *Bacillus cereus* |
| SBP00142 (SBE00449) | Red prickly pear¬†-tuna roja | *Bacillus thuringiensis* |
| SBP00142 (SBE00449) | Red prickly pear¬†-tuna roja | *Brenneria goodwinii* |
| SBP00142 (SBE00449) | Red prickly pear¬†-tuna roja | *Brenneria* sp. EniD312 |
| SBP00142 (SBE00449) | Red prickly pear¬†-tuna roja | *Buttiauxella* sp. 3AFRM03 |
| SBP00142 (SBE00449) | Red prickly pear¬†-tuna roja | *Cedecea lapagei* |
| SBP00142 (SBE00449) | Red prickly pear¬†-tuna roja | *Cedecea neteri* |
| SBP00142 (SBE00449) | Red prickly pear¬†-tuna roja | *Chania multitudinisentens* |
| SBP00142 (SBE00449) | Red prickly pear¬†-tuna roja | *Citrobacter amalonaticus* |
| SBP00142 (SBE00449) | Red prickly pear¬†-tuna roja | *Citrobacter farmeri* |
| SBP00142 (SBE00449) | Red prickly pear¬†-tuna roja | *Citrobacter freundii* |
| SBP00142 (SBE00449) | Red prickly pear¬†-tuna roja | *Citrobacter freundii* complex sp. CFNIH2 |
| SBP00142 (SBE00449) | Red prickly pear¬†-tuna roja | *Citrobacter koseri* |
| SBP00142 (SBE00449) | Red prickly pear¬†-tuna roja | *Citrobacter pasteurii* |
| SBP00142 (SBE00449) | Red prickly pear¬†-tuna roja | *Citrobacter rodentium* |
| SBP00142 (SBE00449) | Red prickly pear¬†-tuna roja | *Citrobacter* sp. CFNIH10 |
| SBP00142 (SBE00449) | Red prickly pear¬†-tuna roja | *Citrobacter werkmanii* |
| SBP00142 (SBE00449) | Red prickly pear¬†-tuna roja | *Corynebacterium efficiens* |

TABLE 3-continued

List of species identified in each metagenomic sample of each SBP Sample

| SBP ID | SBP Host Common Name | Genus sp. |
|---|---|---|
| SBP00142 (SBE00449) | Red prickly pear¬†-tuna roja | *Cronobacter condimenti* |
| SBP00142 (SBE00449) | Red prickly pear¬†-tuna roja | *Cronobacter dublinensis* |
| SBP00142 (SBE00449) | Red prickly pear¬†-tuna roja | *Cronobacter malonaticus* |
| SBP00142 (SBE00449) | Red prickly pear¬†-tuna roja | *Cronobacter muytjensii* |
| SBP00142 (SBE00449) | Red prickly pear¬†-tuna roja | *Cronobacter sakazakii* |
| SBP00142 (SBE00449) | Red prickly pear¬†-tuna roja | *Cronobacter turicensis* |
| SBP00142 (SBE00449) | Red prickly pear¬†-tuna roja | *Cronobacter universalis* |
| SBP00142 (SBE00449) | Red prickly pear¬†-tuna roja | *Dickeya chrysanthemi* |
| SBP00142 (SBE00449) | Red prickly pear¬†-tuna roja | *Dickeya dadantii* |
| SBP00142 (SBE00449) | Red prickly pear¬†-tuna roja | *Dickeya dianthicola* |
| SBP00142 (SBE00449) | Red prickly pear¬†-tuna roja | *Dickeya fangzhongdai* |
| SBP00142 (SBE00449) | Red prickly pear¬†-tuna roja | *Dickeya paradisiaca* |
| SBP00142 (SBE00449) | Red prickly pear¬†-tuna roja | *Dickeya* sp. Secpp 1600 |
| SBP00142 (SBE00449) | Red prickly pear¬†-tuna roja | *Dickeya zeae* |
| SBP00142 (SBE00449) | Red prickly pear¬†-tuna roja | *Edwardsiella hoshinae* |
| SBP00142 (SBE00449) | Red prickly pear¬†-tuna roja | *Edwardsiella ictaluri* |
| SBP00142 (SBE00449) | Red prickly pear¬†-tuna roja | *Edwardsiella tarda* |
| SBP00142 (SBE00449) | Red prickly pear¬†-tuna roja | *Enterobacter asburiae* |
| SBP00142 (SBE00449) | Red prickly pear¬†-tuna roja | *Enterobacter bugandensis* |
| SBP00142 (SBE00449) | Red prickly pear¬†-tuna roja | *Enterobacter cancerogenus* |
| SBP00142 (SBE00449) | Red prickly pear¬†-tuna roja | *Enterobacter cloacae* |
| SBP00142 (SBE00449) | Red prickly pear¬†-tuna roja | *Enterobacter cloacae* complex sp. |
| SBP00142 (SBE00449) | Red prickly pear¬†-tuna roja | *Enterobacter cloacae* complex sp. ECNIH7 |
| SBP00142 (SBE00449) | Red prickly pear¬†-tuna roja | *Enterobacter cloacae* complex sp. FDA-CDC-AR_0164 |
| SBP00142 (SBE00449) | Red prickly pear¬†-tuna roja | *Enterobacter hormaechei* |
| SBP00142 (SBE00449) | Red prickly pear¬†-tuna roja | *Enterobacter kobei* |
| SBP00142 (SBE00449) | Red prickly pear¬†-tuna roja | *Enterobacter roggenkampii* |
| SBP00142 (SBE00449) | Red prickly pear¬†-tuna roja | *Enterobacter* sp. 638 |
| SBP00142 (SBE00449) | Red prickly pear¬†-tuna roja | *Enterobacter* sp. FY-07 |
| SBP00142 (SBE00449) | Red prickly pear¬†-tuna roja | *Enterobacter* sp. HK169 |
| SBP00142 (SBE00449) | Red prickly pear¬†-tuna roja | *Enterobacter* sp. N18-03635 |
| SBP00142 (SBE00449) | Red prickly pear¬†-tuna roja | *Enterobacter* sp. R4-368 |
| SBP00142 (SBE00449) | Red prickly pear¬†-tuna roja | *Enterobacter* sp. SA187 |
| SBP00142 (SBE00449) | Red prickly pear¬†-tuna roja | *Enterobacteriaceae bacterium* ENNIH1 |
| SBP00142 (SBE00449) | Red prickly pear¬†-tuna roja | *Enterobacteriaceae bacterium* ENNIH3 |
| SBP00142 (SBE00449) | Red prickly pear¬†-tuna roja | *Enterobacteriaceae bacterium* strain FGI 57 |
| SBP00142 (SBE00449) | Red prickly pear¬†-tuna roja | *Enterobacteriaceae bacterium* w17 |
| SBP00142 (SBE00449) | Red prickly pear¬†-tuna roja | *Enterobacteriaceae bacterium* w6 |
| SBP00142 (SBE00449) | Red prickly pear¬†-tuna roja | *Enterococcus gilvus* |
| SBP00142 (SBE00449) | Red prickly pear¬†-tuna roja | *Erwinia amylovora* |
| SBP00142 (SBE00449) | Red prickly pear¬†-tuna roja | *Erwinia billingiae* |
| SBP00142 (SBE00449) | Red prickly pear¬†-tuna roja | *Erwinia gerundensis* |
| SBP00142 (SBE00449) | Red prickly pear¬†-tuna roja | *Erwinia persicina* |
| SBP00142 (SBE00449) | Red prickly pear¬†-tuna roja | *Erwinia tasmaniensis* |
| SBP00142 (SBE00449) | Red prickly pear¬†-tuna roja | *Escherichia albertii* |
| SBP00142 (SBE00449) | Red prickly pear¬†-tuna roja | *Escherichia coli* |
| SBP00142 (SBE00449) | Red prickly pear¬†-tuna roja | *Escherichia fergusonii* |
| SBP00142 (SBE00449) | Red prickly pear¬†-tuna roja | *Gibbsiella quercinecans* |
| SBP00142 (SBE00449) | Red prickly pear¬†-tuna roja | *Hafnia alvei* |
| SBP00142 (SBE00449) | Red prickly pear¬†-tuna roja | *Hafnia paralvei* |
| SBP00142 (SBE00449) | Red prickly pear¬†-tuna roja | *Klebsiella aerogenes* |
| SBP00142 (SBE00449) | Red prickly pear¬†-tuna roja | *Klebsiella michiganensis* |
| SBP00142 (SBE00449) | Red prickly pear¬†-tuna roja | *Klebsiella oxytoca* |
| SBP00142 (SBE00449) | Red prickly pear¬†-tuna roja | *Klebsiella pneumoniae* |
| SBP00142 (SBE00449) | Red prickly pear¬†-tuna roja | *Klebsiella quasipneumoniae* |
| SBP00142 (SBE00449) | Red prickly pear¬†-tuna roja | *Klebsiella quasivariicola* |
| SBP00142 (SBE00449) | Red prickly pear¬†-tuna roja | *Klebsiella* sp. FDAARGOS_511 |
| SBP00142 (SBE00449) | Red prickly pear¬†-tuna roja | *Klebsiella* sp. LTGPAF-6F |
| SBP00142 (SBE00449) | Red prickly pear¬†-tuna roja | *Klebsiella* sp. LY |
| SBP00142 (SBE00449) | Red prickly pear¬†-tuna roja | *Klebsiella* sp. P1CD1 |
| SBP00142 (SBE00449) | Red prickly pear¬†-tuna roja | *Klebsiella variicola* |
| SBP00142 (SBE00449) | Red prickly pear¬†-tuna roja | *Kluyvera intermedia* |
| SBP00142 (SBE00449) | Red prickly pear¬†-tuna roja | *Kosakonia cowanii* |
| SBP00142 (SBE00449) | Red prickly pear¬†-tuna roja | *Kosakonia oryzae* |
| SBP00142 (SBE00449) | Red prickly pear¬†-tuna roja | *Kosakonia radicincitans* |
| SBP00142 (SBE00449) | Red prickly pear¬†-tuna roja | *Kosakonia sacchari* |
| SBP00142 (SBE00449) | Red prickly pear¬†-tuna roja | *Kosakonia* sp. CCTCC M2018092 |
| SBP00142 (SBE00449) | Red prickly pear¬†-tuna roja | *Lactobacillus casei* |
| SBP00142 (SBE00449) | Red prickly pear¬†-tuna roja | *Lactobacillus fermentum* |
| SBP00142 (SBE00449) | Red prickly pear¬†-tuna roja | *Lactobacillus kefiranofaciens* |
| SBP00142 (SBE00449) | Red prickly pear¬†-tuna roja | *Lactobacillus paracasei* |
| SBP00142 (SBE00449) | Red prickly pear¬†-tuna roja | *Lactobacillus phage* A2 |
| SBP00142 (SBE00449) | Red prickly pear¬†-tuna roja | *Lactobacillus phage* CL2 |
| SBP00142 (SBE00449) | Red prickly pear¬†-tuna roja | *Lactobacillus phage* Lc-Nu |
| SBP00142 (SBE00449) | Red prickly pear¬†-tuna roja | *Lactobacillus phage* Lrm1 |
| SBP00142 (SBE00449) | Red prickly pear¬†-tuna roja | *Lactobacillus plantarum* |

TABLE 3-continued

List of species identified in each metagenomic sample of each SBP Sample

| SBP ID | SBP Host Common Name | Genus sp. |
|---|---|---|
| SBP00142 (SBE00449) | Red prickly pear¬†-tuna roja | *Lactobacillus reuteri* |
| SBP00142 (SBE00449) | Red prickly pear¬†-tuna roja | *Lactobacillus rhamnosus* |
| SBP00142 (SBE00449) | Red prickly pear¬†-tuna roja | *Lactobacillus* sp. CBA3606 |
| SBP00142 (SBE00449) | Red prickly pear¬†-tuna roja | *Lactococcus lactis* |
| SBP00142 (SBE00449) | Red prickly pear¬†-tuna roja | *Leclercia adecarboxylata* |
| SBP00142 (SBE00449) | Red prickly pear¬†-tuna roja | *Leclercia* sp. LSNIH1 |
| SBP00142 (SBE00449) | Red prickly pear¬†-tuna roja | *Lelliottia amnigena* |
| SBP00142 (SBE00449) | Red prickly pear¬†-tuna roja | *Lelliottia jeotgali* |
| SBP00142 (SBE00449) | Red prickly pear¬†-tuna roja | *Lelliottia nimipressuralis* |
| SBP00142 (SBE00449) | Red prickly pear¬†-tuna roja | *Lelliottia* sp. WB101 |
| SBP00142 (SBE00449) | Red prickly pear¬†-tuna roja | *Leuconostoc carnosum* |
| SBP00142 (SBE00449) | Red prickly pear¬†-tuna roja | *Leuconostoc citreum* |
| SBP00142 (SBE00449) | Red prickly pear¬†-tuna roja | *Leuconostoc gelidum* |
| SBP00142 (SBE00449) | Red prickly pear¬†-tuna roja | *Leuconostoc mesenteroides* |
| SBP00142 (SBE00449) | Red prickly pear¬†-tuna roja | *Limnobaculum parvum* |
| SBP00142 (SBE00449) | Red prickly pear¬†-tuna roja | *Lonsdalea britannica* |
| SBP00142 (SBE00449) | Red prickly pear¬†-tuna roja | *Metakosakonia* sp. MRY16-398 |
| SBP00142 (SBE00449) | Red prickly pear¬†-tuna roja | *Mixta gaviniae* |
| SBP00142 (SBE00449) | Red prickly pear¬†-tuna roja | *Morganella morganii* |
| SBP00142 (SBE00449) | Red prickly pear¬†-tuna roja | *Obesumbacterium proteus* |
| SBP00142 (SBE00449) | Red prickly pear¬†-tuna roja | *Pantoea agglomerans* |
| SBP00142 (SBE00449) | Red prickly pear¬†-tuna roja | *Pantoea alhagi* |
| SBP00142 (SBE00449) | Red prickly pear¬†-tuna roja | *Pantoea ananatis* |
| SBP00142 (SBE00449) | Red prickly pear¬†-tuna roja | *Pantoea rwandensis* |
| SBP00142 (SBE00449) | Red prickly pear¬†-tuna roja | *Pantoea* sp. At-9b |
| SBP00142 (SBE00449) | Red prickly pear¬†-tuna roja | *Pantoea* sp. PSNIH1 |
| SBP00142 (SBE00449) | Red prickly pear¬†-tuna roja | *Pantoea stewartii* |
| SBP00142 (SBE00449) | Red prickly pear¬†-tuna roja | *Pantoea vagans* |
| SBP00142 (SBE00449) | Red prickly pear¬†-tuna roja | *Pectobacterium atrosepticum* |
| SBP00142 (SBE00449) | Red prickly pear¬†-tuna roja | *Pectobacterium carotovorum* |
| SBP00142 (SBE00449) | Red prickly pear¬†-tuna roja | *Pectobacterium parmentieri* |
| SBP00142 (SBE00449) | Red prickly pear¬†-tuna roja | *Pectobacterium polaris* |
| SBP00142 (SBE00449) | Red prickly pear¬†-tuna roja | *Pectobacterium wasabiae* |
| SBP00142 (SBE00449) | Red prickly pear¬†-tuna roja | *Pediococcus pentosaceus* |
| SBP00142 (SBE00449) | Red prickly pear¬†-tuna roja | *Photorhabdus asymbiotica* |
| SBP00142 (SBE00449) | Red prickly pear¬†-tuna roja | *Photorhabdus thracensis* |
| SBP00142 (SBE00449) | Red prickly pear¬†-tuna roja | *Phytobacter* sp. SCO41 |
| SBP00142 (SBE00449) | Red prickly pear¬†-tuna roja | *Phytobacter ursingii* |
| SBP00142 (SBE00449) | Red prickly pear¬†-tuna roja | *Plautia stali symbiont* |
| SBP00142 (SBE00449) | Red prickly pear¬†-tuna roja | *Plesiomonas shigelloides* |
| SBP00142 (SBE00449) | Red prickly pear¬†-tuna roja | *Pluralibacter gergoviae* |
| SBP00142 (SBE00449) | Red prickly pear¬†-tuna roja | *Pragia fontium* |
| SBP00142 (SBE00449) | Red prickly pear¬†-tuna roja | *Proteus mirabilis* |
| SBP00142 (SBE00449) | Red prickly pear¬†-tuna roja | *Pseudomonas entomophila* |
| SBP00142 (SBE00449) | Red prickly pear¬†-tuna roja | *Pseudomonas fluorescens* |
| SBP00142 (SBE00449) | Red prickly pear¬†-tuna roja | *Pseudomonas monteilii* |
| SBP00142 (SBE00449) | Red prickly pear¬†-tuna roja | *Pseudomonas putida* |
| SBP00142 (SBE00449) | Red prickly pear¬†-tuna roja | *Pseudomonas* sp. 09C 129 |
| SBP00142 (SBE00449) | Red prickly pear¬†-tuna roja | *Pseudomonas* sp. FGI182 |
| SBP00142 (SBE00449) | Red prickly pear¬†-tuna roja | *Pseudomonas* sp. JY-Q |
| SBP00142 (SBE00449) | Red prickly pear¬†-tuna roja | *Rahnella aquatilis* |
| SBP00142 (SBE00449) | Red prickly pear¬†-tuna roja | *Rahnella* sp. ERMR1:05 |
| SBP00142 (SBE00449) | Red prickly pear¬†-tuna roja | *Rahnella* sp. Y9602 |
| SBP00142 (SBE00449) | Red prickly pear¬†-tuna roja | *Raoultella ornithinolytica* |
| SBP00142 (SBE00449) | Red prickly pear¬†-tuna roja | *Raoultella planticola* |
| SBP00142 (SBE00449) | Red prickly pear¬†-tuna roja | *Saccharomonospora azurea* |
| SBP00142 (SBE00449) | Red prickly pear¬†-tuna roja | *Salmonella bongori* |
| SBP00142 (SBE00449) | Red prickly pear¬†-tuna roja | *Salmonella enterica* |
| SBP00142 (SBE00449) | Red prickly pear¬†-tuna roja | *Scardovia inopinata* |
| SBP00142 (SBE00449) | Red prickly pear¬†-tuna roja | *Serratia ficaria* |
| SBP00142 (SBE00449) | Red prickly pear¬†-tuna roja | *Serratia fonticola* |
| SBP00142 (SBE00449) | Red prickly pear¬†-tuna roja | *Serratia liquefaciens* |
| SBP00142 (SBE00449) | Red prickly pear¬†-tuna roja | *Serratia marcescens* |
| SBP00142 (SBE00449) | Red prickly pear¬†-tuna roja | *Serratia plymuthica* |
| SBP00142 (SBE00449) | Red prickly pear¬†-tuna roja | *Serratia proteamaculans* |
| SBP00142 (SBE00449) | Red prickly pear¬†-tuna roja | *Serratia quinivorans* |
| SBP00142 (SBE00449) | Red prickly pear¬†-tuna roja | *Serratia rubidaea* |
| SBP00142 (SBE00449) | Red prickly pear¬†-tuna roja | *Serratia* sp. 3ACOL1 |
| SBP00142 (SBE00449) | Red prickly pear¬†-tuna roja | *Serratia* sp. ATCC 39006 |
| SBP00142 (SBE00449) | Red prickly pear¬†-tuna roja | *Serratia* sp. FDAARGOS_506 |
| SBP00142 (SBE00449) | Red prickly pear¬†-tuna roja | *Serratia* sp. FGI94 |
| SBP00142 (SBE00449) | Red prickly pear¬†-tuna roja | *Serratia* sp. FS14 |
| SBP00142 (SBE00449) | Red prickly pear¬†-tuna roja | *Serratia* sp. JKS000199 |
| SBP00142 (SBE00449) | Red prickly pear¬†-tuna roja | *Serratia* sp. LS-1 |
| SBP00142 (SBE00449) | Red prickly pear¬†-tuna roja | *Serratia* sp. MYb239 |
| SBP00142 (SBE00449) | Red prickly pear¬†-tuna roja | *Serratia* sp. P2ACOL2 |

TABLE 3-continued

List of species identified in each metagenomic sample of each SBP Sample

| SBP ID | SBP Host Common Name | Genus sp. |
|---|---|---|
| SBP00142 (SBE00449) | Red prickly pear¬†-tuna roja | *Serratia* sp. SCBI |
| SBP00142 (SBE00449) | Red prickly pear¬†-tuna roja | *Serratia* sp. SSNIH1 |
| SBP00142 (SBE00449) | Red prickly pear¬†-tuna roja | *Serratia* sp. YD25 |
| SBP00142 (SBE00449) | Red prickly pear¬†-tuna roja | *Shimwellia blattae* |
| SBP00142 (SBE00449) | Red prickly pear¬†-tuna roja | *Sodalis glossinidius* |
| SBP00142 (SBE00449) | Red prickly pear¬†-tuna roja | *Sodalis praecaptivus* |
| SBP00142 (SBE00449) | Red prickly pear¬†-tuna roja | *Sporosarcina* sp. PTS2304 |
| SBP00142 (SBE00449) | Red prickly pear¬†-tuna roja | *Stenotrophomonas maltophilia* |
| SBP00142 (SBE00449) | Red prickly pear¬†-tuna roja | *Stenotrophomonas* sp. G4 |
| SBP00142 (SBE00449) | Red prickly pear¬†-tuna roja | *Stenotrophomonas* sp. LM091 |
| SBP00142 (SBE00449) | Red prickly pear¬†-tuna roja | *Stenotrophomonas* sp. Pemsol |
| SBP00142 (SBE00449) | Red prickly pear¬†-tuna roja | *Streptomyces* sp. ICC4 |
| SBP00142 (SBE00449) | Red prickly pear¬†-tuna roja | *Tatumella citrea* |
| SBP00142 (SBE00449) | Red prickly pear¬†-tuna roja | *Tatumella ptyseos* |
| SBP00142 (SBE00449) | Red prickly pear¬†-tuna roja | *Terribacillus goriensis* |
| SBP00142 (SBE00449) | Red prickly pear¬†-tuna roja | *Vibrio parahaemolyticus* |
| SBP00142 (SBE00449) | Red prickly pear¬†-tuna roja | *Weissella koreensis* |
| SBP00142 (SBE00449) | Red prickly pear¬†-tuna roja | *Yersinia aldovae* |
| SBP00142 (SBE00449) | Red prickly pear¬†-tuna roja | *Yersinia aleksiciae* |
| SBP00142 (SBE00449) | Red prickly pear¬†-tuna roja | *Yersinia enterocolitica* |
| SBP00142 (SBE00449) | Red prickly pear¬†-tuna roja | *Yersinia entomophaga* |
| SBP00142 (SBE00449) | Red prickly pear¬†-tuna roja | *Yersinia frederiksenii* |
| SBP00142 (SBE00449) | Red prickly pear¬†-tuna roja | *Yersinia kristensenii* |
| SBP00142 (SBE00449) | Red prickly pear¬†-tuna roja | *Yersinia pseudotuberculosis* |
| SBP00142 (SBE00449) | Red prickly pear¬†-tuna roja | *Yersinia rohdei* |
| SBP00142 (SBE00449) | Red prickly pear¬†-tuna roja | *Yersinia ruckeri* |
| SBP00142 (SBE00449) | Red prickly pear¬†-tuna roja | *Yersinia similis* |
| SBP00163 | Fermented Carrot/cabbage | [*Enterobacter*] *lignolyticus* |
| SBP00163 | Fermented Carrot/cabbage | [*Polyangium*] *brachysporum* |
| SBP00163 | Fermented Carrot/cabbage | *Achromobacter denitrificans* |
| SBP00163 | Fermented Carrot/cabbage | *Achromobacter insolitus* |
| SBP00163 | Fermented Carrot/cabbage | *Achromobacter* sp. AONIH1 |
| SBP00163 | Fermented Carrot/cabbage | *Achromobacter* sp. B7 |
| SBP00163 | Fermented Carrot/cabbage | *Achromobacter* sp. MFA1 R4 |
| SBP00163 | Fermented Carrot/cabbage | *Achromobacter spanius* |
| SBP00163 | Fermented Carrot/cabbage | *Achromobacter xylosoxidans* |
| SBP00163 | Fermented Carrot/cabbage | *Acidaminococcus fermentans* |
| SBP00163 | Fermented Carrot/cabbage | *Acidiphilium multivorum* |
| SBP00163 | Fermented Carrot/cabbage | *Acidovorax avenae* |
| SBP00163 | Fermented Carrot/cabbage | *Acidovorax* sp. 1608163 |
| SBP00163 | Fermented Carrot/cabbage | *Acidovorax* sp. JS42 |
| SBP00163 | Fermented Carrot/cabbage | *Acidovorax* sp. KKS102 |
| SBP00163 | Fermented Carrot/cabbage | *Acidovorax* sp. RAC01 |
| SBP00163 | Fermented Carrot/cabbage | *Acidovorax* sp. T1 |
| SBP00163 | Fermented Carrot/cabbage | *Acinetobacter baumannii* |
| SBP00163 | Fermented Carrot/cabbage | *Acinetobacter calcoaceticus* |
| SBP00163 | Fermented Carrot/cabbage | *Acinetobacter guillouiae* |
| SBP00163 | Fermented Carrot/cabbage | *Acinetobacter johnsonii* |
| SBP00163 | Fermented Carrot/cabbage | *Acinetobacter oleivorans* |
| SBP00163 | Fermented Carrot/cabbage | *Acinetobacter pittii* |
| SBP00163 | Fermented Carrot/cabbage | *Acinetobacter* sp. ACNIH1 |
| SBP00163 | Fermented Carrot/cabbage | *Acinetobacter ursingli* |
| SBP00163 | Fermented Carrot/cabbage | *Actinobacillus succinogenes* |
| SBP00163 | Fermented Carrot/cabbage | *Actinobacteria bacterium* IMCC19121 |
| SBP00163 | Fermented Carrot/cabbage | *Actinomadura amylolytica* |
| SBP00163 | Fermented Carrot/cabbage | *Actinomyces radicidentis* |
| SBP00163 | Fermented Carrot/cabbage | *Actinoplanes* sp. ATCC 31351 |
| SBP00163 | Fermented Carrot/cabbage | *Actinoplanes* sp. N902-109 |
| SBP00163 | Fermented Carrot/cabbage | *Advenella kashmirensis* |
| SBP00163 | Fermented Carrot/cabbage | *Advenella mimigardefordensis* |
| SBP00163 | Fermented Carrot/cabbage | *Aerococcus urinaeequi* |
| SBP00163 | Fermented Carrot/cabbage | *Aerococcus viridans* |
| SBP00163 | Fermented Carrot/cabbage | *Aeromicrobium erythreum* |
| SBP00163 | Fermented Carrot/cabbage | *Aeromonas caviae* |
| SBP00163 | Fermented Carrot/cabbage | *Aeromonas encheleia* |
| SBP00163 | Fermented Carrot/cabbage | *Aeromonas hydrophila* |
| SBP00163 | Fermented Carrot/cabbage | *Aeromonas media* |
| SBP00163 | Fermented Carrot/cabbage | *Aeromonas salmonicida* |
| SBP00163 | Fermented Carrot/cabbage | *Aeromonas schubertii* |
| SBP00163 | Fermented Carrot/cabbage | *Aeromonas* sp. |
| SBP00163 | Fermented Carrot/cabbage | *Aeromonas* sp. ASNIH4 |
| SBP00163 | Fermented Carrot/cabbage | *Aeromonas* sp. CUS |
| SBP00163 | Fermented Carrot/cabbage | *Aeromonas veronii* |
| SBP00163 | Fermented Carrot/cabbage | *Afipia* sp. GAS231 |
| SBP00163 | Fermented Carrot/cabbage | *Agarivorans gilvus* |
| SBP00163 | Fermented Carrot/cabbage | *Agrobacterium fabrum* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Agrobacterium larrymoarei* |
| SBP00163 | Fermented Carrot/cabbage | *Agrobacterium rhizogenes* |
| SBP00163 | Fermented Carrot/cabbage | *Agrobacterium* sp. |
| SBP00163 | Fermented Carrot/cabbage | *Agrobacterium* sp. 33MFTa1.1 |
| SBP00163 | Fermented Carrot/cabbage | *Agrobacterium* sp. H13-3 |
| SBP00163 | Fermented Carrot/cabbage | *Agrobacterium* sp. RAC06 |
| SBP00163 | Fermented Carrot/cabbage | *Agrobacterium tumefaciens* |
| SBP00163 | Fermented Carrot/cabbage | *Agrobacterium vitis* |
| SBP00163 | Fermented Carrot/cabbage | *Alcaligenes aquatilis* |
| SBP00163 | Fermented Carrot/cabbage | *Alcaligenes faecalis* |
| SBP00163 | Fermented Carrot/cabbage | *Alcanivorax pacificus* |
| SBP00163 | Fermented Carrot/cabbage | *Alcanivorax* sp. N3-2A |
| SBP00163 | Fermented Carrot/cabbage | *Alcanivorax xenomutans* |
| SBP00163 | Fermented Carrot/cabbage | *Alicycliphilus denitrificans* |
| SBP00163 | Fermented Carrot/cabbage | *Aliivibrio salmonicida* |
| SBP00163 | Fermented Carrot/cabbage | *Alteromonas* sp. RKMC-009 |
| SBP00163 | Fermented Carrot/cabbage | *Antarctobacter heliothermus* |
| SBP00163 | Fermented Carrot/cabbage | *Aquabacterium olei* |
| SBP00163 | Fermented Carrot/cabbage | *Aquaspirillum* sp. LM1 |
| SBP00163 | Fermented Carrot/cabbage | *Aquitalea magnusonii* |
| SBP00163 | Fermented Carrot/cabbage | *Aquitalea* sp. THG-DN7.12 |
| SBP00163 | Fermented Carrot/cabbage | *Aquitalea* sp. USM4 |
| SBP00163 | Fermented Carrot/cabbage | *Arthrobacter alpinus* |
| SBP00163 | Fermented Carrot/cabbage | *Asticcacaulis excentricus* |
| SBP00163 | Fermented Carrot/cabbage | *Atlantibacter hermannii* |
| SBP00163 | Fermented Carrot/cabbage | *Aureimonas* sp. AU20 |
| SBP00163 | Fermented Carrot/cabbage | *Azoarcus* sp. CIB |
| SBP00163 | Fermented Carrot/cabbage | *Azospira oryzae* |
| SBP00163 | Fermented Carrot/cabbage | *Azospirillum brasilense* |
| SBP00163 | Fermented Carrot/cabbage | *Azospirillum humicireducens* |
| SBP00163 | Fermented Carrot/cabbage | *Azospirillum lipoferum* |
| SBP00163 | Fermented Carrot/cabbage | *Azospirillum* sp. TSA2s |
| SBP00163 | Fermented Carrot/cabbage | *Azospirillum* sp. TSH100 |
| SBP00163 | Fermented Carrot/cabbage | *Azospirillum thiophilum* |
| SBP00163 | Fermented Carrot/cabbage | *Azotobacter chroococcum* |
| SBP00163 | Fermented Carrot/cabbage | *Azotobacter vinelandii* |
| SBP00163 | Fermented Carrot/cabbage | *Bacillus altitudinis* |
| SBP00163 | Fermented Carrot/cabbage | *Bacillus amyloliquefaciens* |
| SBP00163 | Fermented Carrot/cabbage | *Bacillus cereus* |
| SBP00163 | Fermented Carrot/cabbage | *Bacillus megaterium* |
| SBP00163 | Fermented Carrot/cabbage | *Bacillus paralicheniformis* |
| SBP00163 | Fermented Carrot/cabbage | *Bacillus pseudomycoides* |
| SBP00163 | Fermented Carrot/cabbage | *Bacillus safensis* |
| SBP00163 | Fermented Carrot/cabbage | *Bacillus* sp. (in: Bacteria) |
| SBP00163 | Fermented Carrot/cabbage | *Bacillus subtilis* |
| SBP00163 | Fermented Carrot/cabbage | *Bacillus velezensis* |
| SBP00163 | Fermented Carrot/cabbage | *Bacteroides fragilis* |
| SBP00163 | Fermented Carrot/cabbage | *Bacteroides uniformis* |
| SBP00163 | Fermented Carrot/cabbage | *Blastococcus saxobsidens* |
| SBP00163 | Fermented Carrot/cabbage | *Blautia* sp. SC05B48 |
| SBP00163 | Fermented Carrot/cabbage | *Bordetella bronchialis* |
| SBP00163 | Fermented Carrot/cabbage | *Bordetella bronchiseptica* |
| SBP00163 | Fermented Carrot/cabbage | *Bordetella* genomosp. 13 |
| SBP00163 | Fermented Carrot/cabbage | *Bordetella* genomosp. 9 |
| SBP00163 | Fermented Carrot/cabbage | *Bordetella petrii* |
| SBP00163 | Fermented Carrot/cabbage | *Bordetella pseudohinzii* |
| SBP00163 | Fermented Carrot/cabbage | *Bordetella* sp. H567 |
| SBP00163 | Fermented Carrot/cabbage | *Bordetella* sp. N |
| SBP00163 | Fermented Carrot/cabbage | *Bosea* sp. Tri-49 |
| SBP00163 | Fermented Carrot/cabbage | *Bosea vaviloviae* |
| SBP00163 | Fermented Carrot/cabbage | *Bradyrhizobium diazoefficiens* |
| SBP00163 | Fermented Carrot/cabbage | *Bradyrhizobium erythrophlei* |
| SBP00163 | Fermented Carrot/cabbage | *Bradyrhizobium guangxiense* |
| SBP00163 | Fermented Carrot/cabbage | *Bradyrhizobium icense* |
| SBP00163 | Fermented Carrot/cabbage | *Bradyrhizobium japonicum* |
| SBP00163 | Fermented Carrot/cabbage | *Bradyrhizobium ottawaense* |
| SBP00163 | Fermented Carrot/cabbage | *Bradyrhizobium* sp. 2 39S1MB |
| SBP00163 | Fermented Carrot/cabbage | *Bradyrhizobium* sp. BTAi1 |
| SBP00163 | Fermented Carrot/cabbage | *Bradyrhizobium* sp. CCBAU 51670 |
| SBP00163 | Fermented Carrot/cabbage | *Bradyrhizobium* sp. CCBAU 51778 |
| SBP00163 | Fermented Carrot/cabbage | *Bradyrhizobium* sp. ORS 278 |
| SBP00163 | Fermented Carrot/cabbage | *Bradyrhizobium* sp. ORS 3257 |
| SBP00163 | Fermented Carrot/cabbage | *Bradyrhizobium* sp. S23321 |
| SBP00163 | Fermented Carrot/cabbage | *Bradyrhizobium* sp. SK17 |
| SBP00163 | Fermented Carrot/cabbage | *Brassica napus* |
| SBP00163 | Fermented Carrot/cabbage | *Brenneria goodwinii* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Brenneria rubrifaciens* |
| SBP00163 | Fermented Carrot/cabbage | *Brevundimonas naejangsanensis* |
| SBP00163 | Fermented Carrot/cabbage | *Brevundimonas* sp. DS20 |
| SBP00163 | Fermented Carrot/cabbage | *Burkholderia ambifaria* |
| SBP00163 | Fermented Carrot/cabbage | *Burkholderia cenocepacia* |
| SBP00163 | Fermented Carrot/cabbage | *Burkholderia cepacia* |
| SBP00163 | Fermented Carrot/cabbage | *Burkholderia gladioli* |
| SBP00163 | Fermented Carrot/cabbage | *Burkholderia insecticola* |
| SBP00163 | Fermented Carrot/cabbage | *Burkholderia multivorans* |
| SBP00163 | Fermented Carrot/cabbage | *Burkholderia plantarii* |
| SBP00163 | Fermented Carrot/cabbage | *Burkholderia* sp. CCGE1002 |
| SBP00163 | Fermented Carrot/cabbage | *Burkholderia* sp. OLGA172 |
| SBP00163 | Fermented Carrot/cabbage | *Burkholderia stabilis* |
| SBP00163 | Fermented Carrot/cabbage | *Burkholderia thailandensis* |
| SBP00163 | Fermented Carrot/cabbage | *Burkholderia ubonensis* |
| SBP00163 | Fermented Carrot/cabbage | *Burkholderiales bacterium* GJ-E10 |
| SBP00163 | Fermented Carrot/cabbage | *Buttiauxella* sp. 3AFRM03 |
| SBP00163 | Fermented Carrot/cabbage | *Candidatus Doolittlea endobia* |
| SBP00163 | Fermented Carrot/cabbage | *Candidatus Fukatsuia symbiotica* |
| SBP00163 | Fermented Carrot/cabbage | *Candidatus Gullanella endobia* |
| SBP00163 | Fermented Carrot/cabbage | *Candidatus Hamiltonella defensa* |
| SBP00163 | Fermented Carrot/cabbage | *Candidatus Ishikawaella capsulata* |
| SBP00163 | Fermented Carrot/cabbage | *Candidatus Moranella endobia* |
| SBP00163 | Fermented Carrot/cabbage | *Candidatus Sodalis pierantonius* |
| SBP00163 | Fermented Carrot/cabbage | *Castellaniella defragrans* |
| SBP00163 | Fermented Carrot/cabbage | *Cedecea lapagei* |
| SBP00163 | Fermented Carrot/cabbage | *Cedecea neteri* |
| SBP00163 | Fermented Carrot/cabbage | *Cellvibrio japonicus* |
| SBP00163 | Fermented Carrot/cabbage | *Cellvibrio* sp. PSBB006 |
| SBP00163 | Fermented Carrot/cabbage | *Chania multitudinisentens* |
| SBP00163 | Fermented Carrot/cabbage | *Chelativorans* sp. BNC1 |
| SBP00163 | Fermented Carrot/cabbage | *Chromobacterium rhizoryzae* |
| SBP00163 | Fermented Carrot/cabbage | *Chromobacterium* sp. ATCC 53434 |
| SBP00163 | Fermented Carrot/cabbage | *Chromohalobacter salexigens* |
| SBP00163 | Fermented Carrot/cabbage | *Chryseobacterium bernardetii* |
| SBP00163 | Fermented Carrot/cabbage | *Chryseobacterium indoltheticum* |
| SBP00163 | Fermented Carrot/cabbage | *Chryseobacterium* sp. H6466 |
| SBP00163 | Fermented Carrot/cabbage | *Citrobacter amalonaticus* |
| SBP00163 | Fermented Carrot/cabbage | *Citrobacter braakii* |
| SBP00163 | Fermented Carrot/cabbage | *Citrobacter farmeri* |
| SBP00163 | Fermented Carrot/cabbage | *Citrobacter freundii* |
| SBP00163 | Fermented Carrot/cabbage | *Citrobacter freundii* complex sp. CFNIH2 |
| SBP00163 | Fermented Carrot/cabbage | *Citrobacter freundii* complex sp. CFNIH3 |
| SBP00163 | Fermented Carrot/cabbage | *Citrobacter freundii* complex sp. CFNIH4 |
| SBP00163 | Fermented Carrot/cabbage | *Citrobacter freundii* complex sp. CFNIH9 |
| SBP00163 | Fermented Carrot/cabbage | *Citrobacter koseri* |
| SBP00163 | Fermented Carrot/cabbage | *Citrobacter pasteurii* |
| SBP00163 | Fermented Carrot/cabbage | *Citrobacter portucalensis* |
| SBP00163 | Fermented Carrot/cabbage | *Citrobacter rodentium* |
| SBP00163 | Fermented Carrot/cabbage | *Citrobacter* sp. 92 |
| SBP00163 | Fermented Carrot/cabbage | *Citrobacter* sp. CFNIH10 |
| SBP00163 | Fermented Carrot/cabbage | *Citrobacter* sp. CRE-46 |
| SBP00163 | Fermented Carrot/cabbage | *Citrobacter* sp. FDAARGOS_156 |
| SBP00163 | Fermented Carrot/cabbage | *Citrobacter werkmanii* |
| SBP00163 | Fermented Carrot/cabbage | *Citrobacter youngae* |
| SBP00163 | Fermented Carrot/cabbage | *Clavibacter michiganensis* |
| SBP00163 | Fermented Carrot/cabbage | *Clostridium baratii* |
| SBP00163 | Fermented Carrot/cabbage | *Clostridium botulinum* |
| SBP00163 | Fermented Carrot/cabbage | *Clostridium saccharoperbutylacetonicum* |
| SBP00163 | Fermented Carrot/cabbage | *Collimonas arenae* |
| SBP00163 | Fermented Carrot/cabbage | *Collimonas fungivorans* |
| SBP00163 | Fermented Carrot/cabbage | *Collimonas pratensis* |
| SBP00163 | Fermented Carrot/cabbage | *Comamonas kerstersii* |
| SBP00163 | Fermented Carrot/cabbage | *Comamonas terrigena* |
| SBP00163 | Fermented Carrot/cabbage | *Comamonas testosteroni* |
| SBP00163 | Fermented Carrot/cabbage | *Conexibacter woesei* |
| SBP00163 | Fermented Carrot/cabbage | *Corynebacterium glutamicum* |
| SBP00163 | Fermented Carrot/cabbage | *Corynebacterium jeikeium* |
| SBP00163 | Fermented Carrot/cabbage | *Coxiella* endosymbiont of *Amblyomma americanum* |
| SBP00163 | Fermented Carrot/cabbage | *Cronobacter condimenti* |
| SBP00163 | Fermented Carrot/cabbage | *Cronobacter dublinensis* |
| SBP00163 | Fermented Carrot/cabbage | *Cronobacter malonaticus* |
| SBP00163 | Fermented Carrot/cabbage | *Cronobacter muytjensii* |
| SBP00163 | Fermented Carrot/cabbage | *Cronobacter sakazakii* |
| SBP00163 | Fermented Carrot/cabbage | *Cronobacter turicensis* |
| SBP00163 | Fermented Carrot/cabbage | *Cronobacter universalis* |

TABLE 3-continued

List of species identified in each metagenomic sample of each SBP Sample

| SBP ID | SBP Host Common Name | Genus sp. |
| --- | --- | --- |
| SBP00163 | Fermented Carrot/cabbage | *Cryobacterium* sp. LW097 |
| SBP00163 | Fermented Carrot/cabbage | *Cupriavidus basilensis* |
| SBP00163 | Fermented Carrot/cabbage | *Cupriavidus gilardii* |
| SBP00163 | Fermented Carrot/cabbage | *Cupriavidus metallidurans* |
| SBP00163 | Fermented Carrot/cabbage | *Cupriavidus necator* |
| SBP00163 | Fermented Carrot/cabbage | *Cupriavidus oxalaticus* |
| SBP00163 | Fermented Carrot/cabbage | *Cupriavidus pauculus* |
| SBP00163 | Fermented Carrot/cabbage | *Cupriavidus pinatubonensis* |
| SBP00163 | Fermented Carrot/cabbage | *Cupriavidus taiwanensis* |
| SBP00163 | Fermented Carrot/cabbage | *Curtobacterium pusillum* |
| SBP00163 | Fermented Carrot/cabbage | *Curtobacterium* sp. BH-2-1-1 |
| SBP00163 | Fermented Carrot/cabbage | *Curtobacterium* sp. MR_MD2014 |
| SBP00163 | Fermented Carrot/cabbage | *Curtobacterium* sp. SGAir0471 |
| SBP00163 | Fermented Carrot/cabbage | *Curvibacter* sp. AEP1-3 |
| SBP00163 | Fermented Carrot/cabbage | *Cutibacterium acnes* |
| SBP00163 | Fermented Carrot/cabbage | *Cystobacter fuscus* |
| SBP00163 | Fermented Carrot/cabbage | *Defluviimonas alba* |
| SBP00163 | Fermented Carrot/cabbage | *Deinococcus wulumuqiensis* |
| SBP00163 | Fermented Carrot/cabbage | *Delftia acidovorans* |
| SBP00163 | Fermented Carrot/cabbage | *Delftia* sp. |
| SBP00163 | Fermented Carrot/cabbage | *Delftia tsuruhatensis* |
| SBP00163 | Fermented Carrot/cabbage | *Desulfotalea psychrophila* |
| SBP00163 | Fermented Carrot/cabbage | *Desulfovibrio carbinolicus* |
| SBP00163 | Fermented Carrot/cabbage | *Desulfovibrio gigas* |
| SBP00163 | Fermented Carrot/cabbage | *Desulfovibrio vulgaris* |
| SBP00163 | Fermented Carrot/cabbage | *Devosia* sp. 1566 |
| SBP00163 | Fermented Carrot/cabbage | *Devosia* sp. A16 |
| SBP00163 | Fermented Carrot/cabbage | *Devosia* sp. HS989 |
| SBP00163 | Fermented Carrot/cabbage | *Devosia* sp. I507 |
| SBP00163 | Fermented Carrot/cabbage | *Dickeya chrysanthemi* |
| SBP00163 | Fermented Carrot/cabbage | *Dickeya dadantii* |
| SBP00163 | Fermented Carrot/cabbage | *Dickeya dianthicola* |
| SBP00163 | Fermented Carrot/cabbage | *Dickeya fangzhongdai* |
| SBP00163 | Fermented Carrot/cabbage | *Dickeya paradisiaca* |
| SBP00163 | Fermented Carrot/cabbage | *Dickeya solani* |
| SBP00163 | Fermented Carrot/cabbage | *Dickeya* sp. NCPPB 3274 |
| SBP00163 | Fermented Carrot/cabbage | *Dickeya* sp. NCPPB 569 |
| SBP00163 | Fermented Carrot/cabbage | *Dickeya* sp. Secpp 1600 |
| SBP00163 | Fermented Carrot/cabbage | *Dickeya zeae* |
| SBP00163 | Fermented Carrot/cabbage | *Diptera* sp. BOLD: AAB3286 |
| SBP00163 | Fermented Carrot/cabbage | *Dokdonella koreensis* |
| SBP00163 | Fermented Carrot/cabbage | *Dyella thiooxydans* |
| SBP00163 | Fermented Carrot/cabbage | *Edwardsiella hoshinae* |
| SBP00163 | Fermented Carrot/cabbage | *Edwardsiella ictaluri* |
| SBP00163 | Fermented Carrot/cabbage | *Edwardsiella piscicida* |
| SBP00163 | Fermented Carrot/cabbage | *Edwardsiella* sp. EA181011 |
| SBP00163 | Fermented Carrot/cabbage | *Edwardsiella tarda* |
| SBP00163 | Fermented Carrot/cabbage | *Ensifer adhaerens* |
| SBP00163 | Fermented Carrot/cabbage | *Enterobacter asburiae* |
| SBP00163 | Fermented Carrot/cabbage | *Enterobacter bugandensis* |
| SBP00163 | Fermented Carrot/cabbage | *Enterobacter cancerogenus* |
| SBP00163 | Fermented Carrot/cabbage | *Enterobacter cloacae* |
| SBP00163 | Fermented Carrot/cabbage | *Enterobacter cloacae* complex sp. |
| SBP00163 | Fermented Carrot/cabbage | *Enterobacter cloacae* complex sp. ECNIH7 |
| SBP00163 | Fermented Carrot/cabbage | *Enterobacter cloacae* complex sp. FDA-CDC-AR_0132 |
| SBP00163 | Fermented Carrot/cabbage | *Enterobacter cloacae* complex sp. FDA-CDC-AR_0164 |
| SBP00163 | Fermented Carrot/cabbage | *Enterobacter hormaechei* |
| SBP00163 | Fermented Carrot/cabbage | *Enterobacter kobei* |
| SBP00163 | Fermented Carrot/cabbage | *Enterobacter ludwigii* |
| SBP00163 | Fermented Carrot/cabbage | *Enterobacter roggenkampii* |
| SBP00163 | Fermented Carrot/cabbage | *Enterobacter soli* |
| SBP00163 | Fermented Carrot/cabbage | *Enterobacter* sp. 638 |
| SBP00163 | Fermented Carrot/cabbage | *Enterobacter* sp. Crenshaw |
| SBP00163 | Fermented Carrot/cabbage | *Enterobacter* sp. CRENT-193 |
| SBP00163 | Fermented Carrot/cabbage | *Enterobacter* sp. DKU_NT_01 |
| SBP00163 | Fermented Carrot/cabbage | *Enterobacter* sp. E20 |
| SBP00163 | Fermented Carrot/cabbage | *Enterobacter* sp. FY-07 |
| SBP00163 | Fermented Carrot/cabbage | *Enterobacter* sp. HK169 |
| SBP00163 | Fermented Carrot/cabbage | *Enterobacter* sp. N18-03635 |
| SBP00163 | Fermented Carrot/cabbage | *Enterobacter* sp. ODB01 |
| SBP00163 | Fermented Carrot/cabbage | *Enterobacter* sp. R4-368 |
| SBP00163 | Fermented Carrot/cabbage | *Enterobacter* sp. SA187 |
| SBP00163 | Fermented Carrot/cabbage | *Enterobacteriaceae bacterium* ENNIH1 |
| SBP00163 | Fermented Carrot/cabbage | *Enterobacteriaceae bacterium* ENNIH2 |
| SBP00163 | Fermented Carrot/cabbage | *Enterobacteriaceae bacterium* strain FGI 57 |
| SBP00163 | Fermented Carrot/cabbage | *Enterobacteriaceae bacterium* w17 |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Enterobacteriaceae bacterium* w6 |
| SBP00163 | Fermented Carrot/cabbage | *Enterococcus durans* |
| SBP00163 | Fermented Carrot/cabbage | *Enterococcus faecium* |
| SBP00163 | Fermented Carrot/cabbage | *Ereboglobus luteus* |
| SBP00163 | Fermented Carrot/cabbage | *Erwinia amylovora* |
| SBP00163 | Fermented Carrot/cabbage | *Erwinia billingiae* |
| SBP00163 | Fermented Carrot/cabbage | *Erwinia gerundensis* |
| SBP00163 | Fermented Carrot/cabbage | *Erwinia persicina* |
| SBP00163 | Fermented Carrot/cabbage | *Erwinia pyrifoliae* |
| SBP00163 | Fermented Carrot/cabbage | *Erwinia* sp. |
| SBP00163 | Fermented Carrot/cabbage | *Erwinia* sp. Ejp617 |
| SBP00163 | Fermented Carrot/cabbage | *Erwinia tasmaniensis* |
| SBP00163 | Fermented Carrot/cabbage | *Erythrobacter flavus* |
| SBP00163 | Fermented Carrot/cabbage | *Escherichia albertii* |
| SBP00163 | Fermented Carrot/cabbage | *Escherichia coli* |
| SBP00163 | Fermented Carrot/cabbage | *Escherichia fergusonii* |
| SBP00163 | Fermented Carrot/cabbage | *Escherichia phage* HK639 |
| SBP00163 | Fermented Carrot/cabbage | *Escherichia* sp. E4742 |
| SBP00163 | Fermented Carrot/cabbage | *Escherichia* virus If1 |
| SBP00163 | Fermented Carrot/cabbage | *Faecalibacterium prausnitzii* |
| SBP00163 | Fermented Carrot/cabbage | *Ferrimonas balearica* |
| SBP00163 | Fermented Carrot/cabbage | *Flavisolibacter* sp. 17J28-1 |
| SBP00163 | Fermented Carrot/cabbage | *Flavobacterium johnsoniae* |
| SBP00163 | Fermented Carrot/cabbage | *Flavobacterium* sp. HYN0086 |
| SBP00163 | Fermented Carrot/cabbage | *Flavonifractor plautii* |
| SBP00163 | Fermented Carrot/cabbage | *Frankia* sp. EAN1pec |
| SBP00163 | Fermented Carrot/cabbage | *Gallaecimonas* sp. HK-28 |
| SBP00163 | Fermented Carrot/cabbage | *Gammaproteobacteria bacterium* DM2 |
| SBP00163 | Fermented Carrot/cabbage | *Gardnerella vaginalis* |
| SBP00163 | Fermented Carrot/cabbage | *Gemmata obscuriglobus* |
| SBP00163 | Fermented Carrot/cabbage | *Gemmobacter* sp. HYN0069 |
| SBP00163 | Fermented Carrot/cabbage | *Geobacillus thermodenitrificans* |
| SBP00163 | Fermented Carrot/cabbage | *Geabacter metallireducens* |
| SBP00163 | Fermented Carrot/cabbage | *Geodermatophilus obscurus* |
| SBP00163 | Fermented Carrot/cabbage | *Gibbsiella quercinecans* |
| SBP00163 | Fermented Carrot/cabbage | *Glaesserella* sp. 15-184 |
| SBP00163 | Fermented Carrot/cabbage | *Gluconobacter oxydans* |
| SBP00163 | Fermented Carrot/cabbage | *Glutamicibacter creatinolyticus* |
| SBP00163 | Fermented Carrot/cabbage | *Glutamicibacter halophytocola* |
| SBP00163 | Fermented Carrot/cabbage | *Glutamicibacter nicotianae* |
| SBP00163 | Fermented Carrot/cabbage | *Gordonia* sp. KTR9 |
| SBP00163 | Fermented Carrot/cabbage | *Grimontia hollisae* |
| SBP00163 | Fermented Carrot/cabbage | *Gynuella sunshinyii* |
| SBP00163 | Fermented Carrot/cabbage | *Haemophilus parainfluenzae* |
| SBP00163 | Fermented Carrot/cabbage | *Hafnia alvei* |
| SBP00163 | Fermented Carrot/cabbage | *Hafnia paralvei* |
| SBP00163 | Fermented Carrot/cabbage | *Hafnia* sp. CBA7124 |
| SBP00163 | Fermented Carrot/cabbage | *Hahella chejuensis* |
| SBP00163 | Fermented Carrot/cabbage | *Haliangium ochraceum* |
| SBP00163 | Fermented Carrot/cabbage | *Halomonas aestuarii* |
| SBP00163 | Fermented Carrot/cabbage | *Halomonas chromatireducens* |
| SBP00163 | Fermented Carrot/cabbage | *Halomonas hydrothermalis* |
| SBP00163 | Fermented Carrot/cabbage | *Halomonas* sp. hl-4 |
| SBP00163 | Fermented Carrot/cabbage | *Halomonas subglaciescola* |
| SBP00163 | Fermented Carrot/cabbage | *Halopiger xanaduensis* |
| SBP00163 | Fermented Carrot/cabbage | *Halorhabdus tiamatea* |
| SBP00163 | Fermented Carrot/cabbage | *Halotalea alkalilenta* |
| SBP00163 | Fermented Carrot/cabbage | *Herbaspirillum hiltneri* |
| SBP00163 | Fermented Carrot/cabbage | *Herbaspirillum huttiense* |
| SBP00163 | Fermented Carrot/cabbage | *Herbaspirillum robiniae* |
| SBP00163 | Fermented Carrot/cabbage | *Herbaspirillum rubrisubalbicans* |
| SBP00163 | Fermented Carrot/cabbage | *Herbaspirillum seropedicae* |
| SBP00163 | Fermented Carrot/cabbage | *Herbaspirillum* sp. meg3 |
| SBP00163 | Fermented Carrot/cabbage | *Herminiimonas arsenicoxydans* |
| SBP00163 | Fermented Carrot/cabbage | *Hydrogenophaga* sp. NH-16 |
| SBP00163 | Fermented Carrot/cabbage | *Hydrogenophaga* sp. PBC |
| SBP00163 | Fermented Carrot/cabbage | *Hydromonas* sp. F02 |
| SBP00163 | Fermented Carrot/cabbage | *Hymenobacter nivis* |
| SBP00163 | Fermented Carrot/cabbage | *Immundisolibacter cernigliae* |
| SBP00163 | Fermented Carrot/cabbage | *Indioceanicola profundi* |
| SBP00163 | Fermented Carrot/cabbage | *Janthinobacterium agaricidamnosum* |
| SBP00163 | Fermented Carrot/cabbage | *Janthinobacterium* sp. 1_2014MBL_MicDiv |
| SBP00163 | Fermented Carrot/cabbage | *Janthinobacterium* sp. 17J80-10 |
| SBP00163 | Fermented Carrot/cabbage | *Janthinobacterium* sp. LM6 |
| SBP00163 | Fermented Carrot/cabbage | *Janthinobacterium* sp. Marseille |
| SBP00163 | Fermented Carrot/cabbage | *Janthinobacterium svalbardensis* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Jiangella alkaliphila* |
| SBP00163 | Fermented Carrot/cabbage | *Jiangella* sp. DSM 45060 |
| SBP00163 | Fermented Carrot/cabbage | *Kangiella koreensis* |
| SBP00163 | Fermented Carrot/cabbage | *Ketogulonicigenium vulgare* |
| SBP00163 | Fermented Carrot/cabbage | *Klebsiella aerogenes* |
| SBP00163 | Fermented Carrot/cabbage | *Klebsiella michiganensis* |
| SBP00163 | Fermented Carrot/cabbage | *Klebsiella oxytoca* |
| SBP00163 | Fermented Carrot/cabbage | *Klebsiella pneumoniae* |
| SBP00163 | Fermented Carrot/cabbage | *Klebsiella quasipneumoniae* |
| SBP00163 | Fermented Carrot/cabbage | *Klebsiella quasivariicola* |
| SBP00163 | Fermented Carrot/cabbage | *Klebsiella* sp. FDAARGOS_511 |
| SBP00163 | Fermented Carrot/cabbage | *Klebsiella* sp. LTGPAF-6F |
| SBP00163 | Fermented Carrot/cabbage | *Klebsiella* sp. LY |
| SBP00163 | Fermented Carrot/cabbage | *Klebsiella* sp. M5al |
| SBP00163 | Fermented Carrot/cabbage | *Klebsiella* sp. P1CD1 |
| SBP00163 | Fermented Carrot/cabbage | *Klebsiella* sp. PO552 |
| SBP00163 | Fermented Carrot/cabbage | *Klebsiella* sp. WCHKl90001 |
| SBP00163 | Fermented Carrot/cabbage | *Klebsiella variicola* |
| SBP00163 | Fermented Carrot/cabbage | *Kluyvera intermedia* |
| SBP00163 | Fermented Carrot/cabbage | *Kocuria rosea* |
| SBP00163 | Fermented Carrot/cabbage | *Kocuria turfanensis* |
| SBP00163 | Fermented Carrot/cabbage | *Komagataeibacter xylinus* |
| SBP00163 | Fermented Carrot/cabbage | *Kosakonia cowanii* |
| SBP00163 | Fermented Carrot/cabbage | *Kosakonia oryzae* |
| SBP00163 | Fermented Carrot/cabbage | *Kosakonia radicincitans* |
| SBP00163 | Fermented Carrot/cabbage | *Kosakonia sacchari* |
| SBP00163 | Fermented Carrot/cabbage | *Kosakonia* sp. CCTCC M2018092 |
| SBP00163 | Fermented Carrot/cabbage | *Kushneria konosiri* |
| SBP00163 | Fermented Carrot/cabbage | *Kushneria marisflavi* |
| SBP00163 | Fermented Carrot/cabbage | *Kutzneria albida* |
| SBP00163 | Fermented Carrot/cabbage | *Lacimicrobium alkaliphilum* |
| SBP00163 | Fermented Carrot/cabbage | *Lactobacillus alimentarius* |
| SBP00163 | Fermented Carrot/cabbage | *Lactobacillus backii* |
| SBP00163 | Fermented Carrot/cabbage | *Lactobacillus brevis* |
| SBP00163 | Fermented Carrot/cabbage | *Lactobacillus buchneri* |
| SBP00163 | Fermented Carrot/cabbage | *Lactobacillus casei* |
| SBP00163 | Fermented Carrot/cabbage | *Lactobacillus coryniformis* |
| SBP00163 | Fermented Carrot/cabbage | *Lactobacillus crustorum* |
| SBP00163 | Fermented Carrot/cabbage | *Lactobacillus curvatus* |
| SBP00163 | Fermented Carrot/cabbage | *Lactobacillus fermentum* |
| SBP00163 | Fermented Carrot/cabbage | *Lactobacillus helveticus* |
| SBP00163 | Fermented Carrot/cabbage | *Lactobacillus paracasei* |
| SBP00163 | Fermented Carrot/cabbage | *Lactobacillus paraplantarum* |
| SBP00163 | Fermented Carrot/cabbage | *Lactobacillus pentosus* |
| SBP00163 | Fermented Carrot/cabbage | *Lactobacillus plantarum* |
| SBP00163 | Fermented Carrot/cabbage | *Lactobacillus rhamnosus* |
| SBP00163 | Fermented Carrot/cabbage | *Lactobacillus sakei* |
| SBP00163 | Fermented Carrot/cabbage | *Lactobacillus sanfranciscensis* |
| SBP00163 | Fermented Carrot/cabbage | *Lactobacillus* sp. CBA3605 |
| SBP00163 | Fermented Carrot/cabbage | *Lactobacillus* sp. CBA3606 |
| SBP00163 | Fermented Carrot/cabbage | *Lactobacillus* virus Lb338-1 |
| SBP00163 | Fermented Carrot/cabbage | *Lactobacillus zymae* |
| SBP00163 | Fermented Carrot/cabbage | *Lactococcus garvieae* |
| SBP00163 | Fermented Carrot/cabbage | *Lactococcus lactis* |
| SBP00163 | Fermented Carrot/cabbage | *Leclercia adecarboxylata* |
| SBP00163 | Fermented Carrot/cabbage | *Leclercia* sp. LSNIH1 |
| SBP00163 | Fermented Carrot/cabbage | *Leclercia* sp. LSNIH3 |
| SBP00163 | Fermented Carrot/cabbage | *Legionella spiritensis* |
| SBP00163 | Fermented Carrot/cabbage | *Leifsonia xyli* |
| SBP00163 | Fermented Carrot/cabbage | *Lelliottia amnigena* |
| SBP00163 | Fermented Carrot/cabbage | *Lelliottia jeotgali* |
| SBP00163 | Fermented Carrot/cabbage | *Lelliottia nimipressuralis* |
| SBP00163 | Fermented Carrot/cabbage | *Lelliottia* sp. WB101 |
| SBP00163 | Fermented Carrot/cabbage | *Leminorella richardil* |
| SBP00163 | Fermented Carrot/cabbage | *Lentzea guizhouensis* |
| SBP00163 | Fermented Carrot/cabbage | *Leptothrix cholodnii* |
| SBP00163 | Fermented Carrot/cabbage | *Leuconostoc carnosum* |
| SBP00163 | Fermented Carrot/cabbage | *Leuconostoc citreum* |
| SBP00163 | Fermented Carrot/cabbage | *Leuconostoc gelidum* |
| SBP00163 | Fermented Carrot/cabbage | *Leuconostoc kimchii* |
| SBP00163 | Fermented Carrot/cabbage | *Leuconostoc lactis* |
| SBP00163 | Fermented Carrot/cabbage | *Leuconostoc mesenteroides* |
| SBP00163 | Fermented Carrot/cabbage | *Leuconostoc suionicum* |
| SBP00163 | Fermented Carrot/cabbage | *Limnobaculum parvum* |
| SBP00163 | Fermented Carrot/cabbage | *Listeria monocytogenes* |
| SBP00163 | Fermented Carrot/cabbage | *Listeria welshimeri* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Lonsdalea britannica* |
| SBP00163 | Fermented Carrot/cabbage | *Luteimonas* sp. 83-4 |
| SBP00163 | Fermented Carrot/cabbage | *Luteitalea pratensis* |
| SBP00163 | Fermented Carrot/cabbage | *Lysobacter antibioticus* |
| SBP00163 | Fermented Carrot/cabbage | *Lysobacter capsici* |
| SBP00163 | Fermented Carrot/cabbage | *Lysobacter enzymogenes* |
| SBP00163 | Fermented Carrot/cabbage | *Lysobacter gummosus* |
| SBP00163 | Fermented Carrot/cabbage | *Lysobacter maris* |
| SBP00163 | Fermented Carrot/cabbage | *Mannheimia haemolytica* |
| SBP00163 | Fermented Carrot/cabbage | *Marinobacter similis* |
| SBP00163 | Fermented Carrot/cabbage | *Marinobacter* sp. Arc7-DN-1 |
| SBP00163 | Fermented Carrot/cabbage | *Marinobacter* sp. LQ44 |
| SBP00163 | Fermented Carrot/cabbage | *Marinobacterium aestuarii* |
| SBP00163 | Fermented Carrot/cabbage | *Marinomonas* sp. FW-1 |
| SBP00163 | Fermented Carrot/cabbage | *Maritalea myrionectae* |
| SBP00163 | Fermented Carrot/cabbage | *Massilia albidiflava* |
| SBP00163 | Fermented Carrot/cabbage | *Massilia armeniaca* |
| SBP00163 | Fermented Carrot/cabbage | *Massilia lutea* |
| SBP00163 | Fermented Carrot/cabbage | *Massilia oculi* |
| SBP00163 | Fermented Carrot/cabbage | *Massilia plicata* |
| SBP00163 | Fermented Carrot/cabbage | *Massilia putida* |
| SBP00163 | Fermented Carrot/cabbage | *Massilia* sp. NR 4-1 |
| SBP00163 | Fermented Carrot/cabbage | *Massilia* sp. WG5 |
| SBP00163 | Fermented Carrot/cabbage | *Massilia* sp. YMA4 |
| SBP00163 | Fermented Carrot/cabbage | *Massilia umbonata* |
| SBP00163 | Fermented Carrot/cabbage | *Massilia violaceinigra* |
| SBP00163 | Fermented Carrot/cabbage | *Melaminivora* sp. SC2-7 |
| SBP00163 | Fermented Carrot/cabbage | *Melaminivora* sp. SC2-9 |
| SBP00163 | Fermented Carrot/cabbage | *Mesorhizobium amorphae* |
| SBP00163 | Fermented Carrot/cabbage | *Mesorhizobium japonicum* |
| SBP00163 | Fermented Carrot/cabbage | *Mesorhizobium* sp. M1D.F.Ca.ET.043.01.1.1 |
| SBP00163 | Fermented Carrot/cabbage | *Mesorhizobium* sp. M3A.F.Ca.ET.080.04.2.1 |
| SBP00163 | Fermented Carrot/cabbage | *Mesorhizobium* sp. M6A.T.Cr.TU.016.01.1.1 |
| SBP00163 | Fermented Carrot/cabbage | *Mesorhizobium* sp. M7D.F.Ca.US.005.01.1.1 |
| SBP00163 | Fermented Carrot/cabbage | *Metakosakonia* sp. MRY16-398 |
| SBP00163 | Fermented Carrot/cabbage | *Methylibium petroleiphilum* |
| SBP00163 | Fermented Carrot/cabbage | *Methylobacterium nodulans* |
| SBP00163 | Fermented Carrot/cabbage | *Methylobacterium* sp. 17SD2-17 |
| SBP00163 | Fermented Carrot/cabbage | *Methylorubrum extorquens* |
| SBP00163 | Fermented Carrot/cabbage | *Methylorubrum populi* |
| SBP00163 | Fermented Carrot/cabbage | *Microbacterium foliorum* |
| SBP00163 | Fermented Carrot/cabbage | *Microbacterium hominis* |
| SBP00163 | Fermented Carrot/cabbage | *Microbacterium oxydans* |
| SBP00163 | Fermented Carrot/cabbage | *Microbacterium sediminis* |
| SBP00163 | Fermented Carrot/cabbage | *Microbacterium* sp. TPU 3598 |
| SBP00163 | Fermented Carrot/cabbage | *Microbacterium* sp. XT11 |
| SBP00163 | Fermented Carrot/cabbage | *Microbacterium* sp. Y-01 |
| SBP00163 | Fermented Carrot/cabbage | *Microbulbifer aggregans* |
| SBP00163 | Fermented Carrot/cabbage | *Microbulbifer thermotolerans* |
| SBP00163 | Fermented Carrot/cabbage | *Microlunatus phosphovorus* |
| SBP00163 | Fermented Carrot/cabbage | *Micromonospora echinofusca* |
| SBP00163 | Fermented Carrot/cabbage | *Micromonospora purpureochromogenes* |
| SBP00163 | Fermented Carrot/cabbage | *Micropruina glycogenica* |
| SBP00163 | Fermented Carrot/cabbage | *Microvirga ossetica* |
| SBP00163 | Fermented Carrot/cabbage | *Mitsuaria* sp. 7 |
| SBP00163 | Fermented Carrot/cabbage | *Mixta calida* |
| SBP00163 | Fermented Carrot/cabbage | *Mixta gaviniae* |
| SBP00163 | Fermented Carrot/cabbage | *Modestobacter marinus* |
| SBP00163 | Fermented Carrot/cabbage | *Moraxella osloensis* |
| SBP00163 | Fermented Carrot/cabbage | *Morganella morganii* |
| SBP00163 | Fermented Carrot/cabbage | *Moritella yayanosii* |
| SBP00163 | Fermented Carrot/cabbage | *Mycobacterium* sp. DL90 |
| SBP00163 | Fermented Carrot/cabbage | *Mycobacterium* sp. EPa45 |
| SBP00163 | Fermented Carrot/cabbage | *Mycolicibacterium goodii* |
| SBP00163 | Fermented Carrot/cabbage | *Mycolicibacterium vaccae* |
| SBP00163 | Fermented Carrot/cabbage | *Myxococcus hansupus* |
| SBP00163 | Fermented Carrot/cabbage | *Myxococcus xanthus* |
| SBP00163 | Fermented Carrot/cabbage | *Neisseria elongata* |
| SBP00163 | Fermented Carrot/cabbage | *Neisseria zoodegmatis* |
| SBP00163 | Fermented Carrot/cabbage | *Neorhizobium galegae* |
| SBP00163 | Fermented Carrot/cabbage | *Neorhizobium* sp. NCHU2750 |
| SBP00163 | Fermented Carrot/cabbage | *Neorhizobium* sp. SOG26 |
| SBP00163 | Fermented Carrot/cabbage | *Nissabacter* sp. SGAir0207 |
| SBP00163 | Fermented Carrot/cabbage | *Nocardia brasiliensis* |
| SBP00163 | Fermented Carrot/cabbage | *Nocardia cyriacigeorgica* |
| SBP00163 | Fermented Carrot/cabbage | *Nocardia farcinica* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Nocardia seriolae* |
| SBP00163 | Fermented Carrot/cabbage | *Nocardioides humi* |
| SBP00163 | Fermented Carrot/cabbage | *Nocardioides* sp. CF8 |
| SBP00163 | Fermented Carrot/cabbage | *Nocardioides* sp. JS614 |
| SBP00163 | Fermented Carrot/cabbage | *Novosphingobium resinovorum* |
| SBP00163 | Fermented Carrot/cabbage | *Novosphingobium* sp. P6W |
| SBP00163 | Fermented Carrot/cabbage | *Obesumbacterium proteus* |
| SBP00163 | Fermented Carrot/cabbage | *Oceanimonas* sp. GK1 |
| SBP00163 | Fermented Carrot/cabbage | *Oceanisphaera profunda* |
| SBP00163 | Fermented Carrot/cabbage | *Ochrobactrum anthropi* |
| SBP00163 | Fermented Carrot/cabbage | *Ochrobactrum pseudogrignonense* |
| SBP00163 | Fermented Carrot/cabbage | *Ochrobactrum* sp. A44 |
| SBP00163 | Fermented Carrot/cabbage | *Paenibacillus durus* |
| SBP00163 | Fermented Carrot/cabbage | *Paenibacillus ihbetae* |
| SBP00163 | Fermented Carrot/cabbage | *Paenibacillus* sp. 32O-W |
| SBP00163 | Fermented Carrot/cabbage | *Paenibacillus* sp. IHB B 3084 |
| SBP00163 | Fermented Carrot/cabbage | *Paenibacillus stellifer* |
| SBP00163 | Fermented Carrot/cabbage | *Paludisphaera borealis* |
| SBP00163 | Fermented Carrot/cabbage | *Pandoraea apista* |
| SBP00163 | Fermented Carrot/cabbage | *Pandoraea norimbergensis* |
| SBP00163 | Fermented Carrot/cabbage | *Pandoraea pnomenusa* |
| SBP00163 | Fermented Carrot/cabbage | *Pandoraea thiooxydans* |
| SBP00163 | Fermented Carrot/cabbage | *Pantoea agglomerans* |
| SBP00163 | Fermented Carrot/cabbage | *Pantoea alhagi* |
| SBP00163 | Fermented Carrot/cabbage | *Pantoea ananatis* |
| SBP00163 | Fermented Carrot/cabbage | *Pantoea rwandensis* |
| SBP00163 | Fermented Carrot/cabbage | *Pantoea* sp. At-9b |
| SBP00163 | Fermented Carrot/cabbage | *Pantoea* sp. PSNIH1 |
| SBP00163 | Fermented Carrot/cabbage | *Pantoea* sp. PSNIH2 |
| SBP00163 | Fermented Carrot/cabbage | *Pantoea stewartii* |
| SBP00163 | Fermented Carrot/cabbage | *Pantoea vagans* |
| SBP00163 | Fermented Carrot/cabbage | *Pantoea* virus Limelight |
| SBP00163 | Fermented Carrot/cabbage | *Paraburkholderia aromaticivorans* |
| SBP00163 | Fermented Carrot/cabbage | *Paraburkholderia caledonica* |
| SBP00163 | Fermented Carrot/cabbage | *Paraburkholderia caribensis* |
| SBP00163 | Fermented Carrot/cabbage | *Paraburkholderia fungorum* |
| SBP00163 | Fermented Carrot/cabbage | *Paraburkholderia hospita* |
| SBP00163 | Fermented Carrot/cabbage | *Paraburkholderia phymatum* |
| SBP00163 | Fermented Carrot/cabbage | *Paraburkholderia phytofirmans* |
| SBP00163 | Fermented Carrot/cabbage | *Paraburkholderia* sp. SOS3 |
| SBP00163 | Fermented Carrot/cabbage | *Paraburkholderia sprentiae* |
| SBP00163 | Fermented Carrot/cabbage | *Paraburkholderia terrae* |
| SBP00163 | Fermented Carrot/cabbage | *Paraburkholderia xenovorans* |
| SBP00163 | Fermented Carrot/cabbage | *Paracoccus denitrificans* |
| SBP00163 | Fermented Carrot/cabbage | *Paracoccus* sp. Arc7-R13 |
| SBP00163 | Fermented Carrot/cabbage | *Paracoccus yeei* |
| SBP00163 | Fermented Carrot/cabbage | *Pasteurella multocida* |
| SBP00163 | Fermented Carrot/cabbage | *Pectobacterium atrosepticum* |
| SBP00163 | Fermented Carrot/cabbage | *Pectobacterium carotovorum* |
| SBP00163 | Fermented Carrot/cabbage | *Pectobacterium parmentieri* |
| SBP00163 | Fermented Carrot/cabbage | *Pectobacterium polaris* |
| SBP00163 | Fermented Carrot/cabbage | *Pectobacterium wasabiae* |
| SBP00163 | Fermented Carrot/cabbage | *Pediococcus acidilactici* |
| SBP00163 | Fermented Carrot/cabbage | *Pediococcus claussenii* |
| SBP00163 | Fermented Carrot/cabbage | *Pediococcus damnosus* |
| SBP00163 | Fermented Carrot/cabbage | *Pediococcus inopinatus* |
| SBP00163 | Fermented Carrot/cabbage | *Pediococcus pentosaceus* |
| SBP00163 | Fermented Carrot/cabbage | *Pedobacter steynii* |
| SBP00163 | Fermented Carrot/cabbage | *Photobacterium damselae* |
| SBP00163 | Fermented Carrot/cabbage | *Photobacterium gaetbulicola* |
| SBP00163 | Fermented Carrot/cabbage | *Photorhabdus asymbiotica* |
| SBP00163 | Fermented Carrot/cabbage | *Photorhabdus laumondii* |
| SBP00163 | Fermented Carrot/cabbage | *Photorhabdus thracensis* |
| SBP00163 | Fermented Carrot/cabbage | *Phreatobacter stygius* |
| SBP00163 | Fermented Carrot/cabbage | *Phytobacter* sp. SCO41 |
| SBP00163 | Fermented Carrot/cabbage | *Phytobacter ursingii* |
| SBP00163 | Fermented Carrot/cabbage | *Pigmentiphaga* sp. H8 |
| SBP00163 | Fermented Carrot/cabbage | *Pimelobacter simplex* |
| SBP00163 | Fermented Carrot/cabbage | *Piscirickettsia salmonis* |
| SBP00163 | Fermented Carrot/cabbage | *Planctomyces* sp. SH-PL14 |
| SBP00163 | Fermented Carrot/cabbage | *Plantibacter flavus* |
| SBP00163 | Fermented Carrot/cabbage | *Plantibacter* sp. |
| SBP00163 | Fermented Carrot/cabbage | *Plantibacter* sp. PA-3-X8 |
| SBP00163 | Fermented Carrot/cabbage | *Plautia stali* |
| SBP00163 | Fermented Carrot/cabbage | *Plautia stali* symbiont |
| SBP00163 | Fermented Carrot/cabbage | *Plesiomonas shigelloides* |

TABLE 3-continued

List of species identified in each metagenomic sample of each SBP Sample

| SBP ID | SBP Host Common Name | Genus sp. |
| --- | --- | --- |
| SBP00163 | Fermented Carrot/cabbage | *Pluralibacter gergoviae* |
| SBP00163 | Fermented Carrot/cabbage | *Polaromonas naphthalenivorans* |
| SBP00163 | Fermented Carrot/cabbage | *Polaromonas* sp. JS666 |
| SBP00163 | Fermented Carrot/cabbage | *Polaromonas* sp. SP1 |
| SBP00163 | Fermented Carrot/cabbage | *Pragia fontium* |
| SBP00163 | Fermented Carrot/cabbage | *Proteus hauseri* |
| SBP00163 | Fermented Carrot/cabbage | *Proteus mirabilis* |
| SBP00163 | Fermented Carrot/cabbage | *Proteus vulgaris* |
| SBP00163 | Fermented Carrot/cabbage | *Providencia alcalifaciens* |
| SBP00163 | Fermented Carrot/cabbage | *Providencia heimbachae* |
| SBP00163 | Fermented Carrot/cabbage | *Providencia rettgeri* |
| SBP00163 | Fermented Carrot/cabbage | *Providencia rustigianii* |
| SBP00163 | Fermented Carrot/cabbage | *Providencia* sp. WCHPr000369 |
| SBP00163 | Fermented Carrot/cabbage | *Providencia stuartii* |
| SBP00163 | Fermented Carrot/cabbage | *Pseudoalteromonas luteoviolacea* |
| SBP00163 | Fermented Carrot/cabbage | *Pseudoalteromonas phenolica* |
| SBP00163 | Fermented Carrot/cabbage | *Pseudoalteromonas piratica* |
| SBP00163 | Fermented Carrot/cabbage | *Pseudoalteromonas rubra* |
| SBP00163 | Fermented Carrot/cabbage | *Pseudogulbenkiania* sp. NH8B |
| SBP00163 | Fermented Carrot/cabbage | *Pseudomonas aeruginosa* |
| SBP00163 | Fermented Carrot/cabbage | *Pseudomonas agarici* |
| SBP00163 | Fermented Carrot/cabbage | *Pseudomonas alcaligenes* |
| SBP00163 | Fermented Carrot/cabbage | *Pseudomonas alcaliphila* |
| SBP00163 | Fermented Carrot/cabbage | *Pseudomonas alkylphenolica* |
| SBP00163 | Fermented Carrot/cabbage | *Pseudomonas amygdali* |
| SBP00163 | Fermented Carrot/cabbage | *Pseudomonas antarctica* |
| SBP00163 | Fermented Carrot/cabbage | *Pseudomonas arsenicoxydans* |
| SBP00163 | Fermented Carrot/cabbage | *Pseudomonas asplenii* |
| SBP00163 | Fermented Carrot/cabbage | *Pseudomonas azotoformans* |
| SBP00163 | Fermented Carrot/cabbage | *Pseudomonas balearica* |
| SBP00163 | Fermented Carrot/cabbage | *Pseudomonas brassicacearum* |
| SBP00163 | Fermented Carrot/cabbage | *Pseudomonas brenneri* |
| SBP00163 | Fermented Carrot/cabbage | *Pseudomonas cedrina* |
| SBP00163 | Fermented Carrot/cabbage | *Pseudomonas chlororaphis* |
| SBP00163 | Fermented Carrot/cabbage | *Pseudomonas cichorii* |
| SBP00163 | Fermented Carrot/cabbage | *Pseudomonas citronellolis* |
| SBP00163 | Fermented Carrot/cabbage | *Pseudomonas corrugata* |
| SBP00163 | Fermented Carrot/cabbage | *Pseudomonas cremoricolorata* |
| SBP00163 | Fermented Carrot/cabbage | *Pseudomonas entomophila* |
| SBP00163 | Fermented Carrot/cabbage | *Pseudomonas extremaustralis* |
| SBP00163 | Fermented Carrot/cabbage | *Pseudomonas extremorientalis* |
| SBP00163 | Fermented Carrot/cabbage | *Pseudomonas fluorescens* |
| SBP00163 | Fermented Carrot/cabbage | *Pseudomonas fragi* |
| SBP00163 | Fermented Carrot/cabbage | *Pseudomonas frederiksbergensis* |
| SBP00163 | Fermented Carrot/cabbage | *Pseudomonas fulva* |
| SBP00163 | Fermented Carrot/cabbage | *Pseudomonas furukawaii* |
| SBP00163 | Fermented Carrot/cabbage | *Pseudomonas fuscovaginae* |
| SBP00163 | Fermented Carrot/cabbage | *Pseudomonas granadensis* |
| SBP00163 | Fermented Carrot/cabbage | *Pseudomonas guangdongensis* |
| SBP00163 | Fermented Carrot/cabbage | *Pseudomonas knackmussii* |
| SBP00163 | Fermented Carrot/cabbage | *Pseudomonas koreensis* |
| SBP00163 | Fermented Carrot/cabbage | *Pseudomonas kribbensis* |
| SBP00163 | Fermented Carrot/cabbage | *Pseudomonas libanensis* |
| SBP00163 | Fermented Carrot/cabbage | *Pseudomonas lini* |
| SBP00163 | Fermented Carrot/cabbage | *Pseudomonas litoralis* |
| SBP00163 | Fermented Carrot/cabbage | *Pseudomonas lurida* |
| SBP00163 | Fermented Carrot/cabbage | *Pseudomonas mandelii* |
| SBP00163 | Fermented Carrot/cabbage | *Pseudomonas mediterranea* |
| SBP00163 | Fermented Carrot/cabbage | *Pseudomonas mendocina* |
| SBP00163 | Fermented Carrot/cabbage | *Pseudomonas monteilii* |
| SBP00163 | Fermented Carrot/cabbage | *Pseudomonas moraviensis* |
| SBP00163 | Fermented Carrot/cabbage | *Pseudomonas mosselii* |
| SBP00163 | Fermented Carrot/cabbage | *Pseudomonas mucidolens* |
| SBP00163 | Fermented Carrot/cabbage | *Pseudomonas orientalis* |
| SBP00163 | Fermented Carrot/cabbage | *Pseudomonas oryzae* |
| SBP00163 | Fermented Carrot/cabbage | *Pseudomonas oryzihabitans* |
| SBP00163 | Fermented Carrot/cabbage | *Pseudomonas palleroniana* |
| SBP00163 | Fermented Carrot/cabbage | *Pseudomonas parafulva* |
| SBP00163 | Fermented Carrot/cabbage | *Pseudomonas phage Andromeda* |
| SBP00163 | Fermented Carrot/cabbage | *Pseudomonas plecoglossicida* |
| SBP00163 | Fermented Carrot/cabbage | *Pseudomonas poae* |
| SBP00163 | Fermented Carrot/cabbage | *Pseudomonas pohangensis* |
| SBP00163 | Fermented Carrot/cabbage | *Pseudomonas prosekii* |
| SBP00163 | Fermented Carrot/cabbage | *Pseudomonas protegens* |
| SBP00163 | Fermented Carrot/cabbage | *Pseudomonas psychrophila* |
| SBP00163 | Fermented Carrot/cabbage | *Pseudomonas psychrotolerans* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Pseudomonas putida* |
| SBP00163 | Fermented Carrot/cabbage | *Pseudomonas reinekei* |
| SBP00163 | Fermented Carrot/cabbage | *Pseudomonas resinovorans* |
| SBP00163 | Fermented Carrot/cabbage | *Pseudomonas rhizosphaerae* |
| SBP00163 | Fermented Carrot/cabbage | *Pseudomonas rhodesiae* |
| SBP00163 | Fermented Carrot/cabbage | *Pseudomonas sabulinigri* |
| SBP00163 | Fermented Carrot/cabbage | *Pseudomonas salegens* |
| SBP00163 | Fermented Carrot/cabbage | *Pseudomonas saudiphocaensis* |
| SBP00163 | Fermented Carrot/cabbage | *Pseudomonas savastanoi* |
| SBP00163 | Fermented Carrot/cabbage | *Pseudomonas sihuiensis* |
| SBP00163 | Fermented Carrot/cabbage | *Pseudomonas silesiensis* |
| SBP00163 | Fermented Carrot/cabbage | *Pseudomonas simiae* |
| SBP00163 | Fermented Carrot/cabbage | *Pseudomonas soli* |
| SBP00163 | Fermented Carrot/cabbage | *Pseudomonas sp.* |
| SBP00163 | Fermented Carrot/cabbage | *Pseudomonas sp.* 02C 26 |
| SBP00163 | Fermented Carrot/cabbage | *Pseudomonas sp.* 09C 129 |
| SBP00163 | Fermented Carrot/cabbage | *Pseudomonas sp.* 31-12 |
| SBP00163 | Fermented Carrot/cabbage | *Pseudomonas sp.* 7SR1 |
| SBP00163 | Fermented Carrot/cabbage | *Pseudomonas sp.* A214 |
| SBP00163 | Fermented Carrot/cabbage | *Pseudomonas sp.* ATCC 13867 |
| SBP00163 | Fermented Carrot/cabbage | *Pseudomonas sp.* B10 |
| SBP00163 | Fermented Carrot/cabbage | *Pseudomonas sp.* CC6-YY-74 |
| SBP00163 | Fermented Carrot/cabbage | *Pseudomonas sp.* CCOS 191 |
| SBP00163 | Fermented Carrot/cabbage | *Pseudomonas sp.* CMR12a |
| SBP00163 | Fermented Carrot/cabbage | *Pseudomonas sp.* CMR5c |
| SBP00163 | Fermented Carrot/cabbage | *Pseudomonas sp.* DR 5-09 |
| SBP00163 | Fermented Carrot/cabbage | *Pseudomonas sp.* DY-1 |
| SBP00163 | Fermented Carrot/cabbage | *Pseudomonas sp.* FDAARGOS_380 |
| SBP00163 | Fermented Carrot/cabbage | *Pseudomonas sp.* FGI182 |
| SBP00163 | Fermented Carrot/cabbage | *Pseudomonas sp.* GR 6-02 |
| SBP00163 | Fermented Carrot/cabbage | *Pseudomonas sp.* HLS-6 |
| SBP00163 | Fermented Carrot/cabbage | *Pseudomonas sp.* JY-Q |
| SBP00163 | Fermented Carrot/cabbage | *Pseudomonas sp.* K2W315-8 |
| SBP00163 | Fermented Carrot/cabbage | *Pseudomonas sp.* LAB-08 |
| SBP00163 | Fermented Carrot/cabbage | *Pseudomonas sp.* LBUM920 |
| SBP00163 | Fermented Carrot/cabbage | *Pseudomonas sp.* Leaf58 |
| SBP00163 | Fermented Carrot/cabbage | *Pseudomonas sp.* LG1D9 |
| SBP00163 | Fermented Carrot/cabbage | *Pseudomonas sp.* LG1E9 |
| SBP00163 | Fermented Carrot/cabbage | *Pseudomonas sp.* LH1G9 |
| SBP00163 | Fermented Carrot/cabbage | *Pseudomonas sp.* LPH1 |
| SBP00163 | Fermented Carrot/cabbage | *Pseudomonas sp.* LTJR-52 |
| SBP00163 | Fermented Carrot/cabbage | *Pseudomonas sp.* Lz4W |
| SBP00163 | Fermented Carrot/cabbage | *Pseudomonas sp.* M30-35 |
| SBP00163 | Fermented Carrot/cabbage | *Pseudomonas sp.* MRSN12121 |
| SBP00163 | Fermented Carrot/cabbage | *Pseudomonas sp.* MYb193 |
| SBP00163 | Fermented Carrot/cabbage | *Pseudomonas sp.* NC02 |
| SBP00163 | Fermented Carrot/cabbage | *Pseudomonas sp.* NS1(2017) |
| SBP00163 | Fermented Carrot/cabbage | *Pseudomonas sp.* Os17 |
| SBP00163 | Fermented Carrot/cabbage | *Pseudomonas sp.* phDV1 |
| SBP00163 | Fermented Carrot/cabbage | *Pseudomonas sp.* PONIH3 |
| SBP00163 | Fermented Carrot/cabbage | *Pseudomonas sp.* R2-37-08W |
| SBP00163 | Fermented Carrot/cabbage | *Pseudomonas sp.* R2-7-07 |
| SBP00163 | Fermented Carrot/cabbage | *Pseudomonas sp.* R2A2 |
| SBP00163 | Fermented Carrot/cabbage | *Pseudomonas sp.* R3-18-08 |
| SBP00163 | Fermented Carrot/cabbage | *Pseudomonas sp.* R3-52-08 |
| SBP00163 | Fermented Carrot/cabbage | *Pseudomonas sp.* R4-34-07 |
| SBP00163 | Fermented Carrot/cabbage | *Pseudomonas sp.* R5-89-07 |
| SBP00163 | Fermented Carrot/cabbage | *Pseudomonas sp.* RU47 |
| SBP00163 | Fermented Carrot/cabbage | *Pseudomonas sp.* S-6-2 |
| SBP00163 | Fermented Carrot/cabbage | *Pseudomonas sp.* 509G 359 |
| SBP00163 | Fermented Carrot/cabbage | *Pseudomonas sp.* s211(2017) |
| SBP00163 | Fermented Carrot/cabbage | *Pseudomonas sp.* SGAir0191 |
| SBP00163 | Fermented Carrot/cabbage | *Pseudomonas sp.* St29 |
| SBP00163 | Fermented Carrot/cabbage | *Pseudomonas sp.* StFLB209 |
| SBP00163 | Fermented Carrot/cabbage | *Pseudomonas sp.* SWI36 |
| SBP00163 | Fermented Carrot/cabbage | *Pseudomonas sp.* SXM-1 |
| SBP00163 | Fermented Carrot/cabbage | *Pseudomonas sp.* TCU-HL1 |
| SBP00163 | Fermented Carrot/cabbage | *Pseudomonas sp.* TKP |
| SBP00163 | Fermented Carrot/cabbage | *Pseudomonas sp.* TMW 2.1634 |
| SBP00163 | Fermented Carrot/cabbage | *Pseudomonas sp.* URMO17WK12:I11 |
| SBP00163 | Fermented Carrot/cabbage | *Pseudomonas sp.* UW4 |
| SBP00163 | Fermented Carrot/cabbage | *Pseudomonas sp.* XWY-1 |
| SBP00163 | Fermented Carrot/cabbage | *Pseudomonas sp.* Z003-0.4C(8344-21) |
| SBP00163 | Fermented Carrot/cabbage | *Pseudomonas stutzeri* |
| SBP00163 | Fermented Carrot/cabbage | *Pseudomonas synxantha* |
| SBP00163 | Fermented Carrot/cabbage | *Pseudomonas syringae* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | *Pseudomonas syringae* group genomosp. 3 |
| SBP00163 | Fermented Carrot/cabbage | *Pseudomonas taetrolens* |
| SBP00163 | Fermented Carrot/cabbage | *Pseudomonas thivervalensis* |
| SBP00163 | Fermented Carrot/cabbage | *Pseudomonas tolaasii* |
| SBP00163 | Fermented Carrot/cabbage | *Pseudomonas trivialis* |
| SBP00163 | Fermented Carrot/cabbage | *Pseudomonas umsongensis* |
| SBP00163 | Fermented Carrot/cabbage | *Pseudomonas vancouverensis* |
| SBP00163 | Fermented Carrot/cabbage | *Pseudomonas veronii* |
| SBP00163 | Fermented Carrot/cabbage | *Pseudomonas versuta* |
| SBP00163 | Fermented Carrot/cabbage | *Pseudomonas viridiflava* |
| SBP00163 | Fermented Carrot/cabbage | *Pseudomonas xanthomarina* |
| SBP00163 | Fermented Carrot/cabbage | *Pseudomonas xinjiangensis* |
| SBP00163 | Fermented Carrot/cabbage | *Pseudomonas yamanorum* |
| SBP00163 | Fermented Carrot/cabbage | *Pseudonocardia dioxanivorans* |
| SBP00163 | Fermented Carrot/cabbage | *Pseudopropionibacterium propionicum* |
| SBP00163 | Fermented Carrot/cabbage | *Pseudorhodoplanes sinuspersici* |
| SBP00163 | Fermented Carrot/cabbage | *Pseudoxanthomonas spadix* |
| SBP00163 | Fermented Carrot/cabbage | *Pseudoxanthomonas suwonensis* |
| SBP00163 | Fermented Carrot/cabbage | *Psychrobacter alimentarius* |
| SBP00163 | Fermented Carrot/cabbage | *Pusillimonas* sp. T7-7 |
| SBP00163 | Fermented Carrot/cabbage | *Rahnella aquatilis* |
| SBP00163 | Fermented Carrot/cabbage | *Rahnella* sp. 'WMR15' |
| SBP00163 | Fermented Carrot/cabbage | *Rahnella* sp. ERMR1:05 |
| SBP00163 | Fermented Carrot/cabbage | *Rahnella* sp. Y9602 |
| SBP00163 | Fermented Carrot/cabbage | *Ralstonia insidiosa* |
| SBP00163 | Fermented Carrot/cabbage | *Ralstonia mannitolilytica* |
| SBP00163 | Fermented Carrot/cabbage | *Ralstonia pickettii* |
| SBP00163 | Fermented Carrot/cabbage | *Ralstonia solanacearum* |
| SBP00163 | Fermented Carrot/cabbage | *Ramlibacter tataouinensis* |
| SBP00163 | Fermented Carrot/cabbage | *Raoultella ornithinolytica* |
| SBP00163 | Fermented Carrot/cabbage | *Raoultella planticola* |
| SBP00163 | Fermented Carrot/cabbage | *Raoultella terrigena* |
| SBP00163 | Fermented Carrot/cabbage | *Rathayibacter festucae* |
| SBP00163 | Fermented Carrot/cabbage | *Rathayibacter tritici* |
| SBP00163 | Fermented Carrot/cabbage | *Reinekea forsetii* |
| SBP00163 | Fermented Carrot/cabbage | *Rheinheimera* sp. LHK132 |
| SBP00163 | Fermented Carrot/cabbage | *Rhizobacter gummiphilus* |
| SBP00163 | Fermented Carrot/cabbage | *Rhizobium acidisoli* |
| SBP00163 | Fermented Carrot/cabbage | *Rhizobium etli* |
| SBP00163 | Fermented Carrot/cabbage | *Rhizobium favelukesii* |
| SBP00163 | Fermented Carrot/cabbage | *Rhizobium gallicum* |
| SBP00163 | Fermented Carrot/cabbage | *Rhizobium leguminosarum* |
| SBP00163 | Fermented Carrot/cabbage | *Rhizobium phaseoli* |
| SBP00163 | Fermented Carrot/cabbage | *Rhizobium* sp. ACO-34A |
| SBP00163 | Fermented Carrot/cabbage | *Rhizobium* sp. NT-26 |
| SBP00163 | Fermented Carrot/cabbage | *Rhizobium* sp. TAL182 |
| SBP00163 | Fermented Carrot/cabbage | *Rhizobium tropici* |
| SBP00163 | Fermented Carrot/cabbage | *Rhodanobacteraceae bacterium* Dysh456 |
| SBP00163 | Fermented Carrot/cabbage | *Rhodobacter blasticus* |
| SBP00163 | Fermented Carrot/cabbage | *Rhodobacter sphaeroides* |
| SBP00163 | Fermented Carrot/cabbage | *Rhodobacteraceae bacterium* QY30 |
| SBP00163 | Fermented Carrot/cabbage | *Rhodobiaceae bacterium* |
| SBP00163 | Fermented Carrot/cabbage | *Rhodococcus fascians* |
| SBP00163 | Fermented Carrot/cabbage | *Rhodococcus opacus* |
| SBP00163 | Fermented Carrot/cabbage | *Rhodococcus* sp. B7740 |
| SBP00163 | Fermented Carrot/cabbage | *Rhodococcus* sp. NJ-530 |
| SBP00163 | Fermented Carrot/cabbage | *Rhodococcus* sp. P1Y |
| SBP00163 | Fermented Carrot/cabbage | *Rhodoferax antarcticus* |
| SBP00163 | Fermented Carrot/cabbage | *Rhodoferax ferrireducens* |
| SBP00163 | Fermented Carrot/cabbage | *Rhodoferax koreense* |
| SBP00163 | Fermented Carrot/cabbage | *Rhodoferax saidenbachensis* |
| SBP00163 | Fermented Carrot/cabbage | *Rhodoplanes* sp. Z2-YC6860 |
| SBP00163 | Fermented Carrot/cabbage | *Rhodopseudomonas palustris* |
| SBP00163 | Fermented Carrot/cabbage | *Rhodospirillum rubrum* |
| SBP00163 | Fermented Carrot/cabbage | *Rhodothermus marinus* |
| SBP00163 | Fermented Carrot/cabbage | *Roseateles depolymerans* |
| SBP00163 | Fermented Carrot/cabbage | *Rubrivivax gelatinosus* |
| SBP00163 | Fermented Carrot/cabbage | *Ruegeria* sp. TM1040 |
| SBP00163 | Fermented Carrot/cabbage | *Saccharomonospora viridis* |
| SBP00163 | Fermented Carrot/cabbage | *Saccharospirillum mangrovi* |
| SBP00163 | Fermented Carrot/cabbage | *Sagittula* sp. P11 |
| SBP00163 | Fermented Carrot/cabbage | *Salinicola tamaricis* |
| SBP00163 | Fermented Carrot/cabbage | *Salinisphaera* sp. LB1 |
| SBP00163 | Fermented Carrot/cabbage | *Salinivibrio kushneri* |
| SBP00163 | Fermented Carrot/cabbage | *Salmonella bongori* |
| SBP00163 | Fermented Carrot/cabbage | *Salmonella enterica* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | Salmonella phage SSU5 |
| SBP00163 | Fermented Carrot/cabbage | Sanguibacter keddieii |
| SBP00163 | Fermented Carrot/cabbage | secondary endosymbiont of Ctenarytaina eucalypti |
| SBP00163 | Fermented Carrot/cabbage | Serratia ficaria |
| SBP00163 | Fermented Carrot/cabbage | Serratia fonticola |
| SBP00163 | Fermented Carrot/cabbage | Serratia liquefaciens |
| SBP00163 | Fermented Carrot/cabbage | Serratia marcescens |
| SBP00163 | Fermented Carrot/cabbage | Serratia odorifera |
| SBP00163 | Fermented Carrot/cabbage | Serratia plymuthica |
| SBP00163 | Fermented Carrot/cabbage | Serratia proteamaculans |
| SBP00163 | Fermented Carrot/cabbage | Serratia quinivorans |
| SBP00163 | Fermented Carrot/cabbage | Serratia rubidaea |
| SBP00163 | Fermented Carrot/cabbage | Serratia sp. |
| SBP00163 | Fermented Carrot/cabbage | Serratia sp. 1D1416 |
| SBP00163 | Fermented Carrot/cabbage | Serratia sp. 3ACOL1 |
| SBP00163 | Fermented Carrot/cabbage | Serratia sp. ATCC 39006 |
| SBP00163 | Fermented Carrot/cabbage | Serratia sp. FDAARGOS_506 |
| SBP00163 | Fermented Carrot/cabbage | Serratia sp. FGI94 |
| SBP00163 | Fermented Carrot/cabbage | Serratia sp. FS14 |
| SBP00163 | Fermented Carrot/cabbage | Serratia sp. LS-1 |
| SBP00163 | Fermented Carrot/cabbage | Serratia sp. MYb239 |
| SBP00163 | Fermented Carrot/cabbage | Serratia sp. P2ACOL2 |
| SBP00163 | Fermented Carrot/cabbage | Serratia sp. SCBI |
| SBP00163 | Fermented Carrot/cabbage | Serratia sp. SSNIH1 |
| SBP00163 | Fermented Carrot/cabbage | Serratia sp. YD25 |
| SBP00163 | Fermented Carrot/cabbage | Shewanella algae |
| SBP00163 | Fermented Carrot/cabbage | Shewanella amazonensis |
| SBP00163 | Fermented Carrot/cabbage | Shewanella denitrificans |
| SBP00163 | Fermented Carrot/cabbage | Shewanella loihica |
| SBP00163 | Fermented Carrot/cabbage | Shewanella pealeana |
| SBP00163 | Fermented Carrot/cabbage | Shewanella putrefaciens |
| SBP00163 | Fermented Carrot/cabbage | Shewanella sp. ANA-3 |
| SBP00163 | Fermented Carrot/cabbage | Shewanella sp. TH2012 |
| SBP00163 | Fermented Carrot/cabbage | Shewanella sp. WE21 |
| SBP00163 | Fermented Carrot/cabbage | Shewanella woodyi |
| SBP00163 | Fermented Carrot/cabbage | Shigella boydil |
| SBP00163 | Fermented Carrot/cabbage | Shigella dysenteriae |
| SBP00163 | Fermented Carrot/cabbage | Shigella flexneri |
| SBP00163 | Fermented Carrot/cabbage | Shimwellia blattae |
| SBP00163 | Fermented Carrot/cabbage | Shinella sp. HZN7 |
| SBP00163 | Fermented Carrot/cabbage | Simplicispira suum |
| SBP00163 | Fermented Carrot/cabbage | Sinorhizobium fredii |
| SBP00163 | Fermented Carrot/cabbage | Sinorhizobium meliloti |
| SBP00163 | Fermented Carrot/cabbage | Sinorhizobium sp. RAC02 |
| SBP00163 | Fermented Carrot/cabbage | Sodalis glossinidius |
| SBP00163 | Fermented Carrot/cabbage | Sodalis praecaptivus |
| SBP00163 | Fermented Carrot/cabbage | Solimonas sp. K1W22B-7 |
| SBP00163 | Fermented Carrot/cabbage | Sorangium cellulosum |
| SBP00163 | Fermented Carrot/cabbage | Sphingobacteriaceae bacterium GW460-11-11-14-L85 |
| SBP00163 | Fermented Carrot/cabbage | Sphingobium hydrophobicum |
| SBP00163 | Fermented Carrot/cabbage | Sphingobium sp. RAC03 |
| SBP00163 | Fermented Carrot/cabbage | Sphingobium sp. SYK-6 |
| SBP00163 | Fermented Carrot/cabbage | Sphingobium sp. YG1 |
| SBP00163 | Fermented Carrot/cabbage | Sphingobium yanoikuyae |
| SBP00163 | Fermented Carrot/cabbage | Sphingomonas koreensis |
| SBP00163 | Fermented Carrot/cabbage | Sphingomonas melonis |
| SBP00163 | Fermented Carrot/cabbage | Sphingomonas panacis |
| SBP00163 | Fermented Carrot/cabbage | Sphingomonas sp. FARSPH |
| SBP00163 | Fermented Carrot/cabbage | Sphingomonas sp. LM7 |
| SBP00163 | Fermented Carrot/cabbage | Sphingomonas sp. MM-1 |
| SBP00163 | Fermented Carrot/cabbage | Sphingomonas taxi |
| SBP00163 | Fermented Carrot/cabbage | Sphingopyxis alaskensis |
| SBP00163 | Fermented Carrot/cabbage | Sphingopyxis macrogoltabida |
| SBP00163 | Fermented Carrot/cabbage | Sphingopyxis sp. 113P3 |
| SBP00163 | Fermented Carrot/cabbage | Sphingopyxis sp. FD7 |
| SBP00163 | Fermented Carrot/cabbage | Sphingosinicella sp. BN140058 |
| SBP00163 | Fermented Carrot/cabbage | Sporosarcina psychrophila |
| SBP00163 | Fermented Carrot/cabbage | Staphylococcus aureus |
| SBP00163 | Fermented Carrot/cabbage | Staphylococcus carnosus |
| SBP00163 | Fermented Carrot/cabbage | Staphylococcus epidermidis |
| SBP00163 | Fermented Carrot/cabbage | Staphylococcus xylosus |
| SBP00163 | Fermented Carrot/cabbage | Stella humosa |
| SBP00163 | Fermented Carrot/cabbage | Stella vacuolata |
| SBP00163 | Fermented Carrot/cabbage | Stenotrophomonas acidaminiphila |
| SBP00163 | Fermented Carrot/cabbage | Stenotrophomonas maltophilia |
| SBP00163 | Fermented Carrot/cabbage | Stenotrophomonas rhizophila |

TABLE 3-continued

List of species identified in each metagenomic sample of each SBP Sample

| SBP ID | SBP Host Common Name | Genus sp. |
| --- | --- | --- |
| SBP00163 | Fermented Carrot/cabbage | *Stenotrophomonas* sp. |
| SBP00163 | Fermented Carrot/cabbage | *Stenotrophomonas* sp. ESTM1D_MKCIP4_1 |
| SBP00163 | Fermented Carrot/cabbage | *Stenotrophomonas* sp. G4 |
| SBP00163 | Fermented Carrot/cabbage | *Stenotrophomonas* sp. LM091 |
| SBP00163 | Fermented Carrot/cabbage | *Stenotrophomonas* sp. MYb57 |
| SBP00163 | Fermented Carrot/cabbage | *Stenotrophomonas* sp. Pemsol |
| SBP00163 | Fermented Carrot/cabbage | *Stenotrophomonas* sp. SAU14A_NAIMI4_5 |
| SBP00163 | Fermented Carrot/cabbage | *Stenotrophomonas* sp. SAU14A_NAIMI4_8 |
| SBP00163 | Fermented Carrot/cabbage | *Stenotrophomonas* sp. WZN-1 |
| SBP00163 | Fermented Carrot/cabbage | *Stenotrophomonas* sp. YAU14A_MKIMI4_1 |
| SBP00163 | Fermented Carrot/cabbage | *Stenotrophomonas* sp. YAU14D1_LEIMI4_1 |
| SBP00163 | Fermented Carrot/cabbage | *Stenotrophomonas* sp. ZAC14A_NAIMI4_1 |
| SBP00163 | Fermented Carrot/cabbage | *Stenotrophomonas* sp. ZAC14D2_NAIMI4_6 |
| SBP00163 | Fermented Carrot/cabbage | *Stenotrophomonas* sp. ZAC14D2_NAIMI4_7 |
| SBP00163 | Fermented Carrot/cabbage | *Sterolibacteriaceae bacterium* JSB |
| SBP00163 | Fermented Carrot/cabbage | *Streptococcus gordonii* |
| SBP00163 | Fermented Carrot/cabbage | *Streptococcus thermophilus* |
| SBP00163 | Fermented Carrot/cabbage | *Streptomyces asterosporus* |
| SBP00163 | Fermented Carrot/cabbage | *Streptomyces cattleya* |
| SBP00163 | Fermented Carrot/cabbage | *Streptomyces pactum* |
| SBP00163 | Fermented Carrot/cabbage | *Streptomyces rimosus* |
| SBP00163 | Fermented Carrot/cabbage | *Streptomyces scabiei* |
| SBP00163 | Fermented Carrot/cabbage | *Streptomyces seoulensis* |
| SBP00163 | Fermented Carrot/cabbage | *Streptomyces* sp. 2323.1 |
| SBP00163 | Fermented Carrot/cabbage | *Streptomyces* sp. 3214.6 |
| SBP00163 | Fermented Carrot/cabbage | *Streptomyces* sp. TLI_053 |
| SBP00163 | Fermented Carrot/cabbage | *Sulfitobacter* sp. D7 |
| SBP00163 | Fermented Carrot/cabbage | *Sulfuriflexus mobilis* |
| SBP00163 | Fermented Carrot/cabbage | *Tabrizicola* sp. K13M18 |
| SBP00163 | Fermented Carrot/cabbage | *Tatumella citrea* |
| SBP00163 | Fermented Carrot/cabbage | *Tatumella morbirosei* |
| SBP00163 | fermented Carrot/cabbage | *Thalassococcus* sp. SH-1 |
| SBP00163 | Fermented Carrot/cabbage | *Thermomonas* sp. SY21 |
| SBP00163 | Fermented Carrot/cabbage | *Thiocystis violascens* |
| SBP00163 | Fermented Carrot/cabbage | *Thiomonas* sp. X19 |
| SBP00163 | Fermented Carrot/cabbage | *Tistrella mobilis* |
| SBP00163 | Fermented Carrot/cabbage | *Tolumonas auensis* |
| SBP00163 | Fermented Carrot/cabbage | *Variovorax boronicumulans* |
| SBP00163 | Fermented Carrot/cabbage | *Variovorax paradoxus* |
| SBP00163 | Fermented Carrot/cabbage | *Variovorax* sp. HW608 |
| SBP00163 | Fermented Carrot/cabbage | *Variovorax* sp. PAMC 28711 |
| SBP00163 | Fermented Carrot/cabbage | *Variovorax* sp. PMC12 |
| SBP00163 | Fermented Carrot/cabbage | *Vibrio azureus* |
| SBP00163 | Fermented Carrot/cabbage | *Vibrio campbellii* |
| SBP00163 | Fermented Carrot/cabbage | *Vibrio cholerae* |
| SBP00163 | Fermented Carrot/cabbage | *Vibrio coralliilyticus* |
| SBP00163 | Fermented Carrot/cabbage | *Vibrio fluvialis* |
| SBP00163 | Fermented Carrot/cabbage | *Vibrio furnissii* |
| SBP00163 | Fermented Carrot/cabbage | *Vibrio harveyi* |
| SBP00163 | Fermented Carrot/cabbage | *Vibrio mediterranei* |
| SBP00163 | Fermented Carrot/cabbage | *Vibrio mimicus* |
| SBP00163 | Fermented Carrot/cabbage | *Vibrio nigripulchritudo* |
| SBP00163 | Fermented Carrot/cabbage | *Vibrio parahaemolyticus* |
| SBP00163 | Fermented Carrot/cabbage | *Vibrio rumoiensis* |
| SBP00163 | Fermented Carrot/cabbage | *Vibrio* sp. 2521-89 |
| SBP00163 | Fermented Carrot/cabbage | *Vibrio* sp. HBUAS61001 |
| SBP00163 | Fermented Carrot/cabbage | *Vibrio vulnificus* |
| SBP00163 | Fermented Carrot/cabbage | *Vogesella* sp. LIG4 |
| SBP00163 | Fermented Carrot/cabbage | *Weissella cibaria* |
| SBP00163 | Fermented Carrot/cabbage | *Weissella hellenica* |
| SBP00163 | Fermented Carrot/cabbage | *Weissella jogaejeotgali* |
| SBP00163 | Fermented Carrot/cabbage | *Weissella paramesenteroides* |
| SBP00163 | Fermented Carrot/cabbage | *Weissella soli* |
| SBP00163 | Fermented Carrot/cabbage | *Wigglesworthia glossinidia* |
| SBP00163 | Fermented Carrot/cabbage | *Xanthobacter autotrophicus* |
| SBP00163 | Fermented Carrot/cabbage | *Xanthomonas albilineans* |
| SBP00163 | Fermented Carrot/cabbage | *Xanthomonas campestris* |
| SBP00163 | Fermented Carrot/cabbage | *Xanthomonas cassavae* |
| SBP00163 | Fermented Carrot/cabbage | *Xanthomonas citri* |
| SBP00163 | Fermented Carrot/cabbage | *Xanthomonas gardneri* |
| SBP00163 | Fermented Carrot/cabbage | *Xanthomonas oryzae* |
| SBP00163 | Fermented Carrot/cabbage | *Xanthomonas sacchari* |
| SBP00163 | Fermented Carrot/cabbage | *Xanthomonas translucens* |
| SBP00163 | Fermented Carrot/cabbage | *Xanthomonas vasicola* |
| SBP00163 | Fermented Carrot/cabbage | *Xanthomonas vesicatoria* |
| SBP00163 | Fermented Carrot/cabbage | *Xenorhabdus bovienii* |

TABLE 3-continued

List of species identified in each metagenomic sample of each SBP Sample

| SBP ID | SBP Host Common Name | Genus sp. |
|---|---|---|
| SBP00163 | Fermented Carrot/cabbage | Xenorhabdus doucetiae |
| SBP00163 | Fermented Carrot/cabbage | Xenorhabdus hominickii |
| SBP00163 | Fermented Carrot/cabbage | Xenorhabdus nematophila |
| SBP00163 | Fermented Carrot/cabbage | Xenorhabdus poinarii |
| SBP00163 | Fermented Carrot/cabbage | Xylella fastidiosa |
| SBP00163 | Fermented Carrot/cabbage | Yersinia aldovae |
| SBP00163 | Fermented Carrot/cabbage | Yersinia aleksiciae |
| SBP00163 | Fermented Carrot/cabbage | Yersinia enterocolitica |
| SBP00163 | Fermented Carrot/cabbage | Yersinia entomophaga |
| SBP00163 | Fermented Carrot/cabbage | Yersinia frederiksenii |
| SBP00163 | Fermented Carrot/cabbage | Yersinia intermedia |
| SBP00163 | Fermented Carrot/cabbage | Yersinia kristensenii |
| SBP00163 | Fermented Carrot/cabbage | Yersinia massiliensis |
| SBP00163 | Fermented Carrot/cabbage | Yersinia pestis |
| SBP00163 | Fermented Carrot/cabbage | Yersinia pseudotuberculosis |
| SBP00163 | Fermented Carrot/cabbage | Yersinia rohdei |
| SBP00163 | Fermented Carrot/cabbage | Yersinia ruckeri |
| SBP00163 | Fermented Carrot/cabbage | Yersinia similis |
| SBP00163 | Fermented Carrot/cabbage | Zobellella denitrificans |
| SBP00165 | Parsley | [Brevibacterium] frigoritolerans |
| SBP00165 | Parsley | [Enterobacter] lignolyticus |
| SBP00165 | Parsley | [Eubacterium] eligens |
| SBP00165 | Parsley | [Eubacterium] hallii |
| SBP00165 | Parsley | [Eubacterium] rectale |
| SBP00165 | Parsley | [Polyangium] brachysporum |
| SBP00165 | Parsley | [Pseudomonas] mesoacidophila |
| SBP00165 | Parsley | Acetobacter aceti |
| SBP00165 | Parsley | Acetobacter ascendens |
| SBP00165 | Parsley | Acetobacter ghanensis |
| SBP00165 | Parsley | Acetobacter persici |
| SBP00165 | Parsley | Acetobacterium woodii |
| SBP00165 | Parsley | Acetohalobium arabaticum |
| SBP00165 | Parsley | Acetomicrobium mobile |
| SBP00165 | Parsley | Achromobacter denitrificans |
| SBP00165 | Parsley | Achromobacter insolitus |
| SBP00165 | Parsley | Achromobacter sp. AONIH1 |
| SBP00165 | Parsley | Achromobacter sp. B7 |
| SBP00165 | Parsley | Achromobacter sp. MFA1 R4 |
| SBP00165 | Parsley | Achromobacter spanius |
| SBP00165 | Parsley | Achromobacter xylosoxidans |
| SBP00165 | Parsley | Acidiferrobacter sp. SPIII_3 |
| SBP00165 | Parsley | Acidihalobacter ferrooxidans |
| SBP00165 | Parsley | Acidihalobacter prosperus |
| SBP00165 | Parsley | Acidiphilium multivorum |
| SBP00165 | Parsley | Acidipropionibacterium acidipropionici |
| SBP00165 | Parsley | Acidipropionibacterium jensenil |
| SBP00165 | Parsley | Acidipropionibacterium virtanenii |
| SBP00165 | Parsley | Acidisphaera sp. G45-3 |
| SBP00165 | Parsley | Acidithiobacillus ferrivorans |
| SBP00165 | Parsley | Acidovorax avenae |
| SBP00165 | Parsley | Acidovorax carolinensis |
| SBP00165 | Parsley | Acidovorax cattleyae |
| SBP00165 | Parsley | Acidovorax citrulli |
| SBP00165 | Parsley | Acidovorax ebreus |
| SBP00165 | Parsley | Acidovorax sp. 1608163 |
| SBP00165 | Parsley | Acidovorax sp. JS42 |
| SBP00165 | Parsley | Acidovorax sp. KKS102 |
| SBP00165 | Parsley | Acidovorax sp. RAC01 |
| SBP00165 | Parsley | Acidovorax sp. T1 |
| SBP00165 | Parsley | Acinetobacter baumannii |
| SBP00165 | Parsley | Acinetobacter bereziniae |
| SBP00165 | Parsley | Acinetobacter calcoaceticus |
| SBP00165 | Parsley | Acinetobacter equi |
| SBP00165 | Parsley | Acinetobacter guillouiae |
| SBP00165 | Parsley | Acinetobacter indicus |
| SBP00165 | Parsley | Acinetobacter johnsonii |
| SBP00165 | Parsley | Acinetobacter larvae |
| SBP00165 | Parsley | Acinetobacter lwoffii |
| SBP00165 | Parsley | Acinetobacter pittii |
| SBP00165 | Parsley | Acinetobacter soli |
| SBP00165 | Parsley | Acinetobacter sp. ACNIH1 |
| SBP00165 | Parsley | Acinetobacter sp. TGL-Y2 |
| SBP00165 | Parsley | Acinetobacter sp. TTHO-4 |
| SBP00165 | Parsley | Acinetobacter sp. WCHAc010034 |
| SBP00165 | Parsley | Acinetobacter wuhouensis |
| SBP00165 | Parsley | Actinoalloteichus hoggarensis |

TABLE 3-continued

List of species identified in each metagenomic sample of each SBP Sample

| SBP ID | SBP Host Common Name | Genus sp. |
|---|---|---|
| SBP00165 | Parsley | *Actinoalloteichus hymeniacidonis* |
| SBP00165 | Parsley | *Actinoalloteichus* sp. AHMU CJ021 |
| SBP00165 | Parsley | *Actinobacteria bacterium* YIM 96077 |
| SBP00165 | Parsley | *Actinomadura amylolytica* |
| SBP00165 | Parsley | *Actinomyces howellil* |
| SBP00165 | Parsley | *Actinomyces radicidentis* |
| SBP00165 | Parsley | *Actinomyces slackil* |
| SBP00165 | Parsley | *Actinomyces* sp. 2129 |
| SBP00165 | Parsley | *Actinomyces* sp. 299 |
| SBP00165 | Parsley | *Actinomyces* sp. Chiba101 |
| SBP00165 | Parsley | *Actinomyces* sp. oral taxon 414 |
| SBP00165 | Parsley | *Actinomyces* sp. oral taxon 897 |
| SBP00165 | Parsley | *Actinomyces* sp. Z16 |
| SBP00165 | Parsley | *Actinomyces viscosus* |
| SBP00165 | Parsley | *Actinoplanes derwentensis* |
| SBP00165 | Parsley | *Actinoplanes friuliensis* |
| SBP00165 | Parsley | *Actinoplanes missouriensis* |
| SBP00165 | Parsley | *Actinoplanes* sp. ATCC 31351 |
| SBP00165 | Parsley | *Actinoplanes* sp. N902-109 |
| SBP00165 | Parsley | *Actinoplanes* sp. OR16 |
| SBP00165 | Parsley | *Actinoplanes teichomyceticus* |
| SBP00165 | Parsley | *Actinopolymorpha singaporensis* |
| SBP00165 | Parsley | *Actinopolyspora erythraea* |
| SBP00165 | Parsley | *Actinosynnema mirum* |
| SBP00165 | Parsley | *Actinosynnema pretiosum* |
| SBP00165 | Parsley | *Adlercreutzia equolifaciens* |
| SBP00165 | Parsley | *Advenella kashmirensis* |
| SBP00165 | Parsley | *Advenella mimigardefordensis* |
| SBP00165 | Parsley | *Aequorivita* sp. H23M31 |
| SBP00165 | Parsley | *Aerococcus christensenii* |
| SBP00165 | Parsley | *Aeromicrobium choanae* |
| SBP00165 | Parsley | *Aeromicrobium erythreum* |
| SBP00165 | Parsley | *Aeromicrobium marinum* |
| SBP00165 | Parsley | *Aeromicrobium* sp. 592 |
| SBP00165 | Parsley | *Aeromicrobium* sp. A1-2 |
| SBP00165 | Parsley | *Aeromonas caviae* |
| SBP00165 | Parsley | *Aeromonas encheleia* |
| SBP00165 | Parsley | *Aeromonas hydrophila* |
| SBP00165 | Parsley | *Aeromonas media* |
| SBP00165 | Parsley | *Aeromonas phage* CC2 |
| SBP00165 | Parsley | *Aeromonas rivipollensis* |
| SBP00165 | Parsley | *Aeromonas salmonicida* |
| SBP00165 | Parsley | *Aeromonas schubertii* |
| SBP00165 | Parsley | *Aeromonas* sp. |
| SBP00165 | Parsley | *Aeromonas veronii* |
| SBP00165 | Parsley | *Afipia* sp. GAS231 |
| SBP00165 | Parsley | *Agarilytica rhodophyticola* |
| SBP00165 | Parsley | *Agrobacterium fabrum* |
| SBP00165 | Parsley | *Agrobacterium larrymoorei* |
| SBP00165 | Parsley | *Agrobacterium rhizogenes* |
| SBP00165 | Parsley | *Agrobacterium* sp. |
| SBP00165 | Parsley | *Agrobacterium* sp. H13-3 |
| SBP00165 | Parsley | *Agrobacterium* sp. RAC06 |
| SBP00165 | Parsley | *Agrobacterium tumefaciens* |
| SBP00165 | Parsley | *Agrobacterium vitis* |
| SBP00165 | Parsley | *Agrococcus carbonis* |
| SBP00165 | Parsley | *Agrococcus jejuensis* |
| SBP00165 | Parsley | *Agrococcus* sp. SGAir0287 |
| SBP00165 | Parsley | *Agromyces aureus* |
| SBP00165 | Parsley | *Agromyces flavus* |
| SBP00165 | Parsley | *Agromyces* sp. 30A |
| SBP00165 | Parsley | *Agromyces* sp. LHK192 |
| SBP00165 | Parsley | *Ahniella affigens* |
| SBP00165 | Parsley | *Alcaligenes faecalis* |
| SBP00165 | Parsley | *Alcanivorax dieselolei* |
| SBP00165 | Parsley | *Alcanivorax pacificus* |
| SBP00165 | Parsley | *Alcanivorax* sp. N3-2A |
| SBP00165 | Parsley | *Alcanivorax xenomutans* |
| SBP00165 | Parsley | *Alces alces faeces* associated microvirus MP21 4718 |
| SBP00165 | Parsley | *Algibacter alginicilyticus* |
| SBP00165 | Parsley | *Alicycliphilus denitrificans* |
| SBP00165 | Parsley | *Aliivibrio fischeri* |
| SBP00165 | Parsley | *Alkalilimnicola ehrlichii* |
| SBP00165 | Parsley | *Alloactinosynnema* sp. L-07 |
| SBP00165 | Parsley | *Allochromatium vinosum* |
| SBP00165 | Parsley | *Allokutzneria albata* |

TABLE 3-continued

List of species identified in each metagenomic sample of each SBP Sample

| SBP ID | SBP Host Common Name | Genus sp. |
|---|---|---|
| SBP00165 | Parsley | *Alphaproteobacteria bacterium* WS11 |
| SBP00165 | Parsley | *Altererythrobacter atlanticus* |
| SBP00165 | Parsley | *Altererythrobacter dongtanensis* |
| SBP00165 | Parsley | *Altererythrobacter epoxidivorans* |
| SBP00165 | Parsley | *Altererythrobacter ishigakiensis* |
| SBP00165 | Parsley | *Altererythrobacter mangrovi* |
| SBP00165 | Parsley | *Altererythrobacter marensis* |
| SBP00165 | Parsley | *Altererythrobacter namhicola* |
| SBP00165 | Parsley | *Altererythrobacter* sp. B11 |
| SBP00165 | Parsley | *Altererythrobacter* sp. NS1 |
| SBP00165 | Parsley | *Altererythrobacter* sp. ZODW24 |
| SBP00165 | Parsley | *Alteromonas macleodii* |
| SBP00165 | Parsley | *Alteromonas mediterranea* |
| SBP00165 | Parsley | *Alteromonas* sp. RKMC-009 |
| SBP00165 | Parsley | *Aminobacter aminovorans* |
| SBP00165 | Parsley | *Aminobacter* sp. MSH1 |
| SBP00165 | Parsley | *Amycolatopsis albispora* |
| SBP00165 | Parsley | *Amycolatopsis japonica* |
| SBP00165 | Parsley | *Amycolatopsis keratiniphila* |
| SBP00165 | Parsley | *Amycolatopsis mediterranei* |
| SBP00165 | Parsley | *Amycolatopsis methanolica* |
| SBP00165 | Parsley | *Amycolatopsis orientalis* |
| SBP00165 | Parsley | *Amycolatopsis* sp. AA4 |
| SBP00165 | Parsley | *Amycolatopsis* sp. BJA-103 |
| SBP00165 | Parsley | *Anabaena cylindrica* |
| SBP00165 | Parsley | *Anaerolineaceae bacterium* oral taxon 439 |
| SBP00165 | Parsley | *Anaeromyxobacter dehalogenans* |
| SBP00165 | Parsley | *Anaeromyxobacter* sp. Fw109-5 |
| SBP00165 | Parsley | *Anaeromyxobacter* sp. K |
| SBP00165 | Parsley | *Anaerostipes hadrus* |
| SBP00165 | Parsley | *Anderseniella* sp. Alg231-50 |
| SBP00165 | Parsley | *Aneurinibacillus soli* |
| SBP00165 | Parsley | *Aneurinibacillus* sp. XH2 |
| SBP00165 | Parsley | Angelica bushy stunt virus |
| SBP00165 | Parsley | *Antarctobacter heliothermus* |
| SBP00165 | Parsley | *Aquabacterium olei* |
| SBP00165 | Parsley | *Aquaspirillum* sp. LM1 |
| SBP00165 | Parsley | *Aquimarina* sp. AD1 |
| SBP00165 | Parsley | *Aquimarina* sp. AD10 |
| SBP00165 | Parsley | *Aquimarina* sp. BL5 |
| SBP00165 | Parsley | *Aquitalea magnusonii* |
| SBP00165 | Parsley | *Aquitalea* sp. THG-DN7.12 |
| SBP00165 | Parsley | *Aquitalea* sp. USM4 |
| SBP00165 | Parsley | archaeon AArc-SI |
| SBP00165 | Parsley | *Archangium gephyra* |
| SBP00165 | Parsley | *Arcobacter butzleri* |
| SBP00165 | Parsley | *Arcobacter cryaerophilus* |
| SBP00165 | Parsley | *Arcobacter molluscorum* |
| SBP00165 | Parsley | *Arcobacter mytili* |
| SBP00165 | Parsley | *Arcobacter nitrofigilis* |
| SBP00165 | Parsley | *Arcobacter suis* |
| SBP00165 | Parsley | *Arcticibacterium luteifluviistationis* |
| SBP00165 | Parsley | *Arenibacter algicola* |
| SBP00165 | Parsley | *Aromatoleum aromaticum* |
| SBP00165 | Parsley | *Arsenicicoccus* sp. oral taxon 190 |
| SBP00165 | Parsley | *Arthrobacter alpinus* |
| SBP00165 | Parsley | *Arthrobacter crystallopoietes* |
| SBP00165 | Parsley | *Arthrobacter* sp. DCT-5 |
| SBP00165 | Parsley | *Arthrobacter* sp. ERGS1:01 |
| SBP00165 | Parsley | *Arthrobacter* sp. FB24 |
| SBP00165 | Parsley | *Arthrobacter* sp. PGP41 |
| SBP00165 | Parsley | *Arthrobacter* sp. QXT-31 |
| SBP00165 | Parsley | *Arthrobacter* sp. U41 |
| SBP00165 | Parsley | *Arthrobacter* sp. YC-RL1 |
| SBP00165 | Parsley | *Arthrobacter* sp. YN |
| SBP00165 | Parsley | *Arthrobacter* sp. ZXY-2 |
| SBP00165 | Parsley | *Asaia bogorensis* |
| SBP00165 | Parsley | *Asticcacaulis excentricus* |
| SBP00165 | Parsley | *Atlantibacter hermannii* |
| SBP00165 | Parsley | *Atopobium parvulum* |
| SBP00165 | Parsley | *Auraticoccus monumenti* |
| SBP00165 | Parsley | *Aureimonas* sp. AU20 |
| SBP00165 | Parsley | *Austwickia chelonae* |
| SBP00165 | Parsley | *Azoarcus communis* |
| SBP00165 | Parsley | *Azoarcus olearius* |
| SBP00165 | Parsley | *Azoarcus* sp. BH72 |

TABLE 3-continued

List of species identified in each metagenomic sample of each SBP Sample

| SBP ID | SBP Host Common Name | Genus sp. |
|---|---|---|
| SBP00165 | Parsley | *Azoarcus* sp. CIB |
| SBP00165 | Parsley | *Azoarcus* sp. DN11 |
| SBP00165 | Parsley | *Azoarcus* sp. KH32C |
| SBP00165 | Parsley | *Azoarcus* sp. SY39 |
| SBP00165 | Parsley | *Azorhizobium caulinodans* |
| SBP00165 | Parsley | *Azospira oryzae* |
| SBP00165 | Parsley | *Azospirillum brasilense* |
| SBP00165 | Parsley | *Azospirillum humicireducens* |
| SBP00165 | Parsley | *Azospirillum lipoferum* |
| SBP00165 | Parsley | *Azospirillum* sp. CFH 70021 |
| SBP00165 | Parsley | *Azospirillum* sp. M21282 |
| SBP00165 | Parsley | *Azospirillum* sp. TSA2s |
| SBP00165 | Parsley | *Azospirillum* sp. TSH100 |
| SBP00165 | Parsley | *Azospirillum* sp. TSH58 |
| SBP00165 | Parsley | *Azospirillum thiophilum* |
| SBP00165 | Parsley | *Azotobacter chroococcum* |
| SBP00165 | Parsley | *Azotobacter vinelandii* |
| SBP00165 | Parsley | *Bacillus altitudinis* |
| SBP00165 | Parsley | *Bacillus amyloliquefaciens* |
| SBP00165 | Parsley | *Bacillus atrophaeus* |
| SBP00165 | Parsley | *Bacillus cereus* |
| SBP00165 | Parsley | *Bacillus ciccensis* |
| SBP00165 | Parsley | *Bacillus coagulans* |
| SBP00165 | Parsley | *Bacillus cytotoxicus* |
| SBP00165 | Parsley | *Bacillus foraminis* |
| SBP00165 | Parsley | *Bacillus freudenreichii* |
| SBP00165 | Parsley | *Bacillus glycinifermentans* |
| SBP00165 | Parsley | *Bacillus gobiensis* |
| SBP00165 | Parsley | *Bacillus halodurans* |
| SBP00165 | Parsley | *Bacillus halotolerans* |
| SBP00165 | Parsley | *Bacillus kochii* |
| SBP00165 | Parsley | *Bacillus krulwichiae* |
| SBP00165 | Parsley | *Bacillus litoralis* |
| SBP00165 | Parsley | *Bacillus marisflavi* |
| SBP00165 | Parsley | *Bacillus megaterium* |
| SBP00165 | Parsley | *Bacillus methanolicus* |
| SBP00165 | Parsley | *Bacillus mycoides* |
| SBP00165 | Parsley | *Bacillus oceanisediminis* |
| SBP00165 | Parsley | *Bacillus paralicheniformis* |
| SBP00165 | Parsley | *Bacillus pseudofirmus* |
| SBP00165 | Parsley | *Bacillus pseudomycoides* |
| SBP00165 | Parsley | *Bacillus pumilus* |
| SBP00165 | Parsley | *Bacillus safensis* |
| SBP00165 | Parsley | *Bacillus* sp. (in: Bacteria) |
| SBP00165 | Parsley | *Bacillus* sp. FJAT-45348 |
| SBP00165 | Parsley | *Bacillus* sp. Y1 |
| SBP00165 | Parsley | *Bacillus subtilis* |
| SBP00165 | Parsley | *Bacillus thuringiensis* |
| SBP00165 | Parsley | *Bacillus velezensis* |
| SBP00165 | Parsley | *Bacillus wiedmannii* |
| SBP00165 | Parsley | *Bacterioplanes sanyensis* |
| SBP00165 | Parsley | *Bacteriovorax stolpii* |
| SBP00165 | Parsley | *bacterium* enrichment culture clone 2a(2010) |
| SBP00165 | Parsley | *Bacteroides cellulosilyticus* |
| SBP00165 | Parsley | *Bacteroides fragilis* |
| SBP00165 | Parsley | *Bacteroides ovatus* |
| SBP00165 | Parsley | *Bacteroides salanitronis* |
| SBP00165 | Parsley | *Bacteroides thetaiotaomicron* |
| SBP00165 | Parsley | *Basilea psittacipulmonis* |
| SBP00165 | Parsley | *Beijerinckia indica* |
| SBP00165 | Parsley | *Beijerinckiaceae bacterium* |
| SBP00165 | Parsley | *Belliella baltica* |
| SBP00165 | Parsley | *Betaproteobacteria bacterium* GR16-43 |
| SBP00165 | Parsley | *Beutenbergia cavernae* |
| SBP00165 | Parsley | *Bibersteinia trehalosi* |
| SBP00165 | Parsley | *Bifidobacterium bifidum* |
| SBP00165 | Parsley | *Bifidobacterium breve* |
| SBP00165 | Parsley | *Bifidobacterium choerinum* |
| SBP00165 | Parsley | *Bifidobacterium gallinarum* |
| SBP00165 | Parsley | *Bifidobacterium longum* |
| SBP00165 | Parsley | *Bifidobacterium pseudolongum* |
| SBP00165 | Parsley | *Bifidobacterium scardovii* |
| SBP00165 | Parsley | *Blastochloris* sp. GI |
| SBP00165 | Parsley | *Blastochloris viridis* |
| SBP00165 | Parsley | *Blastococcus saxobsidens* |
| SBP00165 | Parsley | *Blastomonas fulva* |

TABLE 3-continued

List of species identified in each metagenomic sample of each SBP Sample

| SBP ID | SBP Host Common Name | Genus sp. |
|---|---|---|
| SBP00165 | Parsley | *Blastomonas* sp. RAC04 |
| SBP00165 | Parsley | *Bordetella avium* |
| SBP00165 | Parsley | *Bordetella bronchialis* |
| SBP00165 | Parsley | *Bordetella bronchiseptica* |
| SBP00165 | Parsley | *Bordetella flabilis* |
| SBP00165 | Parsley | *Bordetella* genomosp. 13 |
| SBP00165 | Parsley | *Bordetella* genomosp. 6 |
| SBP00165 | Parsley | *Bordetella* genomosp. 8 |
| SBP00165 | Parsley | *Bordetella* genomosp. 9 |
| SBP00165 | Parsley | *Bordetella hinzii* |
| SBP00165 | Parsley | *Bordetella holmesii* |
| SBP00165 | Parsley | *Bordetella parapertussis* |
| SBP00165 | Parsley | *Bordetella petrii* |
| SBP00165 | Parsley | *Bordetella pseudohinzii* |
| SBP00165 | Parsley | *Bordetella* sp. H567 |
| SBP00165 | Parsley | *Bordetella* sp. HZ20 |
| SBP00165 | Parsley | *Bordetella* sp. 1329 |
| SBP00165 | Parsley | *Bordetella* sp. N |
| SBP00165 | Parsley | *Bordetella trematum* |
| SBP00165 | Parsley | *Bosea* sp. AS-1 |
| SBP00165 | Parsley | *Bosea* sp. PAMC 26642 |
| SBP00165 | Parsley | *Bosea* sp. RAC05 |
| SBP00165 | Parsley | *Bosea* sp. Tri-49 |
| SBP00165 | Parsley | *Bosea vaviloviae* |
| SBP00165 | Parsley | *Brachybacterium faecium* |
| SBP00165 | Parsley | *Brachybacterium ginsengisoli* |
| SBP00165 | Parsley | *Brachybacterium saurashtrense* |
| SBP00165 | Parsley | *Brachybacterium* sp. P6-10-X1 |
| SBP00165 | Parsley | *Brachybacterium* sp. VM2412 |
| SBP00165 | Parsley | *Brachybacterium* sp. VR2415 |
| SBP00165 | Parsley | *Brachyspira intermedia* |
| SBP00165 | Parsley | *Brachyspira pilosicoli* |
| SBP00165 | Parsley | *Bradymonas sediminis* |
| SBP00165 | Parsley | *Bradyrhizobiaceae* bacterium SG-6C |
| SBP00165 | Parsley | *Bradyrhizobium diazoefficiens* |
| SBP00165 | Parsley | *Bradyrhizobium erythrophlei* |
| SBP00165 | Parsley | *Bradyrhizobium guangdongense* |
| SBP00165 | Parsley | *Bradyrhizobium guangxiense* |
| SBP00165 | Parsley | *Bradyrhizobium icense* |
| SBP00165 | Parsley | *Bradyrhizobium japonicum* |
| SBP00165 | Parsley | *Bradyrhizobium lablabi* |
| SBP00165 | Parsley | *Bradyrhizobium oligotrophicum* |
| SBP00165 | Parsley | *Bradyrhizobium ottawaense* |
| SBP00165 | Parsley | *Bradyrhizobium* sp. |
| SBP00165 | Parsley | *Bradyrhizobium* sp. 2 3951MB |
| SBP00165 | Parsley | *Bradyrhizobium* sp. 3 |
| SBP00165 | Parsley | *Bradyrhizobium* sp. 3 85S1MB |
| SBP00165 | Parsley | *Bradyrhizobium* sp. BTAi1 |
| SBP00165 | Parsley | *Bradyrhizobium* sp. CCBAU 51670 |
| SBP00165 | Parsley | *Bradyrhizobium* sp. CCBAU 51778 |
| SBP00165 | Parsley | *Bradyrhizobium* sp. CCGE-LA001 |
| SBP00165 | Parsley | *Bradyrhizobium* sp. ORS 278 |
| SBP00165 | Parsley | *Bradyrhizobium* sp. ORS 285 |
| SBP00165 | Parsley | *Bradyrhizobium* sp. ORS 3257 |
| SBP00165 | Parsley | *Bradyrhizobium* sp. S23321 |
| SBP00165 | Parsley | *Bradyrhizobium* sp. SK17 |
| SBP00165 | Parsley | *Bradyrhizobium* sp. WSM471 |
| SBP00165 | Parsley | *Brenneria goodwinii* |
| SBP00165 | Parsley | *Brenneria rubrifaciens* |
| SBP00165 | Parsley | *Breoghania* sp. L-A4 |
| SBP00165 | Parsley | *Brevibacillus agri* |
| SBP00165 | Parsley | *Brevibacillus brevis* |
| SBP00165 | Parsley | *Brevibacillus laterosporus* |
| SBP00165 | Parsley | *Brevibacillus* sp. SCSIO 07484 |
| SBP00165 | Parsley | *Brevibacterium aurantiacum* |
| SBP00165 | Parsley | *Brevibacterium linens* |
| SBP00165 | Parsley | *Brevibacterium sandarakinum* |
| SBP00165 | Parsley | *Brevibacterium siliguriense* |
| SBP00165 | Parsley | *Brevirhabdus pacifica* |
| SBP00165 | Parsley | *Brevundimonas diminuta* |
| SBP00165 | Parsley | *Brevundimonas naejangsanensis* |
| SBP00165 | Parsley | *Brevundimonas* sp. DS20 |
| SBP00165 | Parsley | *Brevundimonas* sp. GW460-12-10-14-LB2 |
| SBP00165 | Parsley | *Brevundimonas* sp. LM2 |
| SBP00165 | Parsley | *Brevundimonas subvibrioides* |
| SBP00165 | Parsley | *Brevundimonas vancanneytii* |

TABLE 3-continued

List of species identified in each metagenomic sample of each SBP Sample

| SBP ID | SBP Host Common Name | Genus sp. |
|---|---|---|
| SBP00165 | Parsley | *Brevundimonas vesicularis* |
| SBP00165 | Parsley | *Buchnera aphidicola* |
| SBP00165 | Parsley | *Burkholderia ambifaria* |
| SBP00165 | Parsley | *Burkholderia anthina* |
| SBP00165 | Parsley | *Burkholderia cenocepacia* |
| SBP00165 | Parsley | *Burkholderia cepacia* |
| SBP00165 | Parsley | *Burkholderia contaminans* |
| SBP00165 | Parsley | *Burkholderia diffusa* |
| SBP00165 | Parsley | *Burkholderia gladioli* |
| SBP00165 | Parsley | *Burkholderia glumae* |
| SBP00165 | Parsley | *Burkholderia insecticola* |
| SBP00165 | Parsley | *Burkholderia lata* |
| SBP00165 | Parsley | *Burkholderia metallica* |
| SBP00165 | Parsley | *Burkholderia multivorans* |
| SBP00165 | Parsley | *Burkholderia oklahomensis* |
| SBP00165 | Parsley | *Burkholderia plantarii* |
| SBP00165 | Parsley | *Burkholderia pseudomallei* |
| SBP00165 | Parsley | *Burkholderia pseudomultivorans* |
| SBP00165 | Parsley | *Burkholderia pyrrocinia* |
| SBP00165 | Parsley | *Burkholderia seminalis* |
| SBP00165 | Parsley | *Burkholderia* sp. AD24 |
| SBP00165 | Parsley | *Burkholderia* sp. BDU6 |
| SBP00165 | Parsley | *Burkholderia* sp. BDU8 |
| SBP00165 | Parsley | *Burkholderia* sp. Bp7605 |
| SBP00165 | Parsley | *Burkholderia* sp. CCGE1001 |
| SBP00165 | Parsley | *Burkholderia* sp. CCGE1002 |
| SBP00165 | Parsley | *Burkholderia* sp. CCGE1003 |
| SBP00165 | Parsley | *Burkholderia* sp. HB1 |
| SBP00165 | Parsley | *Burkholderia* sp. IDO3 |
| SBP00165 | Parsley | *Burkholderia* sp. JP2-270 |
| SBP00165 | Parsley | *Burkholderia* sp. KJ006 |
| SBP00165 | Parsley | *Burkholderia* sp. KK1 |
| SBP00165 | Parsley | *Burkholderia* sp. LA-2-3-30-S1-D2 |
| SBP00165 | Parsley | *Burkholderia* sp. MSMB0266 |
| SBP00165 | Parsley | *Burkholderia* sp. MSMB0856 |
| SBP00165 | Parsley | *Burkholderia* sp. NRF60-BP8 |
| SBP00165 | Parsley | *Burkholderia* sp. OLGA172 |
| SBP00165 | Parsley | *Burkholderia* sp. PAMC 26561 |
| SBP00165 | Parsley | *Burkholderia* sp. PAMC 28687 |
| SBP00165 | Parsley | *Burkholderia* sp. RPE67 |
| SBP00165 | Parsley | *Burkholderia* sp. YI23 |
| SBP00165 | Parsley | *Burkholderia stabilis* |
| SBP00165 | Parsley | *Burkholderia stagnalis* |
| SBP00165 | Parsley | *Burkholderia territorii* |
| SBP00165 | Parsley | *Burkholderia thailandensis* |
| SBP00165 | Parsley | *Burkholderia ubonensis* |
| SBP00165 | Parsley | *Burkholderia vietnamiensis* |
| SBP00165 | Parsley | *Burkholderiales bacterium* GJ-E10 |
| SBP00165 | Parsley | *Burkholderiales bacterium* JOSHI_001 |
| SBP00165 | Parsley | *Buttiauxella* sp. 3AFRM03 |
| SBP00165 | Parsley | *Caldilinea aerophila* |
| SBP00165 | Parsley | *Calditerrivibrio nitroreducens* |
| SBP00165 | Parsley | *Calothrix parasitica* |
| SBP00165 | Parsley | *Calothrix* sp. NIES-2100 |
| SBP00165 | Parsley | *Calothrix* sp. NIES-3974 |
| SBP00165 | Parsley | *Calothrix* sp. PCC 7507 |
| SBP00165 | Parsley | *Calyptogena okutanii thioautotrophic gill* symbiont |
| SBP00165 | Parsley | *Campylobacter coli* |
| SBP00165 | Parsley | *Campylobacter insulaenigrae* |
| SBP00165 | Parsley | *Campylobacter lari* |
| SBP00165 | Parsley | *Campylobacter pinnipediorum* |
| SBP00165 | Parsley | *Campylobacter upsaliensis* |
| SBP00165 | Parsley | *Candidatus Accumulibacter phosphatis* |
| SBP00165 | Parsley | *Candidatus Coxiella mudrowiae* |
| SBP00165 | Parsley | *Candidatus Cyclonatronum proteinivorum* |
| SBP00165 | Parsley | *Candidatus Desulfofervidus auxilii* |
| SBP00165 | Parsley | *Candidatus Desulforudis audaxviator* |
| SBP00165 | Parsley | *Candidatus Filomicrobium marinum* |
| SBP00165 | Parsley | *Candidatus Hamiltonella defensa* |
| SBP00165 | Parsley | *Candidatus Methanomethylophilus alvus* |
| SBP00165 | Parsley | *Candidatus Methylopumilus planktonicus* |
| SBP00165 | Parsley | *Candidatus Nitrosocosmicus franklandus* |
| SBP00165 | Parsley | *Candidatus Nitrosopelagicus brevis* |
| SBP00165 | Parsley | *Candidatus Nitrospira inopinata* |
| SBP00165 | Parsley | *Candidatus Phaeomarinobacter ectocarpi* |
| SBP00165 | Parsley | *Candidatus Planktophila lacus* |

TABLE 3-continued

List of species identified in each metagenomic sample of each SBP Sample

| SBP ID | SBP Host Common Name | Genus sp. |
|---|---|---|
| SBP00165 | Parsley | Candidatus Promineofilum breve |
| SBP00165 | Parsley | Candidatus Protochlamydia naegleriophila |
| SBP00165 | Parsley | Candidatus Pseudomonas adelgestsugas |
| SBP00165 | Parsley | Candidatus Rickettsiella viridis |
| SBP00165 | Parsley | Candidatus Sodalis pierantonius |
| SBP00165 | Parsley | Candidatus Solibacter usitatus |
| SBP00165 | Parsley | Candidatus Symbiobacter mobilis |
| SBP00165 | Parsley | Candidatus Thiodictyon syntrophicum |
| SBP00165 | Parsley | Capnocytophaga canimorsus |
| SBP00165 | Parsley | Capnocytophaga haemolytica |
| SBP00165 | Parsley | Capnocytophaga ochracea |
| SBP00165 | Parsley | Cardiobacterium hominis |
| SBP00165 | Parsley | Carnation etched ring virus |
| SBP00165 | Parsley | Carnobacterium inhibens |
| SBP00165 | Parsley | Carnobacterium maltaromaticum |
| SBP00165 | Parsley | Carnobacterium sp. 17-4 |
| SBP00165 | Parsley | Castellaniella defragrans |
| SBP00165 | Parsley | Catenovulum sp. CCB-QB4 |
| SBP00165 | Parsley | Catenulispora acidiphila |
| SBP00165 | Parsley | Caulobacter flavus |
| SBP00165 | Parsley | Caulobacter henricii |
| SBP00165 | Parsley | Caulobacter mirabilis |
| SBP00165 | Parsley | Caulobacter segnis |
| SBP00165 | Parsley | Caulobacter sp. FWC26 |
| SBP00165 | Parsley | Caulobacter sp. K31 |
| SBP00165 | Parsley | Caulobacter vibrioides |
| SBP00165 | Parsley | Cedecea lapagei |
| SBP00165 | Parsley | Cedecea neteri |
| SBP00165 | Parsley | Celeribacter baekdonensis |
| SBP00165 | Parsley | Celeribacter ethanolicus |
| SBP00165 | Parsley | Celeribacter indicus |
| SBP00165 | Parsley | Celeribacter manganoxidans |
| SBP00165 | Parsley | Cellulomonas fimi |
| SBP00165 | Parsley | Cellulomonas flavigena |
| SBP00165 | Parsley | Cellulomonas gilvus |
| SBP00165 | Parsley | Cellulomonas sp. PSBB021 |
| SBP00165 | Parsley | Cellulophaga algicola |
| SBP00165 | Parsley | Cellulophaga lytica |
| SBP00165 | Parsley | Cellulosilyticum sp. WCF-2 |
| SBP00165 | Parsley | Cellulosimicrobium cellulans |
| SBP00165 | Parsley | Cellulosimicrobium sp. TH-20 |
| SBP00165 | Parsley | Cellvibrio japonicus |
| SBP00165 | Parsley | Cellvibrio sp. PSBB006 |
| SBP00165 | Parsley | Cellvibrio sp. PSBB023 |
| SBP00165 | Parsley | Chania multitudinisentens |
| SBP00165 | Parsley | Chelativorans sp. BNC1 |
| SBP00165 | Parsley | Chelatococcus daeguensis |
| SBP00165 | Parsley | Chelatococcus sp. CO-6 |
| SBP00165 | Parsley | Chloracidobacterium thermophilum |
| SBP00165 | Parsley | Chondromyces crocatus |
| SBP00165 | Parsley | Chromatiaceae bacterium 2141T.STBD.0c.01a |
| SBP00165 | Parsley | Chromobacterium rhizoryzae |
| SBP00165 | Parsley | Chromobacterium sp. ATCC 53434 |
| SBP00165 | Parsley | Chromobacterium sp. IIBBL 112-1 |
| SBP00165 | Parsley | Chromobacterium vaccinii |
| SBP00165 | Parsley | Chromobacterium violaceum |
| SBP00165 | Parsley | Chromohalobacter salexigens |
| SBP00165 | Parsley | Chroococcidiopsis thermalis |
| SBP00165 | Parsley | Chryseobacterium arthrosphaerae |
| SBP00165 | Parsley | Chryseobacterium balustinum |
| SBP00165 | Parsley | Chryseobacterium bernardetii |
| SBP00165 | Parsley | Chryseobacterium gleum |
| SBP00165 | Parsley | Chryseobacterium indologenes |
| SBP00165 | Parsley | Chryseobacterium indoltheticum |
| SBP00165 | Parsley | Chryseobacterium piperi |
| SBP00165 | Parsley | Chryseobacterium sp. 1751E7 |
| SBP00165 | Parsley | Chryseobacterium sp. 3008163 |
| SBP00165 | Parsley | Chryseobacterium sp. G0186 |
| SBP00165 | Parsley | Chryseobacterium sp. G0201 |
| SBP00165 | Parsley | Chryseobacterium sp. T16E-39 |
| SBP00165 | Parsley | Chryseolinea sp. KIS68-18 |
| SBP00165 | Parsley | Chrysochromulina ericina virus |
| SBP00165 | Parsley | Citrobacter farmeri |
| SBP00165 | Parsley | Citrobacter freundii |
| SBP00165 | Parsley | Citrobacter koseri |
| SBP00165 | Parsley | Citrobacter rodentium |

TABLE 3-continued

List of species identified in each metagenomic sample of each SBP Sample

| SBP ID | SBP Host Common Name | Genus sp. |
|---|---|---|
| SBP00165 | Parsley | *Citrobacter* sp. CRE-46 |
| SBP00165 | Parsley | *Citromicrobium* sp. JL477 |
| SBP00165 | Parsley | *Clavibacter michiganensis* |
| SBP00165 | Parsley | *Cloacibacterium normanense* |
| SBP00165 | Parsley | *Clostridiaceae bacterium* 1450207 |
| SBP00165 | Parsley | *Clostridiales bacterium* 70B-A |
| SBP00165 | Parsley | *Clostridioides difficile* |
| SBP00165 | Parsley | *Clostridium baratii* |
| SBP00165 | Parsley | *Clostridium beijerinckii* |
| SBP00165 | Parsley | *Clostridium botulinum* |
| SBP00165 | Parsley | *Clostridium butyricum* |
| SBP00165 | Parsley | *Clostridium carboxidivorans* |
| SBP00165 | Parsley | *Clostridium cellulovorans* |
| SBP00165 | Parsley | *Clostridium estertheticum* |
| SBP00165 | Parsley | *Clostridium formicaceticum* |
| SBP00165 | Parsley | *Clostridium kluyveri* |
| SBP00165 | Parsley | *Clostridium novyi* |
| SBP00165 | Parsley | *Clostridium pasteurianum* |
| SBP00165 | Parsley | *Clostridium perfringens* |
| SBP00165 | Parsley | *Clostridium saccharoperbutylacetonicum* |
| SBP00165 | Parsley | *Clostridium* sp. DL-VIII |
| SBP00165 | Parsley | *Clostridium* sp. JN-1 |
| SBP00165 | Parsley | *Clostridium taeniosporum* |
| SBP00165 | Parsley | *Clostridium tyrobutyricum* |
| SBP00165 | Parsley | *Cnuibacter physcomitrellae* |
| SBP00165 | Parsley | *Cohaesibacter* sp. ES.047 |
| SBP00165 | Parsley | *Collimonas arenae* |
| SBP00165 | Parsley | *Collimonas fungivorans* |
| SBP00165 | Parsley | *Collimonas pratensis* |
| SBP00165 | Parsley | *Collinsella aerofaciens* |
| SBP00165 | Parsley | *Colwellia psychrerythraea* |
| SBP00165 | Parsley | *Colwellia* sp. PAMC 20917 |
| SBP00165 | Parsley | *Comamonas aquatica* |
| SBP00165 | Parsley | *Comamonas kerstersii* |
| SBP00165 | Parsley | *Comamonas serinivorans* |
| SBP00165 | Parsley | *Comamonas terrigena* |
| SBP00165 | Parsley | *Comamonas testosteroni* |
| SBP00165 | Parsley | *Comamonas thiooxydans* |
| SBP00165 | Parsley | *Conexibacter woesei* |
| SBP00165 | Parsley | *Confluentimicrobium* sp. EMB200-NS6 |
| SBP00165 | Parsley | *Congregibacter litoralis* |
| SBP00165 | Parsley | *Corallococcus coralloides* |
| SBP00165 | Parsley | *Corynebacterium atypicum* |
| SBP00165 | Parsley | *Corynebacterium casei* |
| SBP00165 | Parsley | *Corynebacterium choanis* |
| SBP00165 | Parsley | *Corynebacterium efficiens* |
| SBP00165 | Parsley | *Corynebacterium frankenforstense* |
| SBP00165 | Parsley | *Corynebacterium glutamicum* |
| SBP00165 | Parsley | *Corynebacterium glyciniphilum* |
| SBP00165 | Parsley | *Corynebacterium halotolerans* |
| SBP00165 | Parsley | *Corynebacterium humireducens* |
| SBP00165 | Parsley | *Corynebacterium imitans* |
| SBP00165 | Parsley | *Corynebacterium jeikeium* |
| SBP00165 | Parsley | *Corynebacterium marinum* |
| SBP00165 | Parsley | *Corynebacterium maris* |
| SBP00165 | Parsley | *Corynebacterium mycetoides* |
| SBP00165 | Parsley | *Corynebacterium phocae* |
| SBP00165 | Parsley | *Corynebacterium pseudopelargi* |
| SBP00165 | Parsley | *Corynebacterium simulans* |
| SBP00165 | Parsley | *Corynebacterium* sp. 2183 |
| SBP00165 | Parsley | *Corynebacterium* sp. 2184 |
| SBP00165 | Parsley | *Corynebacterium sphenisci* |
| SBP00165 | Parsley | *Corynebacterium timonense* |
| SBP00165 | Parsley | *Corynebacterium vitaeruminis* |
| SBP00165 | Parsley | *Corynebacterium xerosis* |
| SBP00165 | Parsley | *Crenobacter* sp. K1W11S-77 |
| SBP00165 | Parsley | *Crinalium epipsammum* |
| SBP00165 | Parsley | *Croceicoccus marinus* |
| SBP00165 | Parsley | *Croceicoccus naphthovorans* |
| SBP00165 | Parsley | *Cronobacter condimenti* |
| SBP00165 | Parsley | *Cronobacter dublinensis* |
| SBP00165 | Parsley | *Cronobacter malonaticus* |
| SBP00165 | Parsley | *Cronobacter muytjensii* |
| SBP00165 | Parsley | *Cronobacter sakazakii* |
| SBP00165 | Parsley | *Cronobacter turicensis* |
| SBP00165 | Parsley | *Cronobacter universalis* |

TABLE 3-continued

List of species identified in each metagenomic sample of each SBP Sample

| SBP ID | SBP Host Common Name | Genus sp. |
|---|---|---|
| SBP00165 | Parsley | *Cryobacterium arcticum* |
| SBP00165 | Parsley | *Cryobacterium* sp. GCJ02 |
| SBP00165 | Parsley | *Cryobacterium* sp. LW097 |
| SBP00165 | Parsley | *Cupriavidus basilensis* |
| SBP00165 | Parsley | *Cupriavidus gilardii* |
| SBP00165 | Parsley | *Cupriavidus metallidurans* |
| SBP00165 | Parsley | *Cupriavidus nantongensis* |
| SBP00165 | Parsley | *Cupriavidus necator* |
| SBP00165 | Parsley | *Cupriavidus oxalaticus* |
| SBP00165 | Parsley | *Cupriavidus pauculus* |
| SBP00165 | Parsley | *Cupriavidus pinatubonensis* |
| SBP00165 | Parsley | *Cupriavidus* sp. USMAA1020 |
| SBP00165 | Parsley | *Cupriavidus* sp. USMAA2-4 |
| SBP00165 | Parsley | *Cupriavidus* sp. USMAHM13 |
| SBP00165 | Parsley | *Cupriavidus taiwanensis* |
| SBP00165 | Parsley | *Curtobacterium pusillum* |
| SBP00165 | Parsley | *Curtobacterium* sp. BH-2-1-1 |
| SBP00165 | Parsley | *Curtobacterium* sp. MR_MD2014 |
| SBP00165 | Parsley | *Curtobacterium* sp. SGAir0471 |
| SBP00165 | Parsley | *Curvibacter* sp. AEP1-3 |
| SBP00165 | Parsley | *Cutibacterium acnes* |
| SBP00165 | Parsley | *Cutibacterium avidum* |
| SBP00165 | Parsley | *Cyanobium gracile* |
| SBP00165 | Parsley | *Cyanothece* sp. PCC 7424 |
| SBP00165 | Parsley | *Cyanothece* sp. PCC 7822 |
| SBP00165 | Parsley | *Cyclobacterium amurskyense* |
| SBP00165 | Parsley | *Cyclobacterium marinum* |
| SBP00165 | Parsley | *Cyprinid* herpesvirus 1 |
| SBP00165 | Parsley | *Cystobacter fuscus* |
| SBP00165 | Parsley | *Cytophaga hutchinsonii* |
| SBP00165 | Parsley | *Dechloromonas aromatica* |
| SBP00165 | Parsley | *Dechloromonas* sp. HYN0024 |
| SBP00165 | Parsley | *Defluviimonas alba* |
| SBP00165 | Parsley | *Deinococcus actinosclerus* |
| SBP00165 | Parsley | *Deinococcus deserti* |
| SBP00165 | Parsley | *Deinococcus ficus* |
| SBP00165 | Parsley | *Deinococcus geothermalis* |
| SBP00165 | Parsley | *Deinococcus gobiensis* |
| SBP00165 | Parsley | *Deinococcus irradiatisoli* |
| SBP00165 | Parsley | *Deinococcus maricopensis* |
| SBP00165 | Parsley | *Deinococcus peraridilitoris* |
| SBP00165 | Parsley | *Deinococcus proteolyticus* |
| SBP00165 | Parsley | *Deinococcus puniceus* |
| SBP00165 | Parsley | *Deinococcus radiodurans* |
| SBP00165 | Parsley | *Deinococcus soli* Cha et al. 2016 |
| SBP00165 | Parsley | *Deinococcus* sp. NW-56 |
| SBP00165 | Parsley | *Deinococcus swuensis* |
| SBP00165 | Parsley | *Delftia acidovorans* |
| SBP00165 | Parsley | *Delftia* sp. |
| SBP00165 | Parsley | *Delftia* sp. Cs1-4 |
| SBP00165 | Parsley | *Delftia* sp. HK171 |
| SBP00165 | Parsley | *Delftia tsuruhatensis* |
| SBP00165 | Parsley | *Dermacoccus nishinomiyaensis* |
| SBP00165 | Parsley | *Desulfarculus baarsii* |
| SBP00165 | Parsley | *Desulfitobacterium dichloroeliminans* |
| SBP00165 | Parsley | *Desulfobacca acetoxidans* |
| SBP00165 | Parsley | *Desulfobacter hydrogenophilus* |
| SBP00165 | Parsley | *Desulfobulbus oralis* |
| SBP00165 | Parsley | *Desulfococcus multivorans* |
| SBP00165 | Parsley | *Desulfococcus oleovorans* |
| SBP00165 | Parsley | *Desulfohalobium retbaense* |
| SBP00165 | Parsley | *Desulfomicrobium baculatum* |
| SBP00165 | Parsley | *Desulfomicrobium orale* |
| SBP00165 | Parsley | *Desulfomonile tiedjei* |
| SBP00165 | Parsley | *Desulfosporosinus orientis* |
| SBP00165 | Parsley | *Desulfovibrio africanus* |
| SBP00165 | Parsley | *Desulfovibrio alaskensis* |
| SBP00165 | Parsley | *Desulfovibrio carbinolicus* |
| SBP00165 | Parsley | *Desulfovibrio desulfuricans* |
| SBP00165 | Parsley | *Desulfovibrio fairfieldensis* |
| SBP00165 | Parsley | *Desulfovibrio ferrophilus* |
| SBP00165 | Parsley | *Desulfovibrio gigas* |
| SBP00165 | Parsley | *Desulfovibrio magneticus* |
| SBP00165 | Parsley | *Desulfovibrio* sp. FW1012B |
| SBP00165 | Parsley | *Desulfovibrio vulgaris* |
| SBP00165 | Parsley | *Desulfuromonas soudanensis* |

TABLE 3-continued

List of species identified in each metagenomic sample of each SBP Sample

| SBP ID | SBP Host Common Name | Genus sp. |
|---|---|---|
| SBP00165 | Parsley | *Desulfuromonas* sp. DDH964 |
| SBP00165 | Parsley | *Devosia* sp. 1566 |
| SBP00165 | Parsley | *Devosia* sp. A16 |
| SBP00165 | Parsley | *Devosia* sp. H5989 |
| SBP00165 | Parsley | *Devosia* sp. I507 |
| SBP00165 | Parsley | *Diaphorobacter polyhydroxybutyrativorans* |
| SBP00165 | Parsley | *Dickeya chrysanthemi* |
| SBP00165 | Parsley | *Dickeya dadantii* |
| SBP00165 | Parsley | *Dickeya dianthicola* |
| SBP00165 | Parsley | *Dickeya paradisiaca* |
| SBP00165 | Parsley | *Dickeya solani* |
| SBP00165 | Parsley | *Dickeya* sp. NCPPB 3274 |
| SBP00165 | Parsley | *Dickeya* sp. NCPPB 569 |
| SBP00165 | Parsley | *Dickeya* sp. Secpp 1600 |
| SBP00165 | Parsley | *Dickeya zeae* |
| SBP00165 | Parsley | *Dietzia lutea* |
| SBP00165 | Parsley | *Dietzia psychralcaliphila* |
| SBP00165 | Parsley | *Dietzia* sp. JS16-p6b |
| SBP00165 | Parsley | *Dietzia timorensis* |
| SBP00165 | Parsley | *Dinoroseobacter shibae* |
| SBP00165 | Parsley | *Dokdonella koreensis* |
| SBP00165 | Parsley | *Dyadobacter fermentans* |
| SBP00165 | Parsley | *Dyella japonica* |
| SBP00165 | Parsley | *Dyella thiooxydans* |
| SBP00165 | Parsley | *Echinicola rosea* |
| SBP00165 | Parsley | *Ectothiorhodospira haloalkaliphila* |
| SBP00165 | Parsley | *Ectothiorhodospira* sp. BSL-9 |
| SBP00165 | Parsley | *Edwardsiella hoshinae* |
| SBP00165 | Parsley | *Edwardsiella ictaluri* |
| SBP00165 | Parsley | *Edwardsiella piscicida* |
| SBP00165 | Parsley | *Edwardsiella tarda* |
| SBP00165 | Parsley | *Eggerthella lenta* |
| SBP00165 | Parsley | *Eggerthella* sp. YY7918 |
| SBP00165 | Parsley | *Egibacter rhizosphaerae* |
| SBP00165 | Parsley | *Egicoccus halophilus* |
| SBP00165 | Parsley | *Ehrlichia ruminantium* |
| SBP00165 | Parsley | *Eikenella corrodens* |
| SBP00165 | Parsley | *Elizabethkingia anophelis* |
| SBP00165 | Parsley | *Emcibacter congregatus* |
| SBP00165 | Parsley | endosymbiont of *Acanthamoeba* sp. UWC8 |
| SBP00165 | Parsley | endosymbiont of unidentified scaly snail isolate Monju |
| SBP00165 | Parsley | *Endozoicomonas montiporae* |
| SBP00165 | Parsley | *Ensifer adhaerens* |
| SBP00165 | Parsley | *Ensifer sojae* |
| SBP00165 | Parsley | *Enterobacter asburiae* |
| SBP00165 | Parsley | *Enterobacter bugandensis* |
| SBP00165 | Parsley | *Enterobacter cancerogenus* |
| SBP00165 | Parsley | *Enterobacter cloacae* |
| SBP00165 | Parsley | *Enterobacter cloacae* complex sp. |
| SBP00165 | Parsley | *Enterobacter hormaechei* |
| SBP00165 | Parsley | *Enterobacter ludwigii* |
| SBP00165 | Parsley | *Enterobacter roggenkampii* |
| SBP00165 | Parsley | *Enterobacter soli* |
| SBP00165 | Parsley | *Enterobacter* sp. 638 |
| SBP00165 | Parsley | *Enterobacter* sp. FY-07 |
| SBP00165 | Parsley | *Enterobacter* sp. R4-368 |
| SBP00165 | Parsley | *Enterobacter* sp. SA187 |
| SBP00165 | Parsley | *Enterobacteriaceae bacterium* ENNIH1 |
| SBP00165 | Parsley | *Enterobacteriaceae bacterium* strain FGI 57 |
| SBP00165 | Parsley | *Enterococcus durans* |
| SBP00165 | Parsley | *Enterococcus faecalis* |
| SBP00165 | Parsley | *Enterococcus faecium* |
| SBP00165 | Parsley | *Entomoplasma freundtii* |
| SBP00165 | Parsley | *Epibacterium mobile* |
| SBP00165 | Parsley | *Ereboglobus luteus* |
| SBP00165 | Parsley | *Erwinia amylovora* |
| SBP00165 | Parsley | *Erwinia billingiae* |
| SBP00165 | Parsley | *Erwinia gerundensis* |
| SBP00165 | Parsley | *Erwinia pyrifoliae* |
| SBP00165 | Parsley | *Erwinia* sp. |
| SBP00165 | Parsley | *Erwinia* sp. Ejp617 |
| SBP00165 | Parsley | *Erwinia tasmaniensis* |
| SBP00165 | Parsley | *Erythrobacter atlanticus* |
| SBP00165 | Parsley | *Erythrobacter flavus* |
| SBP00165 | Parsley | *Erythrobacter gangjinensis* |
| SBP00165 | Parsley | *Erythrobacter litoralis* |

TABLE 3-continued

List of species identified in each metagenomic sample of each SBP Sample

| SBP ID | SBP Host Common Name | Genus sp. |
|---|---|---|
| SBP00165 | Parsley | *Erythrobacter seohaensis* |
| SBP00165 | Parsley | *Erythrobacter* sp. Alg231-14 |
| SBP00165 | Parsley | *Erythrobacter* sp. HKB08 |
| SBP00165 | Parsley | *Erythrobacter* sp. HL-111 |
| SBP00165 | Parsley | *Erythrobacter* sp. KY5 |
| SBP00165 | Parsley | *Erythrobacter* sp. YH-07 |
| SBP00165 | Parsley | *Escherichia albertii* |
| SBP00165 | Parsley | *Escherichia coli* |
| SBP00165 | Parsley | *Escherichia fergusonii* |
| SBP00165 | Parsley | *Escherichia* sp. E4742 |
| SBP00165 | Parsley | *Euzebya* sp. DY32-46 |
| SBP00165 | Parsley | *Exiguobacterium* sp. N4-1P |
| SBP00165 | Parsley | *Fabibacter pacificus* |
| SBP00165 | Parsley | *Faecalibacterium prausnitzii* |
| SBP00165 | Parsley | *Ferrimonas balearica* |
| SBP00165 | Parsley | *Ferriphaselus amnicola* |
| SBP00165 | Parsley | *Fervidobacterium pennivorans* |
| SBP00165 | Parsley | *Fibrella aestuarina* |
| SBP00165 | Parsley | *Fibrella* sp. ES10-3-2-2 |
| SBP00165 | Parsley | *Filimonas lacunae* |
| SBP00165 | Parsley | *Fimbriimonas ginsengisoli* |
| SBP00165 | Parsley | *Finegoldia magna* |
| SBP00165 | Parsley | *Fischerella* sp. NIES-3754 |
| SBP00165 | Parsley | *Flagellimonas* sp. HME9304 |
| SBP00165 | Parsley | *Flammeovirga* sp. L12M1 |
| SBP00165 | Parsley | *Flammeovirga* sp. MY04 |
| SBP00165 | Parsley | *Flammeovirgaceae* bacterium 311 |
| SBP00165 | Parsley | *Flavisolibacter* sp. 17J28-1 |
| SBP00165 | Parsley | *Flavobacteriaceae* bacterium |
| SBP00165 | Parsley | *Flavobacterium columnare* |
| SBP00165 | Parsley | *Flavobacterium commune* |
| SBP00165 | Parsley | *Flavobacterium crocinum* |
| SBP00165 | Parsley | *Flavobacterium faecale* |
| SBP00165 | Parsley | *Flavobacterium gilvum* |
| SBP00165 | Parsley | *Flavobacterium johnsoniae* |
| SBP00165 | Parsley | *Flavobacterium kingsejongi* |
| SBP00165 | Parsley | *Flavobacterium pallidum* |
| SBP00165 | Parsley | *Flavobacterium* sp. CJ74 |
| SBP00165 | Parsley | *Flavobacterium* sp. MEBiC07310 |
| SBP00165 | Parsley | *Fluoribacter dumoffii* |
| SBP00165 | Parsley | *Formosa agariphila* |
| SBP00165 | Parsley | *Francisella halioticida* |
| SBP00165 | Parsley | *Francisella* sp. FSC1006 |
| SBP00165 | Parsley | *Frankia alni* |
| SBP00165 | Parsley | *Frankia casuarinae* |
| SBP00165 | Parsley | *Frankia inefficax* |
| SBP00165 | Parsley | *Frankia* sp. EAN1pec |
| SBP00165 | Parsley | *Frankia* sp. QA3 |
| SBP00165 | Parsley | *Frankia* symbiont of *Datisca glomerata* |
| SBP00165 | Parsley | *Frateuria aurantia* |
| SBP00165 | Parsley | *Friedmanniella luteola* |
| SBP00165 | Parsley | *Friedmanniella sagamiharensis* |
| SBP00165 | Parsley | *Frondihabitans* sp. 762G35 |
| SBP00165 | Parsley | *Frondihabitans* sp. PAMC 28766 |
| SBP00165 | Parsley | *Fusobacterium hwasookii* |
| SBP00165 | Parsley | *Fusobacterium mortiferum* |
| SBP00165 | Parsley | *Fusobacterium nucleatum* |
| SBP00165 | Parsley | *Fusobacterium periodonticum* |
| SBP00165 | Parsley | *Fusobacterium ulcerans* |
| SBP00165 | Parsley | *Gallionella capsiferriformans* |
| SBP00165 | Parsley | gamma proteobacterium HdN1 |
| SBP00165 | Parsley | *Geitlerinema* sp. PCC 7407 |
| SBP00165 | Parsley | *Geminocystis herdmanii* |
| SBP00165 | Parsley | *Geminocystis* sp. NIES-3708 |
| SBP00165 | Parsley | *Gemmata obscuriglobus* |
| SBP00165 | Parsley | *Gemmatimonas aurantiaca* |
| SBP00165 | Parsley | *Gemmatimonas phototrophica* |
| SBP00165 | Parsley | *Gemmatirosa kalamazoonesis* |
| SBP00165 | Parsley | *Gemmobacter* sp. HYN0069 |
| SBP00165 | Parsley | *Geobacillus* genomosp. 3 |
| SBP00165 | Parsley | *Geobacter anodireducens* |
| SBP00165 | Parsley | *Geobacter daltonii* |
| SBP00165 | Parsley | *Geobacter pickeringii* |
| SBP00165 | Parsley | *Geobacter* sp. DSM 9736 |
| SBP00165 | Parsley | *Geobacter* sp. M18 |
| SBP00165 | Parsley | *Geobacter* sp. M21 |

TABLE 3-continued

List of species identified in each metagenomic sample of each SBP Sample

| SBP ID | SBP Host Common Name | Genus sp. |
|---|---|---|
| SBP00165 | Parsley | *Geobacter sulfurreducens* |
| SBP00165 | Parsley | *Geodermatophilus obscurus* |
| SBP00165 | Parsley | *Geoglobus ahangari* |
| SBP00165 | Parsley | *Georgenia* sp. ZLJ0423 |
| SBP00165 | Parsley | *Geosporobacter ferrireducens* |
| SBP00165 | Parsley | *Gibbsiella quercinecans* |
| SBP00165 | Parsley | *Glaciecola* sp. THG-3.7 |
| SBP00165 | Parsley | *Glaesserella parasuis* |
| SBP00165 | Parsley | *Gloeobacter kilaueensis* |
| SBP00165 | Parsley | *Gloeocapsa* sp. PCC 7428 |
| SBP00165 | Parsley | *Gluconacetobacter diazotrophicus* |
| SBP00165 | Parsley | *Gluconobacter albidus* |
| SBP00165 | Parsley | *Gluconobacter oxydans* |
| SBP00165 | Parsley | *Glutamicibacter creatinolyticus* |
| SBP00165 | Parsley | *Glutamicibacter halophytocola* |
| SBP00165 | Parsley | *Glutamicibacter nicotianae* |
| SBP00165 | Parsley | *Glycocaulis alkaliphilus* |
| SBP00165 | Parsley | *Gordonia alkanivorans* |
| SBP00165 | Parsley | *Gordonia iterans* |
| SBP00165 | Parsley | *Gordonia phthalatica* |
| SBP00165 | Parsley | *Gordonia polyisoprenivorans* |
| SBP00165 | Parsley | *Gordonia rubripertincta* |
| SBP00165 | Parsley | *Gordonia* sp. 1D |
| SBP00165 | Parsley | *Gordonia* sp. KTR9 |
| SBP00165 | Parsley | *Gordonia* sp. MMS17-SY073 |
| SBP00165 | Parsley | *Gordonia* sp. YC-JH1 |
| SBP00165 | Parsley | *Gordonia terrae* |
| SBP00165 | Parsley | *Gordonibacter pamelaeae* |
| SBP00165 | Parsley | *Gordonibacter urolithinfaciens* |
| SBP00165 | Parsley | *Gottschalkia acidurici* |
| SBP00165 | Parsley | *Gramella flava* |
| SBP00165 | Parsley | *Gramella* sp. MAR_2010_147 |
| SBP00165 | Parsley | *Granulibacter bethesdensis* |
| SBP00165 | Parsley | *Granulicella tundricola* |
| SBP00165 | Parsley | *Granulosicoccus antarcticus* |
| SBP00165 | Parsley | *Grimontia hollisae* |
| SBP00165 | Parsley | *Gryllotalpicola* sp. 2DFW10M-5 |
| SBP00165 | Parsley | *Gynuella sunshinyii* |
| SBP00165 | Parsley | *Haematobacter massiliensis* |
| SBP00165 | Parsley | *Haemophilus parainfluenzae* |
| SBP00165 | Parsley | *Haemophilus pittmaniae* |
| SBP00165 | Parsley | *Hafnia alvei* |
| SBP00165 | Parsley | *Hafnia paralvei* |
| SBP00165 | Parsley | *Hahella* sp. KA22 |
| SBP00165 | Parsley | *Haliangium ochraceum* |
| SBP00165 | Parsley | *Halioglobus japonicus* |
| SBP00165 | Parsley | *Halioglobus pacificus* |
| SBP00165 | Parsley | *Haliscomenobacter hydrossis* |
| SBP00165 | Parsley | *Haloarcula hispanica* |
| SBP00165 | Parsley | *Haloarcula marismortui* |
| SBP00165 | Parsley | *Halobacterium hubeiense* |
| SBP00165 | Parsley | *Halobacteroides halobius* |
| SBP00165 | Parsley | *Halobellus limi* |
| SBP00165 | Parsley | *Halobiforma lacisalsi* |
| SBP00165 | Parsley | *Haloferax gibbonsii* |
| SBP00165 | Parsley | *Halomicronema hongdechloris* |
| SBP00165 | Parsley | *Halomonas aestuarii* |
| SBP00165 | Parsley | *Halomonas alkaliphila* |
| SBP00165 | Parsley | *Halomonas beimenensis* |
| SBP00165 | Parsley | *Halomonas chromatireducens* |
| SBP00165 | Parsley | *Halomonas elongata* |
| SBP00165 | Parsley | *Halomonas huangheensis* |
| SBP00165 | Parsley | *Halomonas hydrothermalis* |
| SBP00165 | Parsley | *Halomonas* sp. 1513 |
| SBP00165 | Parsley | *Halomonas* sp. A3H3 |
| SBP00165 | Parsley | *Halomonas* sp. hl-4 |
| SBP00165 | Parsley | *Halomonas* sp. JS92-SW72 |
| SBP00165 | Parsley | *Halomonas* sp. KO116 |
| SBP00165 | Parsley | *Halomonas* sp. N3-2A |
| SBP00165 | Parsley | *Halomonas* sp. SF2003 |
| SBP00165 | Parsley | *Halomonas subglaciescola* |
| SBP00165 | Parsley | *Halomonas titanicae* |
| SBP00165 | Parsley | *Halopiger xanaduensis* |
| SBP00165 | Parsley | *Halorhodospira halophila* |
| SBP00165 | Parsley | *Halorubrum lacusprofundi* |
| SBP00165 | Parsley | *Halorubrum* sp. BOL3-1 |

TABLE 3-continued

List of species identified in each metagenomic sample of each SBP Sample

| SBP ID | SBP Host Common Name | Genus sp. |
|---|---|---|
| SBP00165 | Parsley | Halotalea alkalilenta |
| SBP00165 | Parsley | Haloterrigena turkmenica |
| SBP00165 | Parsley | Halothiobacillus neapolitanus |
| SBP00165 | Parsley | Halothiobacillus sp. LS2 |
| SBP00165 | Parsley | Hartmannibacter diazotrophicus |
| SBP00165 | Parsley | Helicobacter cetorum |
| SBP00165 | Parsley | Helicobacter cholecystus |
| SBP00165 | Parsley | Helicobacter pylori |
| SBP00165 | Parsley | Helicobacter saguini |
| SBP00165 | Parsley | Heliobacterium modesticaldum |
| SBP00165 | Parsley | Herbaspirillum hiltneri |
| SBP00165 | Parsley | Herbaspirillum huttiense |
| SBP00165 | Parsley | Herbaspirillum robiniae |
| SBP00165 | Parsley | Herbaspirillum rubrisubalbicans |
| SBP00165 | Parsley | Herbaspirillum seropedicae |
| SBP00165 | Parsley | Herbaspirillum sp. meg3 |
| SBP00165 | Parsley | Herbinix luporum |
| SBP00165 | Parsley | Herminiimonas arsenicoxydans |
| SBP00165 | Parsley | Herminiimonas arsenitoxidans |
| SBP00165 | Parsley | Histophilus somni |
| SBP00165 | Parsley | Hoeflea phototrophica |
| SBP00165 | Parsley | Hoeflea sp. IMCC20628 |
| SBP00165 | Parsley | Humibacter sp. BT305 |
| SBP00165 | Parsley | Hungateiclostridium clariflavum |
| SBP00165 | Parsley | Hydrogenophaga crassostreae |
| SBP00165 | Parsley | Hydrogenophaga pseudoflava |
| SBP00165 | Parsley | Hydrogenophaga sp. NH-16 |
| SBP00165 | Parsley | Hydrogenophaga sp. PBC |
| SBP00165 | Parsley | Hydrogenophaga sp. RAC07 |
| SBP00165 | Parsley | Hydrogenophilus thermoluteolus |
| SBP00165 | Parsley | Hydromonas sp. F02 |
| SBP00165 | Parsley | Hylemonella gracilis |
| SBP00165 | Parsley | Hymenobacter nivis |
| SBP00165 | Parsley | Hymenobacter sedentarius |
| SBP00165 | Parsley | Hymenobacter sp. 17J36-26 |
| SBP00165 | Parsley | Hymenobacter sp. 17J68-5 |
| SBP00165 | Parsley | Hymenobacter sp. APR13 |
| SBP00165 | Parsley | Hymenobacter sp. DG25B |
| SBP00165 | Parsley | Hymenobacter sp. PAMC 26554 |
| SBP00165 | Parsley | Hymenobacter sp. PAMC 26628 |
| SBP00165 | Parsley | Hymenobacter sp. sh-6 |
| SBP00165 | Parsley | Hymenobacter swuensis |
| SBP00165 | Parsley | Hyphomicrobium denitrificans |
| SBP00165 | Parsley | Hyphomicrobium nitrativorans |
| SBP00165 | Parsley | Hyphomicrobium sp. MC1 |
| SBP00165 | Parsley | Hyphomonas neptunium |
| SBP00165 | Parsley | Hyphomonas sp. CACIAM 19H1 |
| SBP00165 | Parsley | Idiomarina loihiensis |
| SBP00165 | Parsley | Idiomarina piscisalsi |
| SBP00165 | Parsley | Ignavibacterium album |
| SBP00165 | Parsley | Ilyobacter polytropus |
| SBP00165 | Parsley | Immundisolibacter cernigliae |
| SBP00165 | Parsley | Indioceanicola profundi |
| SBP00165 | Parsley | Inhella inkyongensis |
| SBP00165 | Parsley | Intestinimonas butyriciproducens |
| SBP00165 | Parsley | Intrasporangium calvum |
| SBP00165 | Parsley | Ilodobacter sp. H11R3 |
| SBP00165 | Parsley | Isoptericola dokdonensis |
| SBP00165 | Parsley | Isoptericola variabilis |
| SBP00165 | Parsley | Janibacter indicus |
| SBP00165 | Parsley | Janibacter limosus |
| SBP00165 | Parsley | Jannaschia sp. CCS1 |
| SBP00165 | Parsley | Janthinobacterium agaricidamnosum |
| SBP00165 | Parsley | Janthinobacterium sp. 1_2014MBL_MicDiv |
| SBP00165 | Parsley | Janthinobacterium sp. 17J80-10 |
| SBP00165 | Parsley | Janthinobacterium sp. B9-8 |
| SBP00165 | Parsley | Janthinobacterium sp. LM6 |
| SBP00165 | Parsley | Janthinobacterium sp. Marseille |
| SBP00165 | Parsley | Janthinobacterium svalbardensis |
| SBP00165 | Parsley | Jatrophihabitans sp. GAS493 |
| SBP00165 | Parsley | Jeongeupia sp. USM3 |
| SBP00165 | Parsley | Jeotgalibaca sp. PTS2502 |
| SBP00165 | Parsley | Jiangella alkaliphila |
| SBP00165 | Parsley | Jiangella sp. DSM 45060 |
| SBP00165 | Parsley | Kerstersia gyiorum |
| SBP00165 | Parsley | Ketobacter alkanivorans |

TABLE 3-continued

List of species identified in each metagenomic sample of each SBP Sample

| SBP ID | SBP Host Common Name | Genus sp. |
|---|---|---|
| SBP00165 | Parsley | *Ketogulonicigenium robustum* |
| SBP00165 | Parsley | *Ketogulonicigenium vulgare* |
| SBP00165 | Parsley | *Kibdelosporangium phytohabitans* |
| SBP00165 | Parsley | *Kineococcus radiotolerans* |
| SBP00165 | Parsley | *Kiritimatiella glycovorans* |
| SBP00165 | Parsley | *Kitasatospora albolonga* |
| SBP00165 | Parsley | *Kitasatospora aureofaciens* |
| SBP00165 | Parsley | *Kitasatospora setae* |
| SBP00165 | Parsley | *Kitasatospora* sp. MMS16-BH015 |
| SBP00165 | Parsley | *Klebsiella aerogenes* |
| SBP00165 | Parsley | *Klebsiella michiganensis* |
| SBP00165 | Parsley | *Klebsiella oxytoca* |
| SBP00165 | Parsley | *Klebsiella pneumoniae* |
| SBP00165 | Parsley | *Klebsiella quasipneumoniae* |
| SBP00165 | Parsley | *Klebsiella* sp. FDAARGOS_511 |
| SBP00165 | Parsley | *Klebsiella* sp. WCHKl090001 |
| SBP00165 | Parsley | *Klebsiella variicola* |
| SBP00165 | Parsley | *Kluyvera intermedia* |
| SBP00165 | Parsley | *Kocuria flava* |
| SBP00165 | Parsley | *Kocuria indica* |
| SBP00165 | Parsley | *Kocuria palustris* |
| SBP00165 | Parsley | *Kocuria rosea* |
| SBP00165 | Parsley | *Kocuria turfanensis* |
| SBP00165 | Parsley | *Komagataeibacter europaeus* |
| SBP00165 | Parsley | *Komagataeibacter medellinensis* |
| SBP00165 | Parsley | *Komagataeibacter nataicola* |
| SBP00165 | Parsley | *Komagataeibacter saccharivorans* |
| SBP00165 | Parsley | *Komagataeibacter xylinus* |
| SBP00165 | Parsley | *Kosakonia cowanii* |
| SBP00165 | Parsley | *Kosakonia oryzae* |
| SBP00165 | Parsley | *Kosakonia sacchari* |
| SBP00165 | Parsley | *Kozakia baliensis* |
| SBP00165 | Parsley | *Kribbella flavida* |
| SBP00165 | Parsley | *Kushneria konosiri* |
| SBP00165 | Parsley | *Kushneria marisflavi* |
| SBP00165 | Parsley | *Kutzneria albida* |
| SBP00165 | Parsley | *Kyrpidia tusciae* |
| SBP00165 | Parsley | *Kytococcus sedentarius* |
| SBP00165 | Parsley | *Labrenzia alexandrii* |
| SBP00165 | Parsley | *Labrenzia* sp. CP4 |
| SBP00165 | Parsley | *Labrenzia* sp. VG12 |
| SBP00165 | Parsley | *Lacimicrobium alkaliphilum* |
| SBP00165 | Parsley | *Lacinutrix* sp. Bg11-31 |
| SBP00165 | Parsley | *Lactobacillus backii* |
| SBP00165 | Parsley | *Lactobacillus crispatus* |
| SBP00165 | Parsley | *Lactobacillus hordei* |
| SBP00165 | Parsley | *Lactobacillus johnsonii* |
| SBP00165 | Parsley | *Lactobacillus mucosae* |
| SBP00165 | Parsley | *Lactobacillus paracasei* |
| SBP00165 | Parsley | *Lactobacillus reuteri* |
| SBP00165 | Parsley | *Lactobacillus sakei* |
| SBP00165 | Parsley | *Lactococcus lactis* |
| SBP00165 | Parsley | *Lacunisphaera limnophila* |
| SBP00165 | Parsley | *Laribacter hongkongensis* |
| SBP00165 | Parsley | *Lautropia mirabilis* |
| SBP00165 | Parsley | *Leclercia adecarboxylata* |
| SBP00165 | Parsley | *Leclercia* sp. LSNIH1 |
| SBP00165 | Parsley | *Legionella israelensis* |
| SBP00165 | Parsley | *Legionella pneumophila* |
| SBP00165 | Parsley | *Legionella sainthelensi* |
| SBP00165 | Parsley | *Legionella spiritensis* |
| SBP00165 | Parsley | *Leifsonia* sp. 21MFCrub1.1 |
| SBP00165 | Parsley | *Leifsonia xyli* |
| SBP00165 | Parsley | *Leisingera aquaemixtae* |
| SBP00165 | Parsley | *Leisingera methylohalidivorans* |
| SBP00165 | Parsley | *Lelliottia amnigena* |
| SBP00165 | Parsley | *Lelliottia jeotgali* |
| SBP00165 | Parsley | *Lelliottia* sp. WB101 |
| SBP00165 | Parsley | *Lentzea guizhouensis* |
| SBP00165 | Parsley | *Leptolyngbya boryana* |
| SBP00165 | Parsley | *Leptospira interrogans* |
| SBP00165 | Parsley | *Leptospira santarosai* |
| SBP00165 | Parsley | *Leptothrix cholodnii* |
| SBP00165 | Parsley | *Leptotrichia buccalis* |
| SBP00165 | Parsley | *Leucobacter* sp. DSM 101948 |
| SBP00165 | Parsley | *Leucobacter triazinivorans* |

TABLE 3-continued

List of species identified in each metagenomic sample of each SBP Sample

| SBP ID | SBP Host Common Name | Genus sp. |
|---|---|---|
| SBP00165 | Parsley | *Leuconostoc mesenteroides* |
| SBP0016S | Parsley | *Libanicoccus massiliensis* |
| SBP00165 | Parsley | *Limnobaculum parvum* |
| SBP00165 | Parsley | *Limnohabitans* sp. 103DPR2 |
| SBP00165 | Parsley | *Limnohabitans* sp. 63ED37-2 |
| SBP00165 | Parsley | *Listeria monocytogenes* |
| SBP00165 | Parsley | *Listeria seeligeri* |
| SBP00165 | Parsley | *Lonsdalea britannica* |
| SBP00165 | Parsley | *Luteibacter rhizovicinus* |
| SBP00165 | Parsley | *Luteimonas* sp. 100111 |
| SBP00165 | Parsley | *Luteimonas* sp. 83-4 |
| SBP00165 | Parsley | *Luteimonas* sp. JM171 |
| SBP00165 | Parsley | *Luteipulveratus mongoliensis* |
| SBP00165 | Parsley | *Luteitalea pratensis* |
| SBP00165 | Parsley | *Lutibacter profundi* |
| SBP00165 | Parsley | *Lutibacter* sp. LPB0138 |
| SBP00165 | Parsley | *Lysinibacillus* sp. SGAir0095 |
| SBP00165 | Parsley | *Lysinibacillus sphaericus* |
| SBP00165 | Parsley | *Lysinimonas* sp. 2DFWR-13 |
| SBP00165 | Parsley | *Lysobacter antibioticus* |
| SBP00165 | Parsley | *Lysobacter capsici* |
| SBP00165 | Parsley | *Lysobacter enzymogenes* |
| SBP00165 | Parsley | *Lysobacter gummosus* |
| SBP00165 | Parsley | *Lysobacter maris* |
| SBP00165 | Parsley | *Lysobacter* sp. TY2-98 |
| SBP00165 | Parsley | *Magnetospira* sp. QH-2 |
| SBP00165 | Parsley | *Magnetospirillum gryphiswaldense* |
| SBP00165 | Parsley | *Magnetospirillum magneticum* |
| SBP00165 | Parsley | *Magnetospirillum* sp. ME-1 |
| SBP00165 | Parsley | *Magnetospirillum* sp. XM-1 |
| SBP00165 | Parsley | *Maribacter cobaltidurans* |
| SBP00165 | Parsley | *Maribacter* sp. MAR_2009_60 |
| SBP00165 | Parsley | *Maricaulis maris* |
| SBP00165 | Parsley | *Marichromatium purpuratum* |
| SBP00165 | Parsley | *Mariniflexile* sp. TRM1-10 |
| SBP00165 | Parsley | *Marinithermus hydrothermalis* |
| SBP00165 | Parsley | *Marinobacter hydrocarbonoclasticus* |
| SBP00165 | Parsley | *Marinobacter psychrophilus* |
| SBP00165 | Parsley | *Marinobacter salarius* |
| SBP00165 | Parsley | *Marinobacter salinus* |
| SBP00165 | Parsley | *Marinobacter similis* |
| SBP00165 | Parsley | *Marinobacter* sp. Arc7-DN-1 |
| SBP00165 | Parsley | *Marinobacter* sp. BSs20148 |
| SBP00165 | Parsley | *Marinobacter* sp. es.042 |
| SBP00165 | Parsley | *Marinobacter* sp. LQ44 |
| SBP00165 | Parsley | *Marinobacter* sp. LV10R510-11A |
| SBP00165 | Parsley | *Marinobacter* sp. NP-4(2019) |
| SBP00165 | Parsley | *Marinobacterium aestuarii* |
| SBP00165 | Parsley | *Marinovum algicola* |
| SBP00165 | Parsley | *Marivirga tractuosa* |
| SBP00165 | Parsley | *Marmoricola scoriae* |
| SBP00165 | Parsley | *Martelella endophytica* |
| SBP00165 | Parsley | *Martelella mediterranea* |
| SBP00165 | Parsley | *Martelella* sp. AD-3 |
| SBP00165 | Parsley | *Maruca vitrata* nucleopolyhedrovirus |
| SBP00165 | Parsley | *Massilia albidiflava* |
| SBP00165 | Parsley | *Massilia armeniaca* |
| SBP00165 | Parsley | *Massilia lutea* |
| SBP00165 | Parsley | *Massilia oculi* |
| SBP00165 | Parsley | *Massilia plicata* |
| SBP00165 | Parsley | *Massilia putida* |
| SBP00165 | Parsley | *Massilia* sp. NR 4-1 |
| SBP00165 | Parsley | *Massilia* sp. WG5 |
| SBP00165 | Parsley | *Massilia* sp. YMA4 |
| SBP00165 | Parsley | *Massilia umbonata* |
| SBP00165 | Parsley | *Massilia violaceinigra* |
| SBP00165 | Parsley | *Megasphaera stantonii* |
| SBP00165 | Parsley | *Melaminivora* sp. SC2-7 |
| SBP00165 | Parsley | *Melaminivora* sp. SC2-9 |
| SBP00165 | Parsley | *Melissococcus plutonius* |
| SBP00165 | Parsley | *Melittangium boletus* |
| SBP00165 | Parsley | *Mesorhizobium amorphae* |
| SBP00165 | Parsley | *Mesorhizobium australicum* |
| SBP00165 | Parsley | *Mesorhizobium ciceri* |
| SBP00165 | Parsley | *Mesorhizobium huakuii* |
| SBP00165 | Parsley | *Mesorhizobium japonicum* |

TABLE 3-continued

List of species identified in each metagenomic sample of each SBP Sample

| SBP ID | SBP Host Common Name | Genus sp. |
|---|---|---|
| SBP00165 | Parsley | Mesorhizobium loti |
| SBP00165 | Parsley | Mesorhizobium oceanicum |
| SBP00165 | Parsley | Mesorhizobium opportunistum |
| SBP00165 | Parsley | Mesorhizobium sp. DCY119 |
| SBP00165 | Parsley | Mesorhizobium sp. M1B.F.Ca.ET.045.04.1.1 |
| SBP00165 | Parsley | Mesorhizobium sp. M1D.F.Ca.ET.043.01.1.1 |
| SBP00165 | Parsley | Mesorhizobium sp. M1E.F.Ca.ET.045.02.1.1 |
| SBP00165 | Parsley | Mesorhizobium sp. M2A,F.Ca.ET.043.02.1.1 |
| SBP00165 | Parsley | Mesorhizobium sp. M2A.F.Ca.ET.043.05.1.1 |
| SBP00165 | Parsley | Mesorhizobium sp. M2A.F.Ca.ET.046.03.2.1 |
| SBP00165 | Parsley | Mesorhizobium sp. M3A.F.Ca.ET.080.04.2.1 |
| SBP00165 | Parsley | Mesorhizobium sp. M4B.F.Ca.ET.058.02.1.1 |
| SBP00165 | Parsley | Mesorhizobium sp. M6A.T.Cr.TU.016.01.1.1 |
| SBP00165 | Parsley | Mesorhizobium sp. M7A.F.Ce.TU.012.03.2.1 |
| SBP00165 | Parsley | Mesorhizobium sp. M7D.F.Ca.US.005.01.1.1 |
| SBP00165 | Parsley | Mesorhizobium sp. M9A.F.Ca.ET.002.03.1.2 |
| SBP00165 | Parsley | Mesorhizobium sp. WSM1497 |
| SBP00165 | Parsley | Methanobrevibacter sp. AbM4 |
| SBP00165 | Parsley | Methanocaldococcus bathoardescens |
| SBP00165 | Parsley | Methanocaldococcus jannaschii |
| SBP00165 | Parsley | Methanocella arvoryzae |
| SBP00165 | Parsley | Methanococcus maripaludis |
| SBP00165 | Parsley | Methanosarcina barkeri |
| SBP00165 | Parsley | Methanosarcina horonobensis |
| SBP00165 | Parsley | Methanosarcina siciliae |
| SBP00165 | Parsley | Methanosarcina sp. Kolksee |
| SBP00165 | Parsley | Methanosarcina sp. MTP4 |
| SBP00165 | Parsley | Methanothermococcus okinawensis |
| SBP00165 | Parsley | Methanothrix soehngenii |
| SBP00165 | Parsley | Methanotorris igneus |
| SBP00165 | Parsley | Methylibium petroleiphilum |
| SBP00165 | Parsley | Methylobacillus flagellatus |
| SBP00165 | Parsley | Methylobacterium aquaticum |
| SBP00165 | Parsley | Methylobacterium brachiatum |
| SBP00165 | Parsley | Methylobacterium currus |
| SBP00165 | Parsley | Methylobacterium nodulans |
| SBP00165 | Parsley | Methylobacterium oryzae |
| SBP00165 | Parsley | Methylobacterium phyllosphaerae |
| SBP00165 | Parsley | Methylobacterium radiotolerans |
| SBP00165 | Parsley | Methylobacterium sp. 17SD2-17 |
| SBP00165 | Parsley | Methylobacterium sp. 17Sr1-1 |
| SBP00165 | Parsley | Methylobacterium sp. 17Sr1-28 |
| SBP00165 | Parsley | Methylobacterium sp. 175r1-43 |
| SBP00165 | Parsley | Methylobacterium sp. 4-46 |
| SBP00165 | Parsley | Methylobacterium sp. AMS5 |
| SBP00165 | Parsley | Methylobacterium sp. C1 |
| SBP00165 | Parsley | Methylobacterium sp. DM1 |
| SBP00165 | Parsley | Methylobacterium sp. XJLW |
| SBP00165 | Parsley | Methylocaldum marinum |
| SBP00165 | Parsley | Methyloceanibacter caenitepidi |
| SBP00165 | Parsley | Methyloceanibacter sp. wino2 |
| SBP00165 | Parsley | Methylocella silvestris |
| SBP00165 | Parsley | Methylococcus capsulatus |
| SBP00165 | Parsley | Methylocystis bryophila |
| SBP00165 | Parsley | Methylocystis rosea |
| SBP00165 | Parsley | Methylocystis sp. SC2 |
| SBP00165 | Parsley | Methylomicrobium album |
| SBP00165 | Parsley | Methylomonas clara |
| SBP00165 | Parsley | Methylomonas denitrificans |
| SBP00165 | Parsley | Methylomonas koyamae |
| SBP00165 | Parsley | Methylomonas methanica |
| SBP00165 | Parsley | Methylomonas sp. DH-1 |
| SBP00165 | Parsley | Methylomonas sp. LW13 |
| SBP00165 | Parsley | Methylorubrum extorquens |
| SBP00165 | Parsley | Methylorubrum populi |
| SBP00165 | Parsley | Methylorubrum zatmanii |
| SBP00165 | Parsley | Methylosinus trichosporium |
| SBP00165 | Parsley | Methyloversatilis sp. RAC08 |
| SBP00165 | Parsley | Methylovirgula ligni |
| SBP00165 | Parsley | Methylovorus glucosotrophus |
| SBP00165 | Parsley | Methylovorus sp. MP688 |
| SBP00165 | Parsley | Methylovulum psychrotolerans |
| SBP00165 | Parsley | Micavibrio aeruginosavorus |
| SBP00165 | Parsley | Microbacterium aurum |
| SBP00165 | Parsley | Microbacterium chocolatum |
| SBP00165 | Parsley | Microbacterium foliorum |

TABLE 3-continued

List of species identified in each metagenomic sample of each SBP Sample

| SBP ID | SBP Host Common Name | Genus sp. |
|---|---|---|
| SBP00165 | Parsley | *Microbacterium hominis* |
| SBP00165 | Parsley | *Microbacterium lemovicicum* |
| SBP00165 | Parsley | *Microbacterium oleivorans* |
| SBP00165 | Parsley | *Microbacterium oxydans* |
| SBP00165 | Parsley | *Microbacterium paludicola* |
| SBP00165 | Parsley | *Microbacterium paraoxydans* |
| SBP00165 | Parsley | *Microbacterium pygmaeum* |
| SBP00165 | Parsley | *Microbacterium sediminis* |
| SBP00165 | Parsley | *Microbacterium* sp. 1.5R |
| SBP00165 | Parsley | *Microbacterium* sp. 10M-3C3 |
| SBP00165 | Parsley | *Microbacterium* sp. ABRD_28 |
| SBP00165 | Parsley | *Microbacterium* sp. BH-3-3-3 |
| SBP00165 | Parsley | *Microbacterium* sp. CGR1 |
| SBP00165 | Parsley | *Microbacterium* sp. LKL04 |
| SBP00165 | Parsley | *Microbacterium* sp. No. 7 |
| SBP00165 | Parsley | *Microbacterium* sp. PAMC 28756 |
| SBP00165 | Parsley | *Microbacterium* sp. PM5 |
| SBP00165 | Parsley | *Microbacterium* sp. SGAir0570 |
| SBP00165 | Parsley | *Microbacterium* sp. str. 'China' |
| SBP00165 | Parsley | *Microbacterium* sp. TPU 3598 |
| SBP00165 | Parsley | *Microbacterium* sp. XT11 |
| SBP00165 | Parsley | *Microbacterium* sp. Y-01 |
| SBP00165 | Parsley | *Microbacterium testaceum* |
| SBP00165 | Parsley | *Microbulbifer agarilyticus* |
| SBP00165 | Parsley | *Microbulbifer aggregans* |
| SBP00165 | Parsley | *Microbulbifer* sp. A4B17 |
| SBP00165 | Parsley | *Microbulbifer thermotolerans* |
| SBP00165 | Parsley | *Microcella alkaliphila* |
| SBP00165 | Parsley | *Micrococcus luteus* |
| SBP00165 | Parsley | *Microcoleus* sp. PCC 7113 |
| SBP00165 | Parsley | *Microlunatus phosphovorus* |
| SBP00165 | Parsley | *Microlunatus soli* |
| SBP00165 | Parsley | *Micromonospora auratinigra* |
| SBP00165 | Parsley | *Micromonospora chokoriensis* |
| SBP00165 | Parsley | *Micromonospora coriariae* |
| SBP00165 | Parsley | *Micromonospora coxensis* |
| SBP00165 | Parsley | *Micromonospora echinaurantiaca* |
| SBP00165 | Parsley | *Micromonospora echinofusca* |
| SBP00165 | Parsley | *Micromonospora echinospora* |
| SBP00165 | Parsley | *Micromonospora inositola* |
| SBP00165 | Parsley | *Micromonospora krabiensis* |
| SBP00165 | Parsley | *Micromonospora narathiwatensis* |
| SBP00165 | Parsley | *Micromonospora purpureochromogenes* |
| SBP00165 | Parsley | *Micromonospora rifamycinica* |
| SBP00165 | Parsley | *Micromonospora siamensis* |
| SBP00165 | Parsley | *Micromonospora* sp. B006 |
| SBP00165 | Parsley | *Micromonospora* sp. WMMA2032 |
| SBP00165 | Parsley | *Micromonospora tulbaghiae* |
| SBP00165 | Parsley | *Micromonospora viridifaciens* |
| SBP00165 | Parsley | *Micromonospora zamorensis* |
| SBP00165 | Parsley | *Micropruina glycogenica* |
| SBP00165 | Parsley | *Microterricola viridarii* |
| SBP00165 | Parsley | *Microvirga ossetica* |
| SBP00165 | Parsley | *Microvirga* sp. 17 mud 1-3 |
| SBP00165 | Parsley | *Microvirgula aerodenitrificans* |
| SBP00165 | Parsley | *Miniimonas* sp. S16 |
| SBP00165 | Parsley | *Mitsuaria* sp. 7 |
| SBP00165 | Parsley | *Mixta calida* |
| SBP00165 | Parsley | *Mixta gaviniae* |
| SBP00165 | Parsley | *Modestobacter marinus* |
| SBP00165 | Parsley | *Moorea producens* |
| SBP00165 | Parsley | *Moorella thermoacetica* |
| SBP00165 | Parsley | *Moraxella osloensis* |
| SBP00165 | Parsley | *Morganella morganii* |
| SBP00165 | Parsley | *Mucilaginibacter paludis* |
| SBP00165 | Parsley | *Mucilaginibacter* sp. HYN0043 |
| SBP00165 | Parsley | *Mycetocola* sp. 449 |
| SBP00165 | Parsley | *Mycobacterium avium* |
| SBP00165 | Parsley | *Mycobacterium canettii* |
| SBP00165 | Parsley | *Mycobacterium chimaera* |
| SBP00165 | Parsley | *Mycobacterium dioxanotrophicus* |
| SBP00165 | Parsley | *Mycobacterium kansasii* |
| SBP00165 | Parsley | *Mycobacterium marseillense* |
| SBP00165 | Parsley | *Mycobacterium paragordonae* |
| SBP00165 | Parsley | *Mycobacterium shigaense* |
| SBP00165 | Parsley | *Mycobacterium* sp. djl-10 |

TABLE 3-continued

List of species identified in each metagenomic sample of each SBP Sample

| SBP ID | SBP Host Common Name | Genus sp. |
| --- | --- | --- |
| SBP00165 | Parsley | *Mycobacterium* sp. DL90 |
| SBP00165 | Parsley | *Mycobacterium* sp. EPa45 |
| SBP00165 | Parsley | *Mycobacterium* sp. JS623 |
| SBP00165 | Parsley | *Mycobacterium* sp. MS1601 |
| SBP00165 | Parsley | *Mycobacterium* sp. PYR15 |
| SBP00165 | Parsley | *Mycobacterium* sp. YC-RL4 |
| SBP00165 | Parsley | *Mycobacterium* virus Benedict |
| SBP00165 | Parsley | *Mycobacteroides abscessus* |
| SBP00165 | Parsley | *Mycobacteroides chelonae* |
| SBP00165 | Parsley | *Mycobacteroides immunogenum* |
| SBP00165 | Parsley | *Mycobacteroides saopaulense* |
| SBP00165 | Parsley | *Mycolicibacter sinensis* |
| SBP00165 | Parsley | *Mycolicibacter terrae* |
| SBP00165 | Parsley | *Mycolicibacterium aurum* |
| SBP00165 | Parsley | *Mycolicibacterium chitae* |
| SBP00165 | Parsley | *Mycolicibacterium chubuense* |
| SBP00165 | Parsley | *Mycolicibacterium flavescens* |
| SBP00165 | Parsley | *Mycolicibacterium gilvum* |
| SBP00165 | Parsley | *Mycolicibacterium goodii* |
| SBP00165 | Parsley | *Mycolicibacterium hassiacum* |
| SBP00165 | Parsley | *Mycolicibacterium rhodesiae* |
| SBP00165 | Parsley | *Mycolicibacterium rutilum* |
| SBP00165 | Parsley | *Mycolicibacterium smegmatis* |
| SBP00165 | Parsley | *Mycolicibacterium thermoresistibile* |
| SBP00165 | Parsley | *Mycolicibacterium vaccae* |
| SBP00165 | Parsley | *Mycolicibacterium vanbaalenii* |
| SBP00165 | Parsley | *Mycoplasma anatis* |
| SBP00165 | Parsley | *Mycoplasma citelli* |
| SBP00165 | Parsley | *Mycoplasma dispar* |
| SBP00165 | Parsley | *Mycoplasma iowae* |
| SBP00165 | Parsley | *Mycoplasma mycoides* |
| SBP00165 | Parsley | *Mycoplasma neurolyticum* |
| SBP00165 | Parsley | *Myxococcus fulvus* |
| SBP00165 | Parsley | *Myxococcus hansupus* |
| SBP00165 | Parsley | *Myxococcus macrosporus* |
| SBP00165 | Parsley | *Myxococcus stipitatus* |
| SBP00165 | Parsley | *Myxococcus xanthus* |
| SBP00165 | Parsley | *Nakamurella multipartita* |
| SBP00165 | Parsley | *Nakamurella panacisegetis* |
| SBP00165 | Parsley | *Natrialba magadii* |
| SBP00165 | Parsley | *Natrinema pallidum* |
| SBP00165 | Parsley | *Natrinema* sp. J7-2 |
| SBP00165 | Parsley | *Natronococcus occultus* |
| SBP00165 | Parsley | *Negativicoccus massiliensis* |
| SBP00165 | Parsley | *Neisseria animalis* |
| SBP00165 | Parsley | *Neisseria cinerea* |
| SBP00165 | Parsley | *Neisseria elongata* |
| SBP00165 | Parsley | *Neisseria meningitidis* |
| SBP00165 | Parsley | *Neisseria* sp. 10022 |
| SBP00165 | Parsley | *Neisseria* sp. 10023 |
| SBP00165 | Parsley | *Neisseria* sp. KEM232 |
| SBP00165 | Parsley | *Neisseria subflava* |
| SBP00165 | Parsley | *Neoasaia chiangmaiensis* |
| SBP00165 | Parsley | *Neorhizobium galegae* |
| SBP00165 | Parsley | *Neorhizobium* sp. NCHU2750 |
| SBP00165 | Parsley | *Neorhizobium* sp. SOG26 |
| SBP00165 | Parsley | *Nissabacter* sp. SGAir0207 |
| SBP00165 | Parsley | *Nitratireductor basaltis* |
| SBP00165 | Parsley | *Nitratireductor* sp. OM-1 |
| SBP00165 | Parsley | *Nitrobacter hamburgensis* |
| SBP00165 | Parsley | *Nitrobacter winogradskyi* |
| SBP00165 | Parsley | *Nitrosococcus halophilus* |
| SBP00165 | Parsley | *Nitrosomonas eutropha* |
| SBP00165 | Parsley | *Nitrosomonas ureae* |
| SBP00165 | Parsley | *Nitrososphaera viennensis* |
| SBP00165 | Parsley | *Nitrosospira briensis* |
| SBP00165 | Parsley | *Nitrosospira lacus* |
| SBP00165 | Parsley | *Nitrosospira multiformis* |
| SBP00165 | Parsley | *Nitrospira defluvii* |
| SBP00165 | Parsley | *Nitrospira japonica* |
| SBP00165 | Parsley | *Nitrospira moscoviensis* |
| SBP00165 | Parsley | *Nitrospirillum amazonense* |
| SBP00165 | Parsley | *Niveispirillum cyanobacteriorum* |
| SBP00165 | Parsley | *Nocardia asteroides* |
| SBP00165 | Parsley | *Nocardia brasiliensis* |
| SBP00165 | Parsley | *Nocardia cyriacigeorgica* |

TABLE 3-continued

List of species identified in each metagenomic sample of each SBP Sample

| SBP ID | SBP Host Common Name | Genus sp. |
|---|---|---|
| SBP00165 | Parsley | *Nocardia farcinica* |
| SBP00165 | Parsley | *Nocardia nova* |
| SBP00165 | Parsley | *Nocardia seriolae* |
| SBP00165 | Parsley | *Nocardia* sp. CFHS0054 |
| SBP00165 | Parsley | *Nocardia* sp. CS682 |
| SBP00165 | Parsley | *Nocardia* sp. Y48 |
| SBP00165 | Parsley | *Nocardia terpenica* |
| SBP00165 | Parsley | *Nocardioides daphniae* |
| SBP00165 | Parsley | *Nocardioides dokdonensis* |
| SBP00165 | Parsley | *Nocardioides humi* |
| SBP00165 | Parsley | *Nocardioides* sp. 603 |
| SBP00165 | Parsley | *Nocardioides* sp. 78 |
| SBP00165 | Parsley | *Nocardioides* sp. CF8 |
| SBP00165 | Parsley | *Nocardioides* sp. HY056 |
| SBP00165 | Parsley | *Nocardioides* sp. JS614 |
| SBP00165 | Parsley | *Nocardiopsis alba* |
| SBP00165 | Parsley | *Nocardiopsis dassonvillei* |
| SBP00165 | Parsley | *Nocardiopsis gilva* |
| SBP00165 | Parsley | *Nonlabens dokdonensis* |
| SBP00165 | Parsley | *Nonlabens* sp. Hel1_33_55 |
| SBP00165 | Parsley | *Nonlabens* sp. MJ115 |
| SBP00165 | Parsley | *Nonomuraea* sp. ATCC 55076 |
| SBP00165 | Parsley | *Nostoc carneum* |
| SBP00165 | Parsley | *Nostoc flagelliforme* |
| SBP00165 | Parsley | *Nostoc linckia* |
| SBP00165 | Parsley | *Nostoc* sp. NIES-4103 |
| SBP00165 | Parsley | *Nostocales cyanobacterium* HT-58-2 |
| SBP00165 | Parsley | *Novosphingobium aromaticivorans* |
| SBP00165 | Parsley | *Novosphingobium pentaromativorans* |
| SBP00165 | Parsley | *Novosphingobium resinovorum* |
| SBP00165 | Parsley | *Novosphingobium* sp. KA1 |
| SBP00165 | Parsley | *Novosphingobium* sp. P6W |
| SBP00165 | Parsley | *Novosphingobium* sp. PP1Y |
| SBP00165 | Parsley | *Novosphingobium* sp. THN1 |
| SBP00165 | Parsley | *Novosphingobium tardaugens* |
| SBP00165 | Parsley | *Obesumbacterium proteus* |
| SBP00165 | Parsley | *Oblitimonas alkaliphila* |
| SBP00165 | Parsley | *Oceanicoccus sagamiensis* |
| SBP00165 | Parsley | *Oceanimonas* sp. GK1 |
| SBP00165 | Parsley | *Oceanisphaera profunda* |
| SBP00165 | Parsley | *Oceanithermus profundus* |
| SBP00165 | Parsley | *Oceanobacillus iheyensis* |
| SBP00165 | Parsley | *Ochrobactrum anthropi* |
| SBP00165 | Parsley | *Ochrobactrum pituitosum* |
| SBP00165 | Parsley | *Ochrobactrum pseudogrignonense* |
| SBP00165 | Parsley | *Ochrobactrum* sp. A44 |
| SBP00165 | Parsley | *Octadecabacter antarcticus* |
| SBP00165 | Parsley | *Oligotropha carboxidovorans* |
| SBP00165 | Parsley | *Olleya aquimaris* |
| SBP00165 | Parsley | *Olleya* sp. Bg11-27 |
| SBP00165 | Parsley | *Olsenella* sp. Marseille-P2300 |
| SBP00165 | Parsley | *Olsenella* sp. oral taxon 807 |
| SBP00165 | Parsley | *Opitutaceae bacterium* TAV5 |
| SBP00165 | Parsley | *Opitutus* sp. GAS368 |
| SBP00165 | Parsley | *Opitutus terrae* |
| SBP00165 | Parsley | *Ornithinimicrobium flavum* |
| SBP00165 | Parsley | *Ornithinimicrobium* sp. AMA3305 |
| SBP00165 | Parsley | *Orrella dioscoreae* |
| SBP00165 | Parsley | *Oscillatoria nigro-viridis* |
| SBP00165 | Parsley | *Oscillibacter valericigenes* |
| SBP00165 | Parsley | *Ottowia oryzae* |
| SBP00165 | Parsley | *Ottowia* sp. oral taxon 894 |
| SBP00165 | Parsley | *Ovine atadenovirus* D |
| SBP00165 | Parsley | *Oxalobacter formigenes* |
| SBP00165 | Parsley | *Paenibacillaceae bacterium* GAS479 |
| SBP00165 | Parsley | *Paenibacillus alvei* |
| SBP00165 | Parsley | *Paenibacillus chitinolyticus* |
| SBP00165 | Parsley | *Paenibacillus crassostreae* |
| SBP00165 | Parsley | *Paenibacillus donghaensis* |
| SBP00165 | Parsley | *Paenibacillus durus* |
| SBP00165 | Parsley | *Paenibacillus glucanolyticus* |
| SBP00165 | Parsley | *Paenibacillus lautus* |
| SBP00165 | Parsley | *Paenibacillus mucilaginosus* |
| SBP00165 | Parsley | *Paenibacillus odorifer* |
| SBP00165 | Parsley | *Paenibacillus physcomitrellae* |
| SBP00165 | Parsley | *Paenibacillus polymyxa* |

TABLE 3-continued

List of species identified in each metagenomic sample of each SBP Sample

| SBP ID | SBP Host Common Name | Genus sp. |
|---|---|---|
| SBP00165 | Parsley | *Paenibacillus sabinae* |
| SBP00165 | Parsley | *Paenibacillus* sp. CAA11 |
| SBP00165 | Parsley | *Paenibacillus* sp. FSL H7-0357 |
| SBP00165 | Parsley | *Paenibacillus* sp. FSL P4-0081 |
| SBP00165 | Parsley | *Paenibacillus* sp. FSL R5-0345 |
| SBP00165 | Parsley | *Paenibacillus* sp. FSL R7-0331 |
| SBP00165 | Parsley | *Paenibacillus* sp. JDR-2 |
| SBP00165 | Parsley | *Paenibacillus* sp. MBLB1234 |
| SBP00165 | Parsley | *Paenibacillus* sp. RUD330 |
| SBP00165 | Parsley | *Paenibacillus xylanexedens* |
| SBP00165 | Parsley | *Palaeococcus pacificus* |
| SBP00165 | Parsley | *Paludisphaera borealis* |
| SBP00165 | Parsley | *Pandoraea apista* |
| SBP00165 | Parsley | *Pandoraea faecigallinarum* |
| SBP00165 | Parsley | *Pandoraea norimbergensis* |
| SBP00165 | Parsley | *Pandoraea oxalativorans* |
| SBP00165 | Parsley | *Pandoraea pnomenusa* |
| SBP00165 | Parsley | *Pandoraea pulmonicola* |
| SBP00165 | Parsley | *Pandoraea sputorum* |
| SBP00165 | Parsley | *Pandoraea thiooxydans* |
| SBP00165 | Parsley | *Pandoraea vervacti* |
| SBP00165 | Parsley | *Pandoravirus inopinatum* |
| SBP00165 | Parsley | *Pandoravirus macleodensis* |
| SBP00165 | Parsley | *Pandoravirus quercus* |
| SBP00165 | Parsley | *Pannonibacter phragmitetus* |
| SBP00165 | Parsley | *Pantoea agglomerans* |
| SBP00165 | Parsley | *Pantoea alhagi* |
| SBP00165 | Parsley | *Pantoea ananatis* |
| SBP00165 | Parsley | *Pantoea rwandensis* |
| SBP00165 | Parsley | *Pantoea* sp. At-9b |
| SBP00165 | Parsley | *Pantoea* sp. PSNIH1 |
| SBP00165 | Parsley | *Pantoea* sp. PSNIH2 |
| SBP00165 | Parsley | *Pantoea stewartii* |
| SBP00165 | Parsley | *Pantoea vagans* |
| SBP00165 | Parsley | *Paraburkholderia aromaticivorans* |
| SBP00165 | Parsley | *Paraburkholderia caffeinilytica* |
| SBP00165 | Parsley | *Paraburkholderia caledonica* |
| SBP00165 | Parsley | *Paraburkholderia caribensis* |
| SBP00165 | Parsley | *Paraburkholderia fungorum* |
| SBP00165 | Parsley | *Paraburkholderia graminis* |
| SBP00165 | Parsley | *Paraburkholderia hospita* |
| SBP00165 | Parsley | *Paraburkholderia phenoliruptrix* |
| SBP00165 | Parsley | *Paraburkholderia phymatum* |
| SBP00165 | Parsley | *Paraburkholderia phytofirmans* |
| SBP00165 | Parsley | *Paraburkholderia rhizoxinica* |
| SBP00165 | Parsley | *Paraburkholderia* sp. DCR13 |
| SBP00165 | Parsley | *Paraburkholderia* sp. SOS3 |
| SBP00165 | Parsley | *Paraburkholderia sprentiae* |
| SBP00165 | Parsley | *Paraburkholderia terrae* |
| SBP00165 | Parsley | *Paraburkholderia terricola* |
| SBP00165 | Parsley | *Paraburkholderia xenovorans* |
| SBP00165 | Parsley | *Paracoccus aminophilus* |
| SBP00165 | Parsley | *Paracoccus aminovorans* |
| SBP00165 | Parsley | *Paracoccus contaminans* |
| SBP00165 | Parsley | *Paracoccus denitrificans* |
| SBP00165 | Parsley | *Paracoccus* sp. Arc7-R13 |
| SBP00165 | Parsley | *Paracoccus* sp. BM15 |
| SBP00165 | Parsley | *Paracoccus* sp. CBA4604 |
| SBP00165 | Parsley | *Paracoccus* sp. SC2-6 |
| SBP00165 | Parsley | *Paracoccus yeei* |
| SBP00165 | Parsley | *Paracoccus zhejiangensis* |
| SBP00165 | Parsley | *Paraoerskovia marina* |
| SBP00165 | Parsley | *Paraprevotella xylaniphila* |
| SBP00165 | Parsley | *Pararhodospirillum photometricum* |
| SBP00165 | Parsley | *Parascardovia denticolens* |
| SBP00165 | Parsley | *Parolsenella catena* |
| SBP00165 | Parsley | *Parvibaculum lavamentivorans* |
| SBP00165 | Parsley | *Pasteurella multocida* |
| SBP00165 | Parsley | *Paucibacter* sp. KCTC 42545 |
| SBP00165 | Parsley | *Pectobacterium atrosepticum* |
| SBP00165 | Parsley | *Pectobacterium carotovorum* |
| SBP00165 | Parsley | *Pectobacterium parmentieri* |
| SBP00165 | Parsley | *Pectobacterium polaris* |
| SBP00165 | Parsley | *Pectobacterium wasabiae* |
| SBP00165 | Parsley | *Pediococcus pentosaceus* |
| SBP00165 | Parsley | *Pedobacter ginsengisoli* |

TABLE 3-continued

List of species identified in each metagenomic sample of each SBP Sample

| SBP ID | SBP Host Common Name | Genus sp. |
|---|---|---|
| SBP00165 | Parsley | Pedobacter sp. eg |
| SBP00165 | Parsley | Pedobacter sp. G11 |
| SBP00165 | Parsley | Pelagibaca abyssi |
| SBP00165 | Parsley | Pelagibacterium halotolerans |
| SBP00165 | Parsley | Pelobacter acetylenicus |
| SBP00165 | Parsley | Pelobacter propionicus |
| SBP00165 | Parsley | Pelobacter sp. SFB93 |
| SBP00165 | Parsley | Pelosinus fermentans |
| SBP00165 | Parsley | Persephonella marina |
| SBP00165 | Parsley | Persicobacter sp. JZB09 |
| SBP00165 | Parsley | Phaeobacter gallaeciensis |
| SBP00165 | Parsley | Phaeobacter inhibens |
| SBP00165 | Parsley | Phaeobacter piscinae |
| SBP00165 | Parsley | Phenylobacterium sp. HYN0004 |
| SBP00165 | Parsley | Phenylobacterium zucineum |
| SBP00165 | Parsley | Photobacterium damselae |
| SBP00165 | Parsley | Photobacterium gaetbulicola |
| SBP00165 | Parsley | Photorhabdus laumondii |
| SBP00165 | Parsley | Photorhabdus thracensis |
| SBP00165 | Parsley | Phreatobacter cathodiphilus |
| SBP00165 | Parsley | Phreatobacter stygius |
| SBP00165 | Parsley | Phycicoccus dokdonensis |
| SBP00165 | Parsley | Phycisphaera mikurensis |
| SBP00165 | Parsley | Phyllobacterium zundukense |
| SBP00165 | Parsley | Phytobacter ursingii |
| SBP00165 | Parsley | Pigmentiphaga sp. H8 |
| SBP00165 | Parsley | Pimelobacter simplex |
| SBP00165 | Parsley | Planctomyces sp. SH-PL14 |
| SBP00165 | Parsley | Planctomyces sp. SH-PL62 |
| SBP00165 | Parsley | Planctopirus limnophila |
| SBP00165 | Parsley | Planktothrix agardhii |
| SBP00165 | Parsley | Planococcus rifietoensis |
| SBP00165 | Parsley | Planococcus sp. MB-3u-03 |
| SBP00165 | Parsley | Plantactinospora sp. BB1 |
| SBP00165 | Parsley | Plantactinospora sp. KBS50 |
| SBP00165 | Parsley | Plantibacter flavus |
| SBP00165 | Parsley | Plantibacter sp. |
| SBP00165 | Parsley | Plantibacter sp. PA-3-X8 |
| SBP00165 | Parsley | Plautia stali |
| SBP00165 | Parsley | Plautia stali symbiont |
| SBP00165 | Parsley | Pleomorphomonas sp. SM30 |
| SBP00165 | Parsley | Plesiomonas shigelloides |
| SBP00165 | Parsley | Pleurocapsa minor |
| SBP00165 | Parsley | Pluralibacter gergoviae |
| SBP00165 | Parsley | Polaribacter sp. KT25b |
| SBP00165 | Parsley | Polaribacter sp. MED152 |
| SBP00165 | Parsley | Polaribacter sp. SA4-10 |
| SBP00165 | Parsley | Polaribacter vadi |
| SBP00165 | Parsley | Polaromonas naphthalenivorans |
| SBP00165 | Parsley | Polaromonas sp. JS666 |
| SBP00165 | Parsley | Polaromonas sp. SP1 |
| SBP00165 | Parsley | Polymorphum gilvum |
| SBP00165 | Parsley | Polynucleobacter asymbioticus |
| SBP00165 | Parsley | Polynucleobacter difficilis |
| SBP00165 | Parsley | Polynucleobacter necessarius |
| SBP00165 | Parsley | Pontibacter actiniarum |
| SBP00165 | Parsley | Porphyrobacter HT-58-2 |
| SBP00165 | Parsley | Porphyrobacter neustonensis |
| SBP00165 | Parsley | Porphyrobacter sp. CACIAM 03H1 |
| SBP00165 | Parsley | Porphyrobacter sp. LM 6 |
| SBP00165 | Parsley | Pragia fontium |
| SBP00165 | Parsley | Prauserella marina |
| SBP00165 | Parsley | Prevotella dentalis |
| SBP00165 | Parsley | Prevotella intermedia |
| SBP00165 | Parsley | Prochlorococcus marinus |
| SBP00165 | Parsley | Prochlorococcus phage P-HM2 |
| SBP00165 | Parsley | Propionibacterium acidifaciens |
| SBP00165 | Parsley | Propionibacterium australiense |
| SBP00165 | Parsley | Propionibacterium freudenreichii |
| SBP00165 | Parsley | Proteus mirabilis |
| SBP00165 | Parsley | Proteus vulgaris |
| SBP00165 | Parsley | Providencia alcalifaciens |
| SBP00165 | Parsley | Providencia rettgeri |
| SBP00165 | Parsley | Providencia stuartii |
| SBP00165 | Parsley | Pseudanabaena sp. PCC 7367 |
| SBP00165 | Parsley | Pseudarthrobacter chlorophenolicus |

TABLE 3-continued

List of species identified in each metagenomic sample of each SBP Sample

| SBP ID | SBP Host Common Name | Genus sp. |
|---|---|---|
| SBP00165 | Parsley | *Pseudarthrobacter equi* |
| SBP00165 | Parsley | *Pseudarthrobacter phenanthrenivorans* |
| SBP00165 | Parsley | *Pseudarthrobacter sulfonivorans* |
| SBP00165 | Parsley | *Pseudoalteromonas atlantica* |
| SBP00165 | Parsley | *Pseudoalteromonas donghaensis* |
| SBP00165 | Parsley | *Pseudoalteromonas luteoviolacea* |
| SBP00165 | Parsley | *Pseudoalteromonas piratica* |
| SBP00165 | Parsley | *Pseudoalteromonas* sp. R3 |
| SBP00165 | Parsley | *Pseudoalteromonas spongiae* |
| SBP00165 | Parsley | *Pseudodesulfovibrio aespoeensis* |
| SBP00165 | Parsley | *Pseudodesulfovibrio piezophilus* |
| SBP00165 | Parsley | *Pseudoflavitalea* sp. SGH32-13 |
| SBP00165 | Parsley | *Pseudogulbenkiania* sp. NH8B |
| SBP00165 | Parsley | *Pseudohongiella spirulinae* |
| SBP00165 | Parsley | *Pseudolabrys taiwanensis* |
| SBP00165 | Parsley | *Pseudomonadaceae bacterium* SI-3 |
| SBP00165 | Parsley | *Pseudomonas aeruginosa* |
| SBP00165 | Parsley | *Pseudomonas agarici* |
| SBP00165 | Parsley | *Pseudomonas alcaligenes* |
| SBP00165 | Parsley | *Pseudomonas alcaliphila* |
| SBP00165 | Parsley | *Pseudomonas alkylphenolica* |
| SBP00165 | Parsley | *Pseudomonas amygdali* |
| SBP00165 | Parsley | *Pseudomonas antarctica* |
| SBP00165 | Parsley | *Pseudomonas arsenicoxydans* |
| SBP00165 | Parsley | *Pseudomonas asplenii* |
| SBP00165 | Parsley | *Pseudomonas avellanae* |
| SBP00165 | Parsley | *Pseudomonas azotoformans* |
| SBP00165 | Parsley | *Pseudomonas balearica* |
| SBP00165 | Parsley | *Pseudomonas brassicacearum* |
| SBP00165 | Parsley | *Pseudomonas brenneri* |
| SBP00165 | Parsley | *Pseudomonas cedrina* |
| SBP00165 | Parsley | *Pseudomonas cerasi* |
| SBP00165 | Parsley | *Pseudomonas chlororaphis* |
| SBP00165 | Parsley | *Pseudomonas cichorii* |
| SBP00165 | Parsley | *Pseudomonas citronellolis* |
| SBP00165 | Parsley | *Pseudomonas corrugata* |
| SBP00165 | Parsley | *Pseudomonas cremoricolorata* |
| SBP00165 | Parsley | *Pseudomonas entomophila* |
| SBP00165 | Parsley | *Pseudomonas extremaustralis* |
| SBP00165 | Parsley | *Pseudomonas extremorientalis* |
| SBP00165 | Parsley | *Pseudomonas fluorescens* |
| SBP00165 | Parsley | *Pseudomonas fragi* |
| SBP00165 | Parsley | *Pseudomonas frederiksbergensis* |
| SBP00165 | Parsley | *Pseudomonas fulva* |
| SBP00165 | Parsley | *Pseudomonas furukawaii* |
| SBP00165 | Parsley | *Pseudomonas fuscovaginae* |
| SBP00165 | Parsley | *Pseudomonas granadensis* |
| SBP00165 | Parsley | *Pseudomonas guangdongensis* |
| SBP00165 | Parsley | *Pseudomonas knackmussii* |
| SBP00165 | Parsley | *Pseudomonas koreensis* |
| SBP00165 | Parsley | *Pseudomonas kribbensis* |
| SBP00165 | Parsley | *Pseudomonas libanensis* |
| SBP00165 | Parsley | *Pseudomonas lini* |
| SBP00165 | Parsley | *Pseudomonas litoralis* |
| SBP00165 | Parsley | *Pseudomonas lurida* |
| SBP00165 | Parsley | *Pseudomonas mandelii* |
| SBP00165 | Parsley | *Pseudomonas mediterranea* |
| SBP00165 | Parsley | *Pseudomonas mendocina* |
| SBP00165 | Parsley | *Pseudomonas monteilii* |
| SBP00165 | Parsley | *Pseudomonas moraviensis* |
| SBP00165 | Parsley | *Pseudomonas mosselii* |
| SBP00165 | Parsley | *Pseudomonas mucidolens* |
| SBP00165 | Parsley | *Pseudomonas orientalis* |
| SBP00165 | Parsley | *Pseudomonas oryzae* |
| SBP00165 | Parsley | *Pseudomonas oryzihabitans* |
| SBP00165 | Parsley | *Pseudomonas palleroniana* |
| SBP00165 | Parsley | *Pseudomonas parafulva* |
| SBP00165 | Parsley | *Pseudomonas phage* phiPSA1 |
| SBP00165 | Parsley | *Pseudomonas plecoglossicida* |
| SBP00165 | Parsley | *Pseudomonas poae* |
| SBP00165 | Parsley | *Pseudomonas pohangensis* |
| SBP00165 | Parsley | *Pseudomonas prosekii* |
| SBP00165 | Parsley | *Pseudomonas protegens* |
| SBP00165 | Parsley | *Pseudomonas psychrophila* |
| SBP00165 | Parsley | *Pseudomonas psychrotolerans* |
| SBP00165 | Parsley | *Pseudomonas putida* |

TABLE 3-continued

List of species identified in each metagenomic sample of each SBP Sample

| SBP ID | SBP Host Common Name | Genus sp. |
|---|---|---|
| SBP00165 | Parsley | *Pseudomonas reinekei* |
| SBP00165 | Parsley | *Pseudomonas resinovorans* |
| SBP00165 | Parsley | *Pseudomonas rhizosphaerae* |
| SBP00165 | Parsley | *Pseudomonas rhodesiae* |
| SBP00165 | Parsley | *Pseudomonas sabulinigri* |
| SBP00165 | Parsley | *Pseudomonas salegens* |
| SBP00165 | Parsley | *Pseudomonas saudiphocaensis* |
| SBP00165 | Parsley | *Pseudomonas savastanoi* |
| SBP00165 | Parsley | *Pseudomonas sihuiensis* |
| SBP00165 | Parsley | *Pseudomonas silesiensis* |
| SBP00165 | Parsley | *Pseudomonas simiae* |
| SBP00165 | Parsley | *Pseudomonas soli* |
| SBP00165 | Parsley | *Pseudomonas sp.* |
| SBP00165 | Parsley | *Pseudomonas sp.* 02C 26 |
| SBP00165 | Parsley | *Pseudomonas sp.* 09C 129 |
| SBP00165 | Parsley | *Pseudomonas sp.* 31-12 |
| SBP00165 | Parsley | *Pseudomonas sp.* 7SR1 |
| SBP00165 | Parsley | *Pseudomonas sp.* A214 |
| SBP00165 | Parsley | *Pseudomonas sp.* AK6U |
| SBP00165 | Parsley | *Pseudomonas sp.* ATCC 13867 |
| SBP00165 | Parsley | *Pseudomonas sp.* B10 |
| SBP00165 | Parsley | *Pseudomonas sp.* bs2935 |
| SBP00165 | Parsley | *Pseudomonas sp.* CC6-YY-74 |
| SBP00165 | Parsley | *Pseudomonas sp.* CCOS 191 |
| SBP00165 | Parsley | *Pseudomonas sp.* CMR12a |
| SBP00165 | Parsley | *Pseudomonas sp.* CMR5c |
| SBP00165 | Parsley | *Pseudomonas sp.* DR 5-09 |
| SBP00165 | Parsley | *Pseudomonas sp.* DY-1 |
| SBP00165 | Parsley | *Pseudomonas sp.* FDAARGOS_380 |
| SBP00165 | Parsley | *Pseudomonas sp.* FGI182 |
| SBP00165 | Parsley | *Pseudomonas sp.* GR 6-02 |
| SBP00165 | Parsley | *Pseudomonas sp.* HLS-6 |
| SBP00165 | Parsley | *Pseudomonas sp.* JY-Q |
| SBP00165 | Parsley | *Pseudomonas sp.* K2W31S-8 |
| SBP00165 | Parsley | *Pseudomonas sp.* LAB-08 |
| SBP00165 | Parsley | *Pseudomonas sp.* LBUM920 |
| SBP00165 | Parsley | *Pseudomonas sp.* Leaf58 |
| SBP00165 | Parsley | *Pseudomonas sp.* LG1D9 |
| SBP00165 | Parsley | *Pseudomonas sp.* LG1E9 |
| SBP00165 | Parsley | *Pseudomonas sp.* LH1G9 |
| SBP00165 | Parsley | *Pseudomonas sp.* LPH1 |
| SBP00165 | Parsley | *Pseudomonas sp.* LTGT-11-2Z |
| SBP00165 | Parsley | *Pseudomonas sp.* LTJR-52 |
| SBP00165 | Parsley | *Pseudomonas sp.* Lz4W |
| SBP00165 | Parsley | *Pseudomonas sp.* M30-35 |
| SBP00165 | Parsley | *Pseudomonas sp.* MRSN12121 |
| SBP00165 | Parsley | *Pseudomonas sp.* MT-1 |
| SBP00165 | Parsley | *Pseudomonas sp.* MYb193 |
| SBP00165 | Parsley | *Pseudomonas sp.* NC02 |
| SBP00165 | Parsley | *Pseudomonas sp.* NS1(2017) |
| SBP00165 | Parsley | *Pseudomonas sp.* Os17 |
| SBP00165 | Parsley | *Pseudomonas sp.* phDV1 |
| SBP00165 | Parsley | *Pseudomonas sp.* PONIH3 |
| SBP00165 | Parsley | *Pseudomonas sp.* R1-43-08 |
| SBP00165 | Parsley | *Pseudomonas sp.* R11-23-07 |
| SBP00165 | Parsley | *Pseudomonas sp.* R2-37-08W |
| SBP00165 | Parsley | *Pseudomonas sp.* R2-60-08W |
| SBP00165 | Parsley | *Pseudomonas sp.* R2-7-07 |
| SBP00165 | Parsley | *Pseudomonas sp.* R2A2 |
| SBP00165 | Parsley | *Pseudomonas sp.* R3-18-08 |
| SBP00165 | Parsley | *Pseudomonas sp.* R3-52-08 |
| SBP00165 | Parsley | *Pseudomonas sp.* R4-34-07 |
| SBP00165 | Parsley | *Pseudomonas sp.* R4-35-07 |
| SBP00165 | Parsley | *Pseudomonas sp.* R4-39-08 |
| SBP00165 | Parsley | *Pseudomonas sp.* R5-89-07 |
| SBP00165 | Parsley | *Pseudomonas sp.* RU47 |
| SBP00165 | Parsley | *Pseudomonas sp.* S-6-2 |
| SBP00165 | Parsley | *Pseudomonas sp.* S09G 359 |
| SBP00165 | Parsley | *Pseudomonas sp.* s211(2017) |
| SBP00165 | Parsley | *Pseudomonas sp.* SGAir0191 |
| SBP00165 | Parsley | *Pseudomonas sp.* St29 |
| SBP00165 | Parsley | *Pseudomonas sp.* StFLB209 |
| SBP00165 | Parsley | *Pseudomonas sp.* SWI36 |
| SBP00165 | Parsley | *Pseudomonas sp.* SWI44 |
| SBP00165 | Parsley | *Pseudomonas sp.* SWI6 |
| SBP00165 | Parsley | *Pseudomonas sp.* SXM-1 |

TABLE 3-continued

List of species identified in each metagenomic sample of each SBP Sample

| SBP ID | SBP Host Common Name | Genus sp. |
|---|---|---|
| SBP00165 | Parsley | *Pseudomonas* sp. TCU-HL1 |
| SBP00165 | Parsley | *Pseudomonas* sp. TKP |
| SBP00165 | Parsley | *Pseudomonas* sp. TMW 2.1634 |
| SBP00165 | Parsley | *Pseudomonas* sp. URMO17WK12:I11 |
| SBP00165 | Parsley | *Pseudomonas* sp. UW4 |
| SBP00165 | Parsley | *Pseudomonas* sp. VLB120 |
| SBP00165 | Parsley | *Pseudomonas* sp. WCS374 |
| SBP00165 | Parsley | *Pseudomonas* sp. XWY-1 |
| SBP00165 | Parsley | *Pseudomonas* sp. 2003-0.4C(8344-21) |
| SBP00165 | Parsley | *Pseudomonas stutzeri* |
| SBP00165 | Parsley | *Pseudomonas synxantha* |
| SBP00165 | Parsley | *Pseudomonas syringae* |
| SBP00165 | Parsley | *Pseudomonas syringae* group genomosp. 3 |
| SBP00165 | Parsley | *Pseudomonas taetrolens* |
| SBP00165 | Parsley | *Pseudomonas thivervalensis* |
| SBP00165 | Parsley | *Pseudomonas tolaasii* |
| SBP00165 | Parsley | *Pseudomonas trivialis* |
| SBP00165 | Parsley | *Pseudomonas umsongensis* |
| SBP00165 | Parsley | *Pseudomonas vancouverensis* |
| SBP00165 | Parsley | *Pseudomonas veronii* |
| SBP00165 | Parsley | *Pseudomonas versuta* |
| SBP00165 | Parsley | *Pseudomonas viridiflava* |
| SBP00165 | Parsley | *Pseudomonas xanthomarina* |
| SBP00165 | Parsley | *Pseudomonas xinjiangensis* |
| SBP00165 | Parsley | *Pseudomonas yamanorum* |
| SBP00165 | Parsley | *Pseudonocardia autotrophica* |
| SBP00165 | Parsley | *Pseudonocardia dioxanivorans* |
| SBP00165 | Parsley | *Pseudonocardia* sp. AL041005-10 |
| SBP00165 | Parsley | *Pseudonocardia* sp. HH130629-09 |
| SBP00165 | Parsley | *Pseudonocardia* sp. HH130630-07 |
| SBP00165 | Parsley | *Pseudopropionibacterium propionicum* |
| SBP00165 | Parsley | *Pseudorhodobacter* sp. S12M18 |
| SBP00165 | Parsley | *Pseudorhodoplanes sinuspersici* |
| SBP00165 | Parsley | *Pseudovibrio* sp. FO-BEG1 |
| SBP00165 | Parsley | *Pseudoxanthomonas spadix* |
| SBP00165 | Parsley | *Pseudoxanthomonas suwonensis* |
| SBP00165 | Parsley | *Psychrobacter alimentarius* |
| SBP00165 | Parsley | *Psychrobacter* sp. DAB_AL43B |
| SBP00165 | Parsley | *Psychrobacter* sp. P11F6 |
| SBP00165 | Parsley | *Psychrobacter* sp. YP14 |
| SBP00165 | Parsley | *Psychroflexus torquis* |
| SBP00165 | Parsley | *Psychromicrobium lacuslunae* |
| SBP00165 | Parsley | *Psychromonas ingrahamii* |
| SBP00165 | Parsley | *Pusillimonas* sp. T7-7 |
| SBP00165 | Parsley | *Qipengyuania sediminis* |
| SBP00165 | Parsley | *Rahnella aquatilis* |
| SBP00165 | Parsley | *Rahnella* sp. ERMR1:05 |
| SBP00165 | Parsley | *Rahnella* sp. Y9602 |
| SBP00165 | Parsley | *Ralstonia insidiosa* |
| SBP00165 | Parsley | *Ralstonia mannitolilytica* |
| SBP00165 | Parsley | *Ralstonia pickettii* |
| SBP00165 | Parsley | *Ralstonia pseudosolanacearum* |
| SBP00165 | Parsley | *Ralstonia solanacearum* |
| SBP00165 | Parsley | *Ramlibacter tataouinensis* |
| SBP00165 | Parsley | *Raoultella ornithinolytica* |
| SBP00165 | Parsley | *Raoultella planticola* |
| SBP00165 | Parsley | *Raoultella terrigena* |
| SBP00165 | Parsley | *Raphidiopsis curvata* |
| SBP00165 | Parsley | *Rathayibacter festucae* |
| SBP00165 | Parsley | *Rathayibacter iranicus* |
| SBP00165 | Parsley | *Rathayibacter rathayi* |
| SBP00165 | Parsley | *Rathayibacter toxicus* |
| SBP00165 | Parsley | *Rathayibacter tritici* |
| SBP00165 | Parsley | *Reinekea forsetii* |
| SBP00165 | Parsley | *Rheinheimera* sp. LHK132 |
| SBP00165 | Parsley | *Rhizobacter gummiphilus* |
| SBP00165 | Parsley | *Rhizobium etli* |
| SBP00165 | Parsley | *Rhizobium favelukesii* |
| SBP00165 | Parsley | *Rhizobium gallicum* |
| SBP00165 | Parsley | *Rhizobium jaguaris* |
| SBP00165 | Parsley | *Rhizobium leguminosarum* |
| SBP00165 | Parsley | *Rhizobium phaseoli* |
| SBP00165 | Parsley | *Rhizobium* sp. 11515TR |
| SBP00165 | Parsley | *Rhizobium* sp. ACO-34A |
| SBP00165 | Parsley | *Rhizobium* sp. CIAT894 |
| SBP00165 | Parsley | *Rhizobium* sp. IRBG74 |

TABLE 3-continued

List of species identified in each metagenomic sample of each SBP Sample

| SBP ID | SBP Host Common Name | Genus sp. |
|---|---|---|
| SBP00165 | Parsley | *Rhizobium* sp. Kim5 |
| SBP00165 | Parsley | *Rhizobium* sp. NT-26 |
| SBP00165 | Parsley | *Rhizobium* sp. NXC14 |
| SBP00165 | Parsley | *Rhizobium* sp. NXC24 |
| SBP00165 | Parsley | *Rhizobium* sp. S41 |
| SBP00165 | Parsley | *Rhizobium* sp. Y9 |
| SBP00165 | Parsley | *Rhizobium tropici* |
| SBP00165 | Parsley | *Rhizorhabdus dicambivorans* |
| SBP00165 | Parsley | *Rhodanobacter denitrificans* |
| SBP00165 | Parsley | *Rhodanobacteraceae bacterium* Dysh456 |
| SBP00165 | Parsley | *Rhodobaca barguzinensis* |
| SBP00165 | Parsley | *Rhodobacter blasticus* |
| SBP00165 | Parsley | *Rhodobacter capsulatus* |
| SBP00165 | Parsley | *Rhodobacter* sp. CZR27 |
| SBP00165 | Parsley | *Rhodobacter* sp. LPB0142 |
| SBP00165 | Parsley | *Rhodobacter sphaeroides* |
| SBP00165 | Parsley | *Rhodobacteraceae bacterium* |
| SBP00165 | Parsley | *Rhodobacteraceae bacterium* QY30 |
| SBP00165 | Parsley | *Rhodobiaceae bacterium* |
| SBP00165 | Parsley | *Rhodococcus aetherivorans* |
| SBP00165 | Parsley | *Rhodococcus coprophilus* |
| SBP00165 | Parsley | *Rhodococcus erythropolis* |
| SBP00165 | Parsley | *Rhodococcus fascians* |
| SBP00165 | Parsley | *Rhodococcus hoagii* |
| SBP00165 | Parsley | *Rhodococcus jostii* |
| SBP00165 | Parsley | *Rhodococcus opacus* |
| SBP00165 | Parsley | *Rhodococcus pyridinivorans* |
| SBP00165 | Parsley | *Rhodococcus rhodochrous* |
| SBP00165 | Parsley | *Rhodococcus ruber* |
| SBP00165 | Parsley | *Rhodococcus* sp. B7740 |
| SBP00165 | Parsley | *Rhodococcus* sp. MTM3W5.2 |
| SBP00165 | Parsley | *Rhodococcus* sp. P1Y |
| SBP00165 | Parsley | *Rhodococcus* sp. PBTS 1 |
| SBP00165 | Parsley | *Rhodococcus* sp. PBTS 2 |
| SBP00165 | Parsley | *Rhodococcus* sp. S2-17 |
| SBP00165 | Parsley | *Rhodococcus* sp. WB1 |
| SBP00165 | Parsley | *Rhodococcus* sp. X156 |
| SBP00165 | Parsley | *Rhodocyclaceae bacterium* |
| SBP00165 | Parsley | *Rhodoferax antarcticus* |
| SBP00165 | Parsley | *Rhodoferax ferrireducens* |
| SBP00165 | Parsley | *Rhodoferax koreense* |
| SBP00165 | Parsley | *Rhodoferax saidenbachensis* |
| SBP00165 | Parsley | *Rhodomicrobium vannielii* |
| SBP00165 | Parsley | *Rhodopirellula baltica* |
| SBP00165 | Parsley | *Rhodoplanes* sp. Z2-YC6860 |
| SBP00165 | Parsley | *Rhodopseudomonas palustris* |
| SBP00165 | Parsley | *Rhodospirillum centenum* |
| SBP00165 | Parsley | *Rhodospirillum rubrum* |
| SBP00165 | Parsley | *Rhodothermaceae bacterium* |
| SBP00165 | Parsley | *Rhodothermaceae bacterium* RA |
| SBP00165 | Parsley | *Rhodothermus marinus* |
| SBP00165 | Parsley | *Rhodovulum* sp. MB263 |
| SBP00165 | Parsley | *Rhodovulum* sp. PS |
| SBP00165 | Parsley | *Rhodovulum sulfidophilum* |
| SBP00165 | Parsley | *Rickettsia* endosymbiont of *Bemisia tabaci* |
| SBP00165 | Parsley | *Rickettsia* endosymbiont of *Ixodes scapularis* |
| SBP00165 | Parsley | *Riemerella anatipestifer* |
| SBP00165 | Parsley | *Rivularia* sp. PCC 7116 |
| SBP00165 | Parsley | *Robiginitalea biformata* |
| SBP00165 | Parsley | *Roseateles depolymerans* |
| SBP00165 | Parsley | *Roseibacterium elongatum* |
| SBP00165 | Parsley | *Roseiflexus castenholzii* |
| SBP00165 | Parsley | *Roseitalea porphyridii* |
| SBP00165 | Parsley | *Roseomonas gilardii* |
| SBP00165 | Parsley | *Roseomonas* sp. FDAARGOS_362 |
| SBP00165 | Parsley | *Rothia dentocariosa* |
| SBP00165 | Parsley | *Rothia mucilaginosa* |
| SBP00165 | Parsley | *Rubrivivax gelatinosus* |
| SBP00165 | Parsley | *Rubrobacter xylanophilus* |
| SBP00165 | Parsley | *Ruegeria pomeroyi* |
| SBP00165 | Parsley | *Ruegeria* sp. AD91A |
| SBP00165 | Parsley | *Rufibacter* sp. DG31D |
| SBP00165 | Parsley | *Rufibacter tibetensis* |
| SBP00165 | Parsley | *Ruminiclostridium cellulolyticum* |
| SBP00165 | Parsley | *Ruminococcus albus* |
| SBP00165 | Parsley | *Ruminococcus champanellensis* |

TABLE 3-continued

List of species identified in each metagenomic sample of each SBP Sample

| SBP ID | SBP Host Common Name | Genus sp. |
|---|---|---|
| SBP00165 | Parsley | *Rummeliibacillus stabekisii* |
| SBP00165 | Parsley | *Saccharomonospora azurea* |
| SBP00165 | Parsley | *Saccharomonospora cyanea* |
| SBP00165 | Parsley | *Saccharomonospora glauca* |
| SBP00165 | Parsley | *Saccharomonospora marina* |
| SBP00165 | Parsley | *Saccharopolyspora erythraea* |
| SBP00165 | Parsley | *Saccharospirillum mangrovi* |
| SBP00165 | Parsley | *Saccharothrix espanaensis* |
| SBP00165 | Parsley | *Sagittula* sp. P11 |
| SBP00165 | Parsley | *Salimicrobium jeotgali* |
| SBP00165 | Parsley | *Salinibacter ruber* |
| SBP00165 | Parsley | *Salinibacterium* sp. CGMCC 1.16371 |
| SBP00165 | Parsley | *Salinicola tamaricis* |
| SBP00165 | Parsley | *Salinigranum rubrum* |
| SBP00165 | Parsley | *Salinimonas* sp. HMF8227 |
| SBP00165 | Parsley | *Salinimonas* sp. N102 |
| SBP00165 | Parsley | *Salinisphaera* sp. LB1 |
| SBP00165 | Parsley | *Salinispora arenicola* |
| SBP00165 | Parsley | *Salinivibrio kushneri* |
| SBP00165 | Parsley | *Salipiger profundus* |
| SBP00165 | Parsley | *Salmonella bongori* |
| SBP00165 | Parsley | *Salmonella enterica* |
| SBP00165 | Parsley | *Sandaracinus amylolyticus* |
| SBP00165 | Parsley | *Sanguibacter keddieii* |
| SBP00165 | Parsley | *Scytonema* sp. NIES-4073 |
| SBP00165 | Parsley | *Sebaldella termitidis* |
| SBP00165 | Parsley | secondary endosymbiont of *Heteropsylla cubana* |
| SBP00165 | Parsley | *Sedimenticola thiotaurini* |
| SBP00165 | Parsley | *Sedimentitalea* sp. W43 |
| SBP00165 | Parsley | *Selenomonas sputigena* |
| SBP00165 | Parsley | *Seonamhaeicola* sp. S2-3 |
| SBP00165 | Parsley | *Serinicoccus chungangensis* |
| SBP00165 | Parsley | *Serinicoccus* sp. JLT9 |
| SBP00165 | Parsley | *Serpentinomonas mccroryi* |
| SBP00165 | Parsley | *Serpentinomonas raichei* |
| SBP00165 | Parsley | *Serratia fonticola* |
| SBP00165 | Parsley | *Serratia liquefaciens* |
| SBP00165 | Parsley | *Serratia marcescens* |
| SBP00165 | Parsley | *Serratia odorifera* |
| SBP00165 | Parsley | *Serratia plymuthica* |
| SBP00165 | Parsley | *Serratia proteamaculans* |
| SBP00165 | Parsley | *Serratia quinivorans* |
| SBP00165 | Parsley | *Serratia rubidaea* |
| SBP00165 | Parsley | *Serratia* sp. 3ACOL1 |
| SBP00165 | Parsley | *Serratia* sp. ATCC 39006 |
| SBP00165 | Parsley | *Serratia* sp. FDAARGOS_506 |
| SBP00165 | Parsley | *Serratia* sp. FGI94 |
| SBP00165 | Parsley | *Serratia* sp. LS-1 |
| SBP00165 | Parsley | *Serratia* sp. MYb239 |
| SBP00165 | Parsley | *Serratia* sp. YD25 |
| SBP00165 | Parsley | *Shewanella algae* |
| SBP00165 | Parsley | *Shewanella amazonensis* |
| SBP00165 | Parsley | *Shewanella baltica* |
| SBP00165 | Parsley | *Shewanella benthica* |
| SBP00165 | Parsley | *Shewanella frigidimarina* |
| SBP00165 | Parsley | *Shewanella japonica* |
| SBP00165 | Parsley | *Shewanella loihica* |
| SBP00165 | Parsley | *Shewanella marisflavi* |
| SBP00165 | Parsley | *Shewanella piezotolerans* |
| SBP00165 | Parsley | *Shewanella sediminis* |
| SBP00165 | Parsley | *Shewanella* sp. M2 |
| SBP00165 | Parsley | *Shewanella* sp. TH2012 |
| SBP00165 | Parsley | *Shewanella spongiae* |
| SBP00165 | Parsley | *Shewanella woodyi* |
| SBP00165 | Parsley | *Shimwellia blattae* |
| SBP00165 | Parsley | *Shinella* sp. HZN7 |
| SBP00165 | Parsley | *Sideroxydans lithotrophicus* |
| SBP00165 | Parsley | *Silicimonas algicola* |
| SBP00165 | Parsley | *Simiduia agarivorans* |
| SBP00165 | Parsley | *Simplicispira suum* |
| SBP00165 | Parsley | *Singulisphaera acidiphila* |
| SBP00165 | Parsley | *Sinomonas atrocyanea* |
| SBP00165 | Parsley | *Sinorhizobium americanum* |
| SBP00165 | Parsley | *Sinorhizobium fredii* |
| SBP00165 | Parsley | *Sinorhizobium medicae* |
| SBP00165 | Parsley | *Sinorhizobium meliloti* |

TABLE 3-continued

List of species identified in each metagenomic sample of each SBP Sample

| SBP ID | SBP Host Common Name | Genus sp. |
|---|---|---|
| SBP00165 | Parsley | *Sinorhizobium* sp. RAC02 |
| SBP00165 | Parsley | *Slackia heliotrinireducens* |
| SBP00165 | Parsley | *Snodgrassella alvi* |
| SBP00165 | Parsley | *Sodalis glossinidius* |
| SBP00165 | Parsley | *Sodalis praecaptivus* |
| SBP00165 | Parsley | *Solibacillus silvestris* |
| SBP00165 | Parsley | *Solibacillus* sp. RS-41 |
| SBP00165 | Parsley | *Solimonas* sp. K1W22B-7 |
| SBP00165 | Parsley | *Solitalea canadensis* |
| SBP00165 | Parsley | *Sorangium cellulosum* |
| SBP00165 | Parsley | Soybean Putnam virus |
| SBP00165 | Parsley | *Sphaerobacter thermophilus* |
| SBP00165 | Parsley | *Sphaerospermopsis kisseleviana* |
| SBP00165 | Parsley | *Sphingobacterium* sp. 21 |
| SBP00165 | Parsley | *Sphingobacterium* sp. B29 |
| SBP00165 | Parsley | *Sphingobacterium* sp. G1-14 |
| SBP00165 | Parsley | *Sphingobacterium thalpophilum* |
| SBP00165 | Parsley | *Sphingobium amiense* |
| SBP00165 | Parsley | *Sphingobium baderi* |
| SBP00165 | Parsley | *Sphingobium chlorophenolicum* |
| SBP00165 | Parsley | *Sphingobium cloacae* |
| SBP00165 | Parsley | *Sphingobium fuliginis* |
| SBP00165 | Parsley | *Sphingobium herbicidovorans* |
| SBP00165 | Parsley | *Sphingobium hydrophobicum* |
| SBP00165 | Parsley | *Sphingobium indicum* |
| SBP00165 | Parsley | *Sphingobium japonicum* |
| SBP00165 | Parsley | *Sphingobium* sp. EP60837 |
| SBP00165 | Parsley | *Sphingobium* sp. LF-16 |
| SBP00165 | Parsley | *Sphingobium* sp. MI1205 |
| SBP00165 | Parsley | *Sphingobium* sp. RAC03 |
| SBP00165 | Parsley | *Sphingobium* sp. SCG-1 |
| SBP00165 | Parsley | *Sphingobium* sp. SYK-6 |
| SBP00165 | Parsley | *Sphingobium* sp. TKS |
| SBP00165 | Parsley | *Sphingobium* sp. YBL2 |
| SBP00165 | Parsley | *Sphingobium* sp. YG1 |
| SBP00165 | Parsley | *Sphingobium yanoikuyae* |
| SBP00165 | Parsley | *Sphingomonas indica* |
| SBP00165 | Parsley | *Sphingomonas koreensis* |
| SBP00165 | Parsley | *Sphingomonas melonis* |
| SBP00165 | Parsley | *Sphingomonas panacis* |
| SBP00165 | Parsley | *Sphingomonas paucimobilis* |
| SBP00165 | Parsley | *Sphingomonas sanxanigenens* |
| SBP00165 | Parsley | *Sphingomonas* sp. AAP5 |
| SBP00165 | Parsley | *Sphingomonas* sp. C8-2 |
| SBP00165 | Parsley | *Sphingomonas* sp. Cra20 |
| SBP00165 | Parsley | *Sphingomonas* sp. FARSPH |
| SBP00165 | Parsley | *Sphingomonas* sp. JJ-A5 |
| SBP00165 | Parsley | *Sphingomonas* sp. KC8 |
| SBP00165 | Parsley | *Sphingomonas* sp. LK11 |
| SBP00165 | Parsley | *Sphingomonas* sp. LM7 |
| SBP00165 | Parsley | *Sphingomonas* sp. MM-1 |
| SBP00165 | Parsley | *Sphingomonas* sp. NIC1 |
| SBP00165 | Parsley | *Sphingomonas* sp. YZ-8 |
| SBP00165 | Parsley | *Sphingomonas taxi* |
| SBP00165 | Parsley | *Sphingomonas wittichii* |
| SBP00165 | Parsley | *Sphingopyxis alaskensis* |
| SBP00165 | Parsley | *Sphingopyxis fribergensis* |
| SBP00165 | Parsley | *Sphingopyxis granuli* |
| SBP00165 | Parsley | *Sphingopyxis macrogoltabida* |
| SBP00165 | Parsley | *Sphingopyxis* sp. 113P3 |
| SBP00165 | Parsley | *Sphingopyxis* sp. EG6 |
| SBP00165 | Parsley | *Sphingopyxis* sp. FD7 |
| SBP00165 | Parsley | *Sphingopyxis* sp. LPB0140 |
| SBP00165 | Parsley | *Sphingopyxis* sp. MG |
| SBP00165 | Parsley | *Sphingopyxis* sp. QXT-31 |
| SBP00165 | Parsley | *Sphingopyxis* sp. WS5A3p |
| SBP00165 | Parsley | *Sphingorhabdus* sp. Alg231-15 |
| SBP00165 | Parsley | *Sphingorhabdus* sp. M41 |
| SBP00165 | Parsley | *Sphingorhabdus* sp. YGSMI21 |
| SBP00165 | Parsley | *Sphingosinicella microcystinivorans* |
| SBP00165 | Parsley | *Sphingosinicella* sp. BN140058 |
| SBP00165 | Parsley | *Spiribacter curvatus* |
| SBP00165 | Parsley | *Spiribacter salinus* |
| SBP00165 | Parsley | *Spiroplasma apis* |
| SBP00165 | Parsley | *Spiroplasma clarkii* |
| SBP00165 | Parsley | *Spiroplasma diminutum* |

TABLE 3-continued

List of species identified in each metagenomic sample of each SBP Sample

| SBP ID | SBP Host Common Name | Genus sp. |
|---|---|---|
| SBP00165 | Parsley | *Spiroplasma helicoides* |
| SBP00165 | Parsley | *Spiroplasma litorale* |
| SBP00165 | Parsley | *Spirosoma pollinicola* |
| SBP00165 | Parsley | *Spirosoma radiotolerans* |
| SBP00165 | Parsley | *Sporolactobacillus terrae* |
| SBP00165 | Parsley | *Sporosarcina ureae* |
| SBP00165 | Parsley | *Stackebrandtia nassauensis* |
| SBP00165 | Parsley | *Stanieria cyanosphaera* |
| SBP00165 | Parsley | *Stanieria* sp. NIES-3757 |
| SBP00165 | Parsley | *Staphylococcus aureus* |
| SBP00165 | Parsley | *Staphylococcus epidermidis* |
| SBP00165 | Parsley | *Staphylococcus hominis* |
| SBP00165 | Parsley | *Staphylococcus kloosii* |
| SBP00165 | Parsley | *Staphylococcus pasteuri* |
| SBP00165 | Parsley | *Staphylococcus pettenkoferi* |
| SBP00165 | Parsley | *Staphylococcus xylosus* |
| SBP00165 | Parsley | *Stappia* sp. ES.058 |
| SBP00165 | Parsley | *Starkeya novella* |
| SBP00165 | Parsley | *Stella humosa* |
| SBP00165 | Parsley | *Stella vacuolata* |
| SBP00165 | Parsley | *Stenotrophomonas acidaminiphila* |
| SBP00165 | Parsley | *Stenotrophomonas maltophilia* |
| SBP00165 | Parsley | *Stenotrophomonas rhizophila* |
| SBP00165 | Parsley | *Stenotrophomonas* sp. |
| SBP00165 | Parsley | *Stenotrophomonas* sp. ESTM1D_MKCIP4_1 |
| SBP00165 | Parsley | *Stenotrophomonas* sp. G4 |
| SBP00165 | Parsley | *Stenotrophomonas* sp. LM091 |
| SBP00165 | Parsley | *Stenotrophomonas* sp. MYb57 |
| SBP00165 | Parsley | *Stenotrophomonas* sp. Pemsol |
| SBP00165 | Parsley | *Stenotrophomonas* sp. SAU14A_NAIMI4_5 |
| SBP00165 | Parsley | *Stenotrophomonas* sp. SAU14A_NAIMI4_8 |
| SBP00165 | Parsley | *Stenotrophomonas* sp. WZN-1 |
| SBP00165 | Parsley | *Stenotrophomonas* sp. YAU14A_MKIMI4_1 |
| SBP00165 | Parsley | *Stenotrophomonas* sp. YAU14D1_LEIMI4_1 |
| SBP00165 | Parsley | *Stenotrophomonas* sp. ZAC14A_NAIMI4_1 |
| SBP00165 | Parsley | *Stenotrophomonas* sp. ZAC14D2_NAIMI4_6 |
| SBP00165 | Parsley | *Stenotrophomonas* sp. ZAC14D2_NAIMI4_7 |
| SBP00165 | Parsley | *Steroidobacter denitrificans* |
| SBP00165 | Parsley | *Sterolibacteriaceae bacterium* 15B |
| SBP00165 | Parsley | *Stigmatella aurantiaca* |
| SBP00165 | Parsley | *Streptacidiphilus* sp. DSM 106435 |
| SBP00165 | Parsley | *Streptobacillus moniliformis* |
| SBP00165 | Parsley | *Streptococcus equi* |
| SBP00165 | Parsley | *Streptococcus mutans* |
| SBP00165 | Parsley | *Streptococcus oralis* |
| SBP00165 | Parsley | *Streptococcus phage* phi3396 |
| SBP00165 | Parsley | *Streptococcus pluranimalium* |
| SBP00165 | Parsley | *Streptococcus pneumoniae* |
| SBP00165 | Parsley | *Streptococcus ruminantium* |
| SBP00165 | Parsley | *Streptococcus suis* |
| SBP00165 | Parsley | *Streptomyces actuosus* |
| SBP00165 | Parsley | *Streptomyces albidoflavus* |
| SBP00165 | Parsley | *Streptomyces albireticuli* |
| SBP00165 | Parsley | *Streptomyces alboflavus* |
| SBP00165 | Parsley | *Streptomyces albulus* |
| SBP00165 | Parsley | *Streptomyces albus* |
| SBP00165 | Parsley | *Streptomyces ambofaciens* |
| SBP00165 | Parsley | *Streptomyces antibioticus* |
| SBP00165 | Parsley | *Streptomyces anulatus* |
| SBP00165 | Parsley | *Streptomyces asterosporus* |
| SBP00165 | Parsley | *Streptomyces avermitilis* |
| SBP00165 | Parsley | *Streptomyces bingchenggensis* |
| SBP00165 | Parsley | *Streptomyces cattleya* |
| SBP00165 | Parsley | *Streptomyces cavourensis* |
| SBP00165 | Parsley | *Streptomyces chartreusis* |
| SBP00165 | Parsley | *Streptomyces clavuligerus* |
| SBP00165 | Parsley | *Streptomyces collinus* |
| SBP00165 | Parsley | *Streptomyces davaonensis* |
| SBP00165 | Parsley | *Streptomyces dengpaensis* |
| SBP00165 | Parsley | *Streptomyces exfoliatus* |
| SBP00165 | Parsley | *Streptomyces formicae* |
| SBP00165 | Parsley | *Streptomyces fulvissimus* |
| SBP00165 | Parsley | *Streptomyces fungicidicus* |
| SBP00165 | Parsley | *Streptomyces gilvosporeus* |
| SBP00165 | Parsley | *Streptomyces glaucescens* |
| SBP00165 | Parsley | *Streptomyces globisporus* |

TABLE 3-continued

List of species identified in each metagenomic sample of each SBP Sample

| SBP ID | SBP Host Common Name | Genus sp. |
|---|---|---|
| SBP00165 | Parsley | *Streptomyces globosus* |
| SBP00165 | Parsley | *Streptomyces griseochromogenes* |
| SBP00165 | Parsley | *Streptomyces griseorubiginosus* |
| SBP00165 | Parsley | *Streptomyces griseoviridis* |
| SBP00165 | Parsley | *Streptomyces griseus* |
| SBP00165 | Parsley | *Streptomyces hundungensis* |
| SBP00165 | Parsley | *Streptomyces hygroscopicus* |
| SBP00165 | Parsley | *Streptomyces katrae* |
| SBP00165 | Parsley | *Streptomyces lavendulae* |
| SBP00165 | Parsley | *Streptomyces leeuwenhoekii* |
| SBP00165 | Parsley | *Streptomyces lincolnensis* |
| SBP00165 | Parsley | *Streptomyces lunaelactis* |
| SBP00165 | Parsley | *Streptomyces luteoverticillatus* |
| SBP00165 | Parsley | *Streptomyces lydicus* |
| SBP00165 | Parsley | *Streptomyces nigra* |
| SBP00165 | Parsley | *Streptomyces niveus* |
| SBP00165 | Parsley | *Streptomyces nodosus* |
| SBP00165 | Parsley | *Streptomyces noursei* |
| SBP00165 | Parsley | *Streptomyces olivaceus* |
| SBP00165 | Parsley | *Streptomyces olivoreticuli* |
| SBP00165 | Parsley | *Streptomyces pactum* |
| SBP00165 | Parsley | *Streptomyces parvulus* |
| SBP00165 | Parsley | *Streptomyces peucetius* |
| SBP00165 | Parsley | *Streptomyces pluripotens* |
| SBP00165 | Parsley | *Streptomyces pristinaespiralis* |
| SBP00165 | Parsley | *Streptomyces puniciscabiei* |
| SBP00165 | Parsley | *Streptomyces qaidamensis* |
| SBP00165 | Parsley | *Streptomyces reticuli* |
| SBP00165 | Parsley | *Streptomyces rimosus* |
| SBP00165 | Parsley | *Streptomyces roseochromogenus* |
| SBP00165 | Parsley | *Streptomyces rubrolavendulae* |
| SBP00165 | Parsley | *Streptomyces scabiei* |
| SBP00165 | Parsley | *Streptomyces seoulensis* |
| SBP00165 | Parsley | *Streptomyces* sp. 11-1-2 |
| SBP00165 | Parsley | *Streptomyces* sp. 2323.1 |
| SBP00165 | Parsley | *Streptomyces* sp. 3211 |
| SBP00165 | Parsley | *Streptomyces* sp. 3214.6 |
| SBP00165 | Parsley | *Streptomyces* sp. 4F |
| SBP00165 | Parsley | *Streptomyces* sp. 769 |
| SBP00165 | Parsley | *Streptomyces* sp. ADI95-16 |
| SBP00165 | Parsley | *Streptomyces* sp. CB09001 |
| SBP00165 | Parsley | *Streptomyces* sp. CCM_MD2014 |
| SBP00165 | Parsley | *Streptomyces* sp. CdTB01 |
| SBP00165 | Parsley | *Streptomyces* sp. CFMR 7 |
| SBP00165 | Parsley | *Streptomyces* sp. CMB-StM0423 |
| SBP00165 | Parsley | *Streptomyces* sp. CNQ-509 |
| SBP00165 | Parsley | *Streptomyces* sp. ETH9427 |
| SBP00165 | Parsley | *Streptomyces* sp. fd1-xmd |
| SBP00165 | Parsley | *Streptomyces* sp. Go-475 |
| SBP00165 | Parsley | *Streptomyces* sp. GSSD-12 |
| SBP00165 | Parsley | *Streptomyces* sp. HNM0039 |
| SBP00165 | Parsley | *Streptomyces* sp. ICC1 |
| SBP00165 | Parsley | *Streptomyces* sp. KPB2 |
| SBP00165 | Parsley | *Streptomyces* sp. M2 |
| SBP00165 | Parsley | *Streptomyces* sp. MK45 |
| SBP00165 | Parsley | *Streptomyces* sp. NEAU-S7G52 |
| SBP00165 | Parsley | *Streptomyces* sp. P3 |
| SBP00165 | Parsley | *Streptomyces* sp. RTd22 |
| SBP00165 | Parsley | *Streptomyces* sp. S8 |
| SBP00165 | Parsley | *Streptomyces* sp. SAT1 |
| SBP00165 | Parsley | *Streptomyces* sp. SCSIO 03032 |
| SBP00165 | Parsley | *Streptomyces* sp. SGAir0924 |
| SBP00165 | Parsley | *Streptomyces* sp. Sge12 |
| SBP00165 | Parsley | *Streptomyces* sp. SirexAA-E |
| SBP00165 | Parsley | *Streptomyces* sp. SM18 |
| SBP00165 | Parsley | *Streptomyces* sp. TLI_053 |
| SBP00165 | Parsley | *Streptomyces* sp. TN58 |
| SBP00165 | Parsley | *Streptomyces* sp. W1SF4 |
| SBP00165 | Parsley | *Streptomyces* sp. WAC 01438 |
| SBP00165 | Parsley | *Streptomyces* sp. WAC 01529 |
| SBP00165 | Parsley | *Streptomyces* sp. WAC00288 |
| SBP00165 | Parsley | *Streptomyces* sp. YIM 121038 |
| SBP00165 | Parsley | *Streptomyces* sp. Z022 |
| SBP00165 | Parsley | *Streptomyces* sp. ZFG47 |
| SBP00165 | Parsley | *Streptomyces spongiicola* |
| SBP00165 | Parsley | *Streptomyces venezuelae* |

TABLE 3-continued

List of species identified in each metagenomic sample of each SBP Sample

| SBP ID | SBP Host Common Name | Genus sp. |
|---|---|---|
| SBP00165 | Parsley | *Streptomyces vietnamensis* |
| SBP00165 | Parsley | *Streptomyces violaceoruber* |
| SBP00165 | Parsley | *Streptomyces xiamenensis* |
| SBP00165 | Parsley | *Streptomyces xinghaiensis* |
| SBP00165 | Parsley | *Streptosporangium roseum* |
| SBP00165 | Parsley | *Streptosporangium* sp. 'caverna' |
| SBP00165 | Parsley | *Sulfitobacter pseudonitzschiae* |
| SBP00165 | Parsley | *Sulfitobacter* sp. AM1-D1 |
| SBP00165 | Parsley | *Sulfitobacter* sp. BSw21498 |
| SBP00165 | Parsley | *Sulfitobacter* sp. D7 |
| SBP00165 | Parsley | *Sulfitobacter* sp. SK011 |
| SBP00165 | Parsley | *Sulfitobacter* sp. SK012 |
| SBP00165 | Parsley | *Sulfolobus acidocaldarius* |
| SBP00165 | Parsley | *Sulfolobus* sp. A20 |
| SBP00165 | Parsley | *Sulfuricaulis limicola* |
| SBP00165 | Parsley | *Sulfuricella denitrificans* |
| SBP00165 | Parsley | *Sulfuriferula* sp. AH1 |
| SBP00165 | Parsley | *Sulfurifustis variabilis* |
| SBP00165 | Parsley | *Sulfurimonas autotrophica* |
| SBP00165 | Parsley | *Sulfuritalea hydrogenivorans* |
| SBP00165 | Parsley | *Sulfuritortus calidifontis* |
| SBP00165 | Parsley | *Sulfurivermis fontis* |
| SBP00165 | Parsley | *Sulfurospirillum barnesii* |
| SBP00165 | Parsley | *Sulfurospirillum deleyianum* |
| SBP00165 | Parsley | *Sulfurovum* sp. NBC37-1 |
| SBP00165 | Parsley | *Sutterella megalosphaeroides* |
| SBP00165 | Parsley | *Symbiobacterium thermophilum* |
| SBP00165 | Parsley | *Synechococcus elongatus* |
| SBP00165 | Parsley | *Synechococcus* sp. KORDI-100 |
| SBP00165 | Parsley | *Synechococcus* sp. KORDI-52 |
| SBP00165 | Parsley | *Synechococcus* sp. PCC 7336 |
| SBP00165 | Parsley | *Synechococcus* sp. SynAce01 |
| SBP00165 | Parsley | *Synechococcus* sp. WH 8101 |
| SBP00165 | Parsley | *Tabrizicola* sp. K13M18 |
| SBP00165 | Parsley | *Tannerella* sp. oral taxon HOT-286 |
| SBP00165 | Parsley | *Tateyamaria omphalii* |
| SBP00165 | Parsley | *Tatumella citrea* |
| SBP00165 | Parsley | *Tenacibaculum maritimum* |
| SBP00165 | Parsley | *Tenacibaculum mesophilum* |
| SBP00165 | Parsley | *Tenacibaculum* sp. SZ-18 |
| SBP00165 | Parsley | *Teredinibacter turnerae* |
| SBP00165 | Parsley | *Terriglobus roseus* |
| SBP00165 | Parsley | *Terriglobus saanensis* |
| SBP00165 | Parsley | *Tessaracoccus aquimaris* |
| SBP00165 | Parsley | *Tessaracoccus flavescens* |
| SBP00165 | Parsley | *Tessaracoccus flavus* |
| SBP00165 | Parsley | *Tessaracoccus* sp. Marseille-P599S |
| SBP00165 | Parsley | *Tessaracoccus* sp. T2.5-30 |
| SBP00165 | Parsley | *Thalassococcus* sp. S3 |
| SBP00165 | Parsley | *Thalassococcus* sp. SH-1 |
| SBP00165 | Parsley | *Thalassolituus oleivorans* |
| SBP00165 | Parsley | *Thalassospira marina* |
| SBP00165 | Parsley | *Thalassospira xiamenensis* |
| SBP00165 | Parsley | *Thalassotalea crassostreae* |
| SBP00165 | Parsley | *Thauera aromatica* |
| SBP00165 | Parsley | *Thauera chlorobenzoica* |
| SBP00165 | Parsley | *Thauera humireducens* |
| SBP00165 | Parsley | *Thauera hydrothermalis* |
| SBP00165 | Parsley | *Thauera* sp. K11 |
| SBP00165 | Parsley | *Thauera* sp. MZ1T |
| SBP00165 | Parsley | *Thermacetogenium phaeum* |
| SBP00165 | Parsley | *Thermaerobacter marianensis* |
| SBP00165 | Parsley | *Thermanaeromonas toyohensis* |
| SBP00165 | Parsley | *Thermoanaerobacterium xylanolyticum* |
| SBP00165 | Parsley | *Thermobifida fusca* |
| SBP00165 | Parsley | *Thermobispora bispora* |
| SBP00165 | Parsley | *Thermocrinis albus* |
| SBP00165 | Parsley | *Thermodesulfobium acidiphilum* |
| SBP00165 | Parsley | *Thermofilum pendens* |
| SBP00165 | Parsley | *Thermomonas* sp. SY21 |
| SBP00165 | Parsley | *Thermomonospora curvata* |
| SBP00165 | Parsley | *Thermovirga lienii* |
| SBP00165 | Parsley | *Thermus* sp. YIM 78456 |
| SBP00165 | Parsley | *Thioalkalivibrio nitratireducens* |
| SBP00165 | Parsley | *Thioalkalivibrio paradoxus* |
| SBP00165 | Parsley | *Thioalkalivibrio* sp. K90mix |

TABLE 3-continued

List of species identified in each metagenomic sample of each SBP Sample

| SBP ID | SBP Host Common Name | Genus sp. |
|---|---|---|
| SBP00165 | Parsley | *Thioalkalivibrio sulfidiphilus* |
| SBP00165 | Parsley | *Thioalkalivibrio versutus* |
| SBP00165 | Parsley | *Thiobacillus denitrificans* |
| SBP00165 | Parsley | *Thioclava nitratireducens* |
| SBP00165 | Parsley | *Thiocystis violascens* |
| SBP00165 | Parsley | *Thioflavicoccus mobilis* |
| SBP00165 | Parsley | *Thiohalobacter thiocyanaticus* |
| SBP00165 | Parsley | *Thiomicrospira cyclica* |
| SBP00165 | Parsley | *Thiomonas arsenitoxydans* |
| SBP00165 | Parsley | *Thiomonas intermedia* |
| SBP00165 | Parsley | *Thiomonas* sp. X19 |
| SBP00165 | Parsley | *Tistrella mobilis* |
| SBP00165 | Parsley | *Tolumonas auensis* |
| SBP00165 | Parsley | *Trichodesmium erythraeum* |
| SBP00165 | Parsley | *Trichormus azollae* |
| SBP00165 | Parsley | *Truepera radiovictrix* |
| SBP00165 | Parsley | *Tsukamurella paurometabola* |
| SBP00165 | Parsley | *Tsukamurella tyrosinosolvens* |
| SBP00165 | Parsley | *Tumebacillus avium* |
| SBP00165 | Parsley | *Turneriella parva* |
| SBP00165 | Parsley | *Undibacterium parvum* |
| SBP00165 | Parsley | *Vagococcus penaei* |
| SBP00165 | Parsley | *Variibacter gotjawalensis* |
| SBP00165 | Parsley | *Variovorax boronicumulans* |
| SBP00165 | Parsley | *Variovorax paradoxus* |
| SBP00165 | Parsley | *Variovorax* sp. HW608 |
| SBP00165 | Parsley | *Variovorax* sp. PAMC 28711 |
| SBP00165 | Parsley | *Variovorax* sp. PMC12 |
| SBP00165 | Parsley | *Veillonella parvula* |
| SBP00165 | Parsley | *Verminephrobacter eiseniae* |
| SBP00165 | Parsley | *Verrucomicrobium* sp. GAS474 |
| SBP00165 | Parsley | *Verrucomicrobium spinosum* |
| SBP00165 | Parsley | *Verrucosispora maris* |
| SBP00165 | Parsley | *Vibrio anguillarum* |
| SBP00165 | Parsley | *Vibrio azureus* |
| SBP00165 | Parsley | *Vibrio chagasii* |
| SBP00165 | Parsley | *Vibrio coralliilyticus* |
| SBP00165 | Parsley | *Vibrio fluvialis* |
| SBP00165 | Parsley | *Vibrio harveyi* |
| SBP00165 | Parsley | *Vibrio mediterranei* |
| SBP00165 | Parsley | *Vibrio parahaemolyticus* |
| SBP00165 | Parsley | *Vibrio rumoiensis* |
| SBP00165 | Parsley | *Vibrio scophthalmi* |
| SBP00165 | Parsley | *Vibrio vulnificus* |
| SBP00165 | Parsley | *Virgibacillus halodenitrificans* |
| SBP00165 | Parsley | *Virgibacillus* sp. 6R |
| SBP00165 | Parsley | *Virgibacillus* sp. SK37 |
| SBP00165 | Parsley | *Vitreoscilla filiformis* |
| SBP00165 | Parsley | *Vogesella* sp. LIG4 |
| SBP00165 | Parsley | *Vulgatibacter incomptus* |
| SBP00165 | Parsley | *Wenzhouxiangella marina* |
| SBP00165 | Parsley | *Winogradskyella* sp. PG-2 |
| SBP00165 | Parsley | *Woeseia oceani* |
| SBP00165 | Parsley | *Xanthobacter autotrophicus* |
| SBP00165 | Parsley | *Xanthomonas albilineans* |
| SBP00165 | Parsley | *Xanthomonas arboricola* |
| SBP00165 | Parsley | *Xanthomonas campestris* |
| SBP00165 | Parsley | *Xanthomonas cassavae* |
| SBP00165 | Parsley | *Xanthomonas citri* |
| SBP00165 | Parsley | *Xanthomonas euvesicatoria* |
| SBP00165 | Parsley | *Xanthomonas fragariae* |
| SBP00165 | Parsley | *Xanthomonas gardneri* |
| SBP00165 | Parsley | *Xanthomonas hortorum* |
| SBP00165 | Parsley | *Xanthomonas oryzae* |
| SBP00165 | Parsley | *Xanthomonas phaseoli* |
| SBP00165 | Parsley | *Xanthomonas sacchari* |
| SBP00165 | Parsley | *Xanthomonas translucens* |
| SBP00165 | Parsley | *Xanthomonas vasicola* |
| SBP00165 | Parsley | *Xanthomonas vesicatoria* |
| SBP00165 | Parsley | *Xenorhabdus bovienii* |
| SBP00165 | Parsley | *Xenorhabdus doucetiae* |
| SBP00165 | Parsley | *Xenorhabdus hominickii* |
| SBP00165 | Parsley | *Xenorhabdus nematophila* |
| SBP00165 | Parsley | *Xylanimonas cellulosilytica* |
| SBP00165 | Parsley | *Xylella fastidiosa* |
| SBP00165 | Parsley | *Xylella taiwanensis* |

TABLE 3-continued

List of species identified in each metagenomic sample of each SBP Sample

| SBP ID | SBP Host Common Name | Genus sp. |
| --- | --- | --- |
| SBP00165 | Parsley | *Yangia pacifica* |
| SBP00165 | Parsley | *Yangia* sp. CCB-MM3 |
| SBP00165 | Parsley | *Yersinia aldovae* |
| SBP00165 | Parsley | *Yersinia aleksiciae* |
| SBP00165 | Parsley | *Yersinia enterocolitica* |
| SBP00165 | Parsley | *Yersinia entomophaga* |
| SBP00165 | Parsley | *Yersinia frederiksenii* |
| SBP00165 | Parsley | *Yersinia intermedia* |
| SBP00165 | Parsley | *Yersinia kristensenii* |
| SBP00165 | Parsley | *Yersinia ruckeri* |
| SBP00165 | Parsley | *Yoonia vestfoldensis* |
| SBP00165 | Parsley | *Zhihengliuella* sp. ISTPL4 |
| SBP00165 | Parsley | *Zhongshania aliphaticivorans* |
| SBP00165 | Parsley | *Zobellella denitrificans* |
| SBP00165 | Parsley | *Zobellia galactanivorans* |
| SBP00165 | Parsley | *Zoogloeaceae bacteirum* Par-f-2 |
| SBP00165 | Parsley | *Zucchini lethal chlorosis tospovirus* |
| SBP00165 | Parsley | *Zunongwangia profunda* |
| SBP00165 | Parsley | *Zymobacter palmae* |
| SBP00165 | Parsley | *Zymomonas mobilis* |
| SBP00180 | Olive oil buttery | [*Polyangium*] *brachysporum* |
| SBP00180 | Olive oil buttery | [*Polyangium*] *brachysporum* |
| SBP00180 | Olive oil buttery | [*Pseudomonas*] *mesoacidophila* |
| SBP00180 | Olive oil buttery | [*Pseudomonas*] *mesoacidophila* |
| SBP00180 | Olive oil buttery | *Achromobacter denitrificans* |
| SBP00180 | Olive oil buttery | *Achromobacter denitrificans* |
| SBP00180 | Olive oil buttery | *Achromobacter* sp. MFA1 R4 |
| SBP00180 | Olive oil buttery | Achromobacter sp. MFA1 R4 |
| SBP00180 | Olive oil buttery | *Achromobacter spanius* |
| SBP00180 | Olive oil buttery | *Achromobacter spanius* |
| SBP00180 | Olive oil buttery | *Achromobacter xylosoxidans* |
| SBP00180 | Olive oil buttery | *Achromobacter xylosoxidans* |
| SBP00180 | Olive oil buttery | *Acidisphaera* sp. G45-3 |
| SBP00180 | Olive oil buttery | *Acidisphaera* sp. G45-3 |
| SBP00180 | Olive oil buttery | *Acidovorax avenae* |
| SBP00180 | Olive oil buttery | *Acidovorax avenae* |
| SBP00180 | Olive oil buttery | *Acidovorax carolinensis* |
| SBP00180 | Olive oil buttery | *Acidovorax carolinensis* |
| SBP00180 | Olive oil buttery | *Acidovorax cattleyae* |
| SBP00180 | Olive oil buttery | *Acidovorax cattleyae* |
| SBP00180 | Olive oil buttery | *Acidovorax citrulli* |
| SBP00180 | Olive oil buttery | *Acidovorax citrulli* |
| SBP00180 | Olive oil buttery | *Acidovorax ebreus* |
| SBP00180 | Olive oil buttery | *Acidovorax ebreus* |
| SBP00180 | Olive oil buttery | *Acidovorax* sp. 1608163 |
| SBP00180 | Olive oil buttery | *Acidovorax* sp. 1608163 |
| SBP00180 | Olive oil buttery | *Acidovorax* sp. JS42 |
| SBP00180 | Olive oil buttery | *Acidovorax* sp. JS42 |
| SBP00180 | Olive oil buttery | *Acidovorax* sp. KKS102 |
| SBP00180 | Olive oil buttery | *Acidovorax* sp. KKS102 |
| SBP00180 | Olive oil buttery | *Acidovorax* sp. RAC01 |
| SBP00180 | Olive oil buttery | *Acidovorax* sp. RAC01 |
| SBP00180 | Olive oil buttery | *Acidovorax* sp. T1 |
| SBP00180 | Olive oil buttery | *Acidovorax* sp. T1 |
| SBP00180 | Olive oil buttery | *Acinetobacter baumannii* |
| SBP00180 | Olive oil buttery | *Acinetobacter baumannii* |
| SBP00180 | Olive oil buttery | *Acinetobacter johnsonii* |
| SBP00180 | Olive oil buttery | *Acinetobacter johnsonii* |
| SBP00180 | Olive oil buttery | *Acinetobacter junii* |
| SBP00180 | Olive oil buttery | *Acinetobacter junii* |
| SBP00180 | Olive oil buttery | *Acinetobacter schindleri* |
| SBP00180 | Olive oil buttery | *Acinetobacter schindleri* |
| SBP00180 | Olive oil buttery | *Acinetobacter ursingii* |
| SBP00180 | Olive oil buttery | *Acinetobacter ursingii* |
| SBP00180 | Olive oil buttery | *Actinomadura amylolytica* |
| SBP00180 | Olive oil buttery | *Actinomadura amylolytica* |
| SBP00180 | Olive oil buttery | *Actinomyces oris* |
| SBP00180 | Olive oil buttery | Actinomyces oris |
| SBP00180 | Olive oil buttery | *Actinopolymorpha singaporensis* |
| SBP00180 | Olive oil buttery | *Actinopolymorpha singaporensis* |
| SBP00180 | Olive oil buttery | *Afipia* sp. GAS231 |
| SBP00180 | Olive oil buttery | *Afipia* sp. GAS231 |
| SBP00180 | Olive oil buttery | *Agrobacterium tumefaciens* |
| SBP00180 | Olive oil buttery | *Agrobacterium tumefaciens* |
| SBP00180 | Olive oil buttery | *Ahniella affigens* |
| SBP00180 | Olive oil buttery | *Ahniella affigens* |

TABLE 3-continued

List of species identified in each metagenomic sample of each SBP Sample

| SBP ID | SBP Host Common Name | Genus sp. |
|---|---|---|
| SBP00180 | Olive oil buttery | *Alicycliphilus denitrificans* |
| SBP00180 | Olive oil buttery | *Alicycliphilus denitrificans* |
| SBP00180 | Olive oil buttery | *Alphaproteobacteria bacterium* WS11 |
| SBP00180 | Olive oil buttery | *Alphaproteobacteria bacterium* WS11 |
| SBP00180 | Olive oil buttery | *Aminobacter aminovorans* |
| SBP00180 | Olive oil buttery | *Aminobacter aminovorans* |
| SBP00180 | Olive oil buttery | *Aminobacter* sp. MSH1 |
| SBP00180 | Olive oil buttery | *Aminobacter* sp. MSH1 |
| SBP00180 | Olive oil buttery | *Amycolatopsis orientalis* |
| SBP00180 | Olive oil buttery | *Amycolatopsis orientalis* |
| SBP00180 | Olive oil buttery | *Aquabacterium olei* |
| SBP00180 | Olive oil buttery | *Aquabacterium olei* |
| SBP00180 | Olive oil buttery | *Aquitalea* sp. THG-DN7.12 |
| SBP00180 | Olive oil buttery | *Aquitalea* sp. THG-DN7.12 |
| SBP00180 | Olive oil buttery | *Auraticoccus monumenti* |
| SBP00180 | Olive oil buttery | *Auraticoccus monumenti* |
| SBP00180 | Olive oil buttery | *Aureimonas* sp. AU20 |
| SBP00180 | Olive oil buttery | *Aureimonas* sp. AU20 |
| SBP00180 | Olive oil buttery | *Auricoccus indicus* |
| SBP00180 | Olive oil buttery | *Auricoccus indicus* |
| SBP00180 | Olive oil buttery | *Azoarcus* sp. CIB |
| SBP00180 | Olive oil buttery | *Azoarcus* sp. CIB |
| SBP00180 | Olive oil buttery | *Azoarcus* sp. KH32C |
| SBP00180 | Olive oil buttery | *Azoarcus* sp. KH32C |
| SBP00180 | Olive oil buttery | *Azorhizobium caulinodans* |
| SBP00180 | Olive oil buttery | *Azorhizobium caulinodans* |
| SBP00180 | Olive oil buttery | *Azospira oryzae* |
| SBP00180 | Olive oil buttery | *Azospira oryzae* |
| SBP00180 | Olive oil buttery | *Azospirillum brasilense* |
| SBP00180 | Olive oil buttery | *Azospirillum brasilense* |
| SBP00180 | Olive oil buttery | *Azospirillum lipoferum* |
| SBP00180 | Olive oil buttery | *Azospirillum lipoferum* |
| SBP00180 | Olive oil buttery | *Azospirillum* sp. CFH 70021 |
| SBP00180 | Olive oil buttery | *Azospirillum* sp. CFH 70021 |
| SBP00180 | Olive oil buttery | *Azospirillum* sp. M2T2B2 |
| SBP00180 | Olive oil buttery | *Azospirillum* sp. M2T282 |
| SBP00180 | Olive oil buttery | *Azospirillum* sp. TSA2s |
| SBP00180 | Olive oil buttery | *Azospirillum* sp. TSA2s |
| SBP00180 | Olive oil buttery | *Bacillus cereus* |
| SBP00180 | Olive oil buttery | *Bacillus cereus* |
| SBP00180 | Olive oil buttery | BeAn 58058 virus |
| SBP00180 | Olive oil buttery | BeAn 58058 virus |
| SBP00180 | Olive oil buttery | *Beijerinckia indica* |
| SBP00180 | Olive oil buttery | *Beijerinckia indica* |
| SBP00180 | Olive oil buttery | *Betaproteobacteria bacterium* GR16-43 |
| SBP00180 | Olive oil buttery | *Betaproteobacteria bacterium* GR16-43 |
| SBP00180 | Olive oil buttery | *Blastochloris* sp. GI |
| SBP00180 | Olive oil buttery | *Blastochloris* sp. GI |
| SBP00180 | Olive oil buttery | *Blastococcus saxobsidens* |
| SBP00180 | Olive oil buttery | *Blastococcus saxobsidens* |
| SBP00180 | Olive oil buttery | blood disease bacterium A2-HR MARDI |
| SBP00180 | Olive oil buttery | blood disease bacterium A2-HR MARDI |
| SBP00180 | Olive oil buttery | *Bordetella bronchialis* |
| SBP00180 | Olive oil buttery | *Bordetella bronchialis* |
| SBP00180 | Olive oil buttery | *Bordetella bronchiseptica* |
| SBP00180 | Olive oil buttery | *Bordetella bronchiseptica* |
| SBP00180 | Olive oil buttery | *Bordetella* genomosp. 13 |
| SBP00180 | Olive oil buttery | *Bordetella* genomosp. 13 |
| SBP00180 | Olive oil buttery | *Bordetella* genomosp. 9 |
| SBP00180 | Olive oil buttery | *Bordetella* genomosp. 9 |
| SBP00180 | Olive oil buttery | *Bordetella* sp. H567 |
| SBP00180 | Olive oil buttery | *Bordetella* sp. H567 |
| SBP00180 | Olive oil buttery | *Bordetella* sp. N |
| SBP00180 | Olive oil buttery | *Bordetella* sp. N |
| SBP00180 | Olive oil buttery | *Bosea* sp. AS-1 |
| SBP00180 | Olive oil buttery | *Bosea* sp. AS-1 |
| SBP00180 | Olive oil buttery | *Bosea* sp. PAMC 26642 |
| SBP00180 | Olive oil buttery | *Bosea* sp. PAMC 26642 |
| SBP00180 | Olive oil buttery | *Bosea* sp. RAC05 |
| SBP00180 | Olive oil buttery | *Bosea* sp. RAC05 |
| SBP00180 | Olive oil buttery | *Bosea* sp. Tri-49 |
| SBP00180 | Olive oil buttery | *Bosea* sp. Tri-49 |
| SBP00180 | Olive oil buttery | *Bosea vaviloviae* |
| SBP00180 | Olive oil buttery | *Bosea vaviloviae* |
| SBP00180 | Olive oil buttery | *Brachybacterium ginsengisoli* |
| SBP00180 | Olive oil buttery | *Brachybacterium ginsengisoli* |

TABLE 3-continued

List of species identified in each metagenomic sample of each SBP Sample

| SBP ID | SBP Host Common Name | Genus sp. |
| --- | --- | --- |
| SBP00180 | Olive oil buttery | *Bradyrhizobiaceae bacterium* SG-6C |
| SBP00180 | Olive oil buttery | *Bradyrhizobiaceae bacterium* SG-6C |
| SBP00180 | Olive oil buttery | *Bradyrhizobium diazoefficiens* |
| SBP00180 | Olive oil buttery | *Bradyrhizobium diazoefficiens* |
| SBP00180 | Olive oil buttery | *Bradyrhizobium erythrophlei* |
| SBP00180 | Olive oil buttery | *Bradyrhizobium erythrophlei* |
| SBP00180 | Olive oil buttery | *Bradyrhizobium guangdongense* |
| SBP00180 | Olive oil buttery | *Bradyrhizobium guangdongense* |
| SBP00180 | Olive oil buttery | *Bradyrhizobium guangxiense* |
| SBP00180 | Olive oil buttery | *Bradyrhizobium guangxiense* |
| SBP00180 | Olive oil buttery | *Bradyrhizobium icense* |
| SBP00180 | Olive oil buttery | *Bradyrhizobium icense* |
| SBP00180 | Olive oil buttery | *Bradyrhizobium japonicum* |
| SBP00180 | Olive oil buttery | *Bradyrhizobium japonicum* |
| SBP00180 | Olive oil buttery | *Bradyrhizobium lablabi* |
| SBP00180 | Olive oil buttery | *Bradyrhizobium lablabi* |
| SBP00180 | Olive oil buttery | *Bradyrhizobium oligotrophicum* |
| SBP00180 | Olive oil buttery | *Bradyrhizobium oligotrophicum* |
| SBP00180 | Olive oil buttery | *Bradyrhizobium ottawaense* |
| SBP00180 | Olive oil buttery | *Bradyrhizobium ottawaense* |
| SBP00180 | Olive oil buttery | *Bradyrhizobium* sp. |
| SBP00180 | Olive oil buttery | *Bradyrhizobium* sp. |
| SBP00180 | Olive oil buttery | *Bradyrhizobium* sp. 2 3951MB |
| SBP00180 | Olive oil buttery | *Bradyrhizobium* sp. 2 39S1MB |
| SBP00180 | Olive oil buttery | *Bradyrhizobium* sp. 3 |
| SBP00180 | Olive oil buttery | *Bradyrhizobium* sp. 3 |
| SBP00180 | Olive oil buttery | *Bradyrhizobium* sp. 3 85S1MB |
| SBP00180 | Olive oil buttery | *Bradyrhizobium* sp. 3 85S1MB |
| SBP00180 | Olive oil buttery | *Bradyrhizobium* sp. BTAi1 |
| SBP00180 | Olive oil buttery | *Bradyrhizobium* sp. BTAi1 |
| SBP00180 | Olive oil buttery | *Bradyrhizobium* sp. CCBAU 51670 |
| SBP00180 | Olive oil buttery | *Bradyrhizobium* sp. CCBAU 51670 |
| SBP00180 | Olive oil buttery | *Bradyrhizobium* sp. CCBAU 51778 |
| SBP00180 | Olive oil buttery | *Bradyrhizobium* sp. CCBAU 51778 |
| SBP00180 | Olive oil buttery | *Bradyrhizobium* sp. CCGE-LA001 |
| SBP00180 | Olive oil buttery | *Bradyrhizobium* sp. CCGE-LA001 |
| SBP00180 | Olive oil buttery | *Bradyrhizobium* sp. ORS 278 |
| SBP00180 | Olive oil buttery | *Bradyrhizobium* sp. ORS 278 |
| SBP00180 | Olive oil buttery | *Bradyrhizobium* sp. ORS 285 |
| SBP00180 | Olive oil buttery | *Bradyrhizobium* sp. ORS 285 |
| SBP00180 | Olive oil buttery | *Bradyrhizobium* sp. ORS 3257 |
| SBP00180 | Olive oil buttery | *Bradyrhizobium* sp. ORS 3257 |
| SBP00180 | Olive oil buttery | *Bradyrhizobium* sp. S23321 |
| SBP00180 | Olive oil buttery | *Bradyrhizobium* sp. S23321 |
| SBP00180 | Olive oil buttery | *Bradyrhizobium* sp. SK17 |
| SBP00180 | Olive oil buttery | *Bradyrhizobium* sp. SK17 |
| SBP00180 | Olive oil buttery | *Bradyrhizobium* sp. WSM471 |
| SBP00180 | Olive oil buttery | *Bradyrhizobium* sp. WSM471 |
| SBP00180 | Olive oil buttery | *Breoghania* sp. L-A4 |
| SBP00180 | Olive oil buttery | *Breoghania* sp. L-A4 |
| SBP00180 | Olive oil buttery | *Brevundimonas diminuta* |
| SBP00180 | Olive oil buttery | *Brevundimonas diminuta* |
| SBP00180 | Olive oil buttery | *Brevundimonas naejangsanensis* |
| SBP00180 | Olive oil buttery | *Brevundimonas naejangsanensis* |
| SBP00180 | Olive oil buttery | *Brevundimonas* sp. DS20 |
| SBP00180 | Olive oil buttery | *Brevundimonas* sp. DS20 |
| SBP00180 | Olive oil buttery | *Brevundimonas* sp. GW460-12-10-14-LB2 |
| SBP00180 | Olive oil buttery | *Brevundimonas* sp. GW460-12-10-14-LB2 |
| SBP00180 | Olive oil buttery | *Burkholderia cenocepacia* |
| SBP00180 | Olive oil buttery | *Burkholderia cenocepacia* |
| SBP00180 | Olive oil buttery | *Burkholderia cepacia* |
| SBP00180 | Olive oil buttery | *Burkholderia cepacia* |
| SBP00180 | Olive oil buttery | *Burkholderia contaminans* |
| SBP00180 | Olive oil buttery | *Burkholderia contaminans* |
| SBP00180 | Olive oil buttery | *Burkholderia gladioli* |
| SBP00180 | Olive oil buttery | *Burkholderia gladioli* |
| SBP00180 | Olive oil buttery | *Burkholderia lata* |
| SBP00180 | Olive oil buttery | *Burkholderia lata* |
| SBP00180 | Olive oil buttery | *Burkholderia metallica* |
| SBP00180 | Olive oil buttery | *Burkholderia metallica* |
| SBP00180 | Olive oil buttery | *Burkholderia multivorans* |
| SBP00180 | Olive oil buttery | *Burkholderia multivorans* |
| SBP00180 | Olive oil buttery | *Burkholderia plantarii* |
| SBP00180 | Olive oil buttery | *Burkholderia plantarii* |
| SBP00180 | Olive oil buttery | *Burkholderia pseudomallei* |
| SBP00180 | Olive oil buttery | *Burkholderia pseudomallei* |

TABLE 3-continued

List of species identified in each metagenomic sample of each SBP Sample

| SBP ID | SBP Host Common Name | Genus sp. |
|---|---|---|
| SBP00180 | Olive oil buttery | *Burkholderia pyrrocinia* |
| SBP00180 | Olive oil buttery | *Burkholderia pyrrocinia* |
| SBP00180 | Olive oil buttery | *Burkholderia seminalis* |
| SBP00180 | Olive oil buttery | *Burkholderia seminalis* |
| SBP00180 | Olive oil buttery | *Burkholderia* sp. AD24 |
| SBP00180 | Olive oil buttery | *Burkholderia* sp. AD24 |
| SBP00180 | Olive oil buttery | *Burkholderia* sp. OLGA172 |
| SBP00180 | Olive oil buttery | *Burkholderia* sp. OLGA172 |
| SBP00180 | Olive oil buttery | *Burkholderia* sp. Y123 |
| SBP00180 | Olive oil buttery | *Burkholderia* sp. Y123 |
| SBP00180 | Olive oil buttery | *Burkholderia stabilis* |
| SBP00180 | Olive oil buttery | *Burkholderia stabilis* |
| SBP00180 | Olive oil buttery | *Burkholderia thailandensis* |
| SBP00180 | Olive oil buttery | *Burkholderia thailandensis* |
| SBP00180 | Olive oil buttery | *Burkholderia ubonensis* |
| SBP00180 | Olive oil buttery | *Burkholderia ubonensis* |
| SBP00180 | Olive oil buttery | *Burkholderiales bacterium* JOSHI_001 |
| SBP00180 | Olive oil buttery | *Burkholderiales bacterium* JOSHI_001 |
| SBP00180 | Olive oil buttery | *Caldivirga maquilingensis* |
| SBP00180 | Olive oil buttery | *Caldivirga maquilingensis* |
| SBP00180 | Olive oil buttery | *Candidatus Accumulibacter phosphatis* |
| SBP00180 | Olive oil buttery | *Candidatus Accumulibacter phosphatis* |
| SBP00180 | Olive oil buttery | *Castellaniella defragrans* |
| SBP00180 | Olive oil buttery | *Castellaniella defragrans* |
| SBP00180 | Olive oil buttery | *Catenulispora acidiphila* |
| SBP00180 | Olive oil buttery | *Catenulispora acidiphila* |
| SBP00180 | Olive oil buttery | *Caulobacter flavus* |
| SBP00180 | Olive oil buttery | *Caulobacter flavus* |
| SBP00180 | Olive oil buttery | *Caulobacter henricii* |
| SBP00180 | Olive oil buttery | *Caulobacter henricii* |
| SBP00180 | Olive oil buttery | *Caulobacter segnis* |
| SBP00180 | Olive oil buttery | *Caulobacter segnis* |
| SBP00180 | Olive oil buttery | *Caulobacter* sp. FWC26 |
| SBP00180 | Olive oil buttery | *Caulobacter* sp. FWC26 |
| SBP00180 | Olive oil buttery | *Caulobacter vibrioides* |
| SBP00180 | Olive oil buttery | *Caulobacter vibrioides* |
| SBP00180 | Olive oil buttery | *Cellulomonas fimi* |
| SBP00180 | Olive oil buttery | *Cellulomonas fimi* |
| SBP00180 | Olive oil buttery | *Cellulomonas flavigena* |
| SBP00180 | Olive oil buttery | *Cellulomonas flavigena* |
| SBP00180 | Olive oil buttery | *Cellulomonas gilvus* |
| SBP00180 | Olive oil buttery | *Cellulomonas gilvus* |
| SBP00180 | Olive oil buttery | *Cellulomonas* sp. PSBB021 |
| SBP00180 | Olive oil buttery | *Cellulomonas* sp. PSBB021 |
| SBP00180 | Olive oil buttery | *Chelativorans* sp. BNC1 |
| SBP00180 | Olive oil buttery | *Chelativorans* sp. BNC1 |
| SBP00180 | Olive oil buttery | *Chelatococcus* sp. CO-6 |
| SBP00180 | Olive oil buttery | *Chelatococcus* sp. CO-6 |
| SBP00180 | Olive oil buttery | *Chromobacterium rhizoryzae* |
| SBP00180 | Olive oil buttery | *Chromobacterium rhizoryzae* |
| SBP00180 | Olive oil buttery | *Chromobacterium* sp. ATCC 53434 |
| SBP00180 | Olive oil buttery | *Chromobacterium* sp. ATCC 53434 |
| SBP00180 | Olive oil buttery | *Chryseobacterium arthrosphaerae* |
| SBP00180 | Olive oil buttery | *Chryseobacterium arthrosphaerae* |
| SBP00180 | Olive oil buttery | *Chryseobacterium* sp. H6466 |
| SBP00180 | Olive oil buttery | *Chryseobacterium* sp. H6466 |
| SBP00180 | Olive oil buttery | *Cloacibacterium normanense* |
| SBP00180 | Olive oil buttery | *Cloacibacterium normanense* |
| SBP00180 | Olive oil buttery | *Collimonas arenae* |
| SBP00180 | Olive oil buttery | *Collimonas arenae* |
| SBP00180 | Olive oil buttery | *Collimonas fungivorans* |
| SBP00180 | Olive oil buttery | *Collimonas fungivorans* |
| SBP00180 | Olive oil buttery | *Collimonas pratensis* |
| SBP00180 | Olive oil buttery | *Collimonas pratensis* |
| SBP00180 | Olive oil buttery | *Comamonas aquatica* |
| SBP00180 | Olive oil buttery | *Comamonas aquatica* |
| SBP00180 | Olive oil buttery | *Comamonas kerstersii* |
| SBP00180 | Olive oil buttery | *Comamonas kerstersii* |
| SBP00180 | Olive oil buttery | *Comamonas serinivorans* |
| SBP00180 | Olive oil buttery | *Comamonas serinivorans* |
| SBP00180 | Olive oil buttery | *Comamonas terrigena* |
| SBP00180 | Olive oil buttery | *Comamonas terrigena* |
| SBP00180 | Olive oil buttery | *Comamonas testosteroni* |
| SBP00180 | Olive oil buttery | *Comamonas testosteroni* |
| SBP00180 | Olive oil buttery | *Comamonas thiooxydans* |
| SBP00180 | Olive oil buttery | *Comamonas thiooxydans* |

TABLE 3-continued

List of species identified in each metagenomic sample of each SBP Sample

| SBP ID | SBP Host Common Name | Genus sp. |
| --- | --- | --- |
| SBP00180 | Olive oil buttery | *Conexibacter woesei* |
| SBP00180 | Olive oil buttery | *Conexibacter woesei* |
| SBP00180 | Olive oil buttery | *Confluentimicrobium* sp. EMB200-NS6 |
| SBP00180 | Olive oil buttery | *Confluentimicrobium* sp. EMB200-NS6 |
| SBP00180 | Olive oil buttery | *Corallococcus coralloides* |
| SBP00180 | Olive oil buttery | *Corallococcus coralloides* |
| SBP00180 | Olive oil buttery | *Corynebacterium aurimucosum* |
| SBP00180 | Olive oil buttery | *Corynebacterium aurimucosum* |
| SBP00180 | Olive oil buttery | *Corynebacterium kroppenstedtii* |
| SBP00180 | Olive oil buttery | *Corynebacterium kroppenstedtii* |
| SBP00180 | Olive oil buttery | *Corynebacterium matruchotii* |
| SBP00180 | Olive oil buttery | *Corynebacterium matruchotii* |
| SBP00180 | Olive oil buttery | *Corynebacterium resistens* |
| SBP00180 | Olive oil buttery | *Corynebacterium resistens* |
| SBP00180 | Olive oil buttery | *Corynebacterium segmentosum* |
| SBP00180 | Olive oil buttery | *Corynebacterium segmentosum* |
| SBP00180 | Olive oil buttery | *Corynebacterium singulare* |
| SBP00180 | Olive oil buttery | *Corynebacterium singulare* |
| SBP00180 | Olive oil buttery | *Corynebacterium ureicelerivorans* |
| SBP00180 | Olive oil buttery | *Corynebacterium ureicelerivorans* |
| SBP00180 | Olive oil buttery | *Cronobacter condimenti* |
| SBP00180 | Olive oil buttery | *Cronobacter condimenti* |
| SBP00180 | Olive oil buttery | *Cupriavidus basilensis* |
| SBP00180 | Olive oil buttery | *Cupriavidus basilensis* |
| SBP00180 | Olive oil buttery | *Cupriavidus gilardii* |
| SBP00180 | Olive oil buttery | *Cupriavidus gilardii* |
| SBP00180 | Olive oil buttery | *Cupriavidus metallidurans* |
| SBP00180 | Olive oil buttery | *Cupriavidus metallidurans* |
| SBP00180 | Olive oil buttery | *Cupriavidus nantongensis* |
| SBP00180 | Olive oil buttery | *Cupriavidus nantongensis* |
| SBP00180 | Olive oil buttery | *Cupriavidus necator* |
| SBP00180 | Olive oil buttery | *Cupriavidus necator* |
| SBP00180 | Olive oil buttery | *Cupriavidus oxalaticus* |
| SBP00180 | Olive oil buttery | *Cupriavidus oxalaticus* |
| SBP00180 | Olive oil buttery | *Cupriavidus pauculus* |
| SBP00180 | Olive oil buttery | *Cupriavidus pauculus* |
| SBP00180 | Olive oil buttery | *Cupriavidus pinatubonensis* |
| SBP00180 | Olive oil buttery | *Cupriavidus pinatubonensis* |
| SBP00180 | Olive oil buttery | *Cupriavidus* sp. USMAA2-4 |
| SBP00180 | Olive oil buttery | *Cupriavidus* sp. USMAA2-4 |
| SBP00180 | Olive oil buttery | *Cupriavidus* sp. USMAHM13 |
| SBP00180 | Olive oil buttery | *Cupriavidus* sp. USMAHM13 |
| SBP00180 | Olive oil buttery | *Cupriavidus taiwanensis* |
| SBP00180 | Olive oil buttery | *Cupriavidus taiwanensis* |
| SBP00180 | Olive oil buttery | *Curvibacter* sp. AEP1-3 |
| SBP00180 | Olive oil buttery | *Curvibacter* sp. AEP1-3 |
| SBP00180 | Olive oil buttery | *Cutibacterium acnes* |
| SBP00180 | Olive oil buttery | *Cutibacterium acnes* |
| SBP00180 | Olive oil buttery | *Cutibacterium granulosum* |
| SBP00180 | Olive oil buttery | *Cutibacterium granulosum* |
| SBP00180 | Olive oil buttery | *Deinococcus wulumuqiensis* |
| SBP00180 | Olive oil buttery | *Deinococcus wulumuqiensis* |
| SBP00180 | Olive oil buttery | *Delftia acidovorans* |
| SBP00180 | Olive oil buttery | *Delftia acidovorans* |
| SBP00180 | Olive oil buttery | *Delftia* sp. |
| SBP00180 | Olive oil buttery | *Delftia* sp. |
| SBP00180 | Olive oil buttery | *Delftia* sp. Cs1-4 |
| SBP00180 | Olive oil buttery | *Delftia* sp. Cs1-4 |
| SBP00180 | Olive oil buttery | *Delftia tsuruhatensis* |
| SBP00180 | Olive oil buttery | *Delftia tsuruhatensis* |
| SBP00180 | Olive oil buttery | *Dermacoccus nishinomiyaensis* |
| SBP00180 | Olive oil buttery | *Dermacoccus nishinomiyaensis* |
| SBP00180 | Olive oil buttery | *Desulfovibrio hydrothermalis* |
| SBP00180 | Olive oil buttery | *Desulfovibrio hydrothermalis* |
| SBP00180 | Olive oil buttery | *Devosia* sp. HS989 |
| SBP00180 | Olive oil buttery | *Devosia* sp. H5989 |
| SBP00180 | Olive oil buttery | *Ensifer adhaerens* |
| SBP00180 | Olive oil buttery | *Ensifer adhaerens* |
| SBP00180 | Olive oil buttery | *Enterobacter cloacae* |
| SBP00180 | Olive oil buttery | *Enterobacter cloacae* |
| SBP00180 | Olive oil buttery | *Enterococcus mundtii* |
| SBP00180 | Olive oil buttery | *Enterococcus mundtii* |
| SBP00180 | Olive oil buttery | *Frankia inefficax* |
| SBP00180 | Olive oil buttery | *Frankia inefficax* |
| SBP00180 | Olive oil buttery | *Frateuria aurantia* |
| SBP00180 | Olive oil buttery | *Frateuria aurantia* |

TABLE 3-continued

List of species identified in each metagenomic sample of each SBP Sample

| SBP ID | SBP Host Common Name | Genus sp. |
|---|---|---|
| SBP00180 | Olive oil buttery | *Fusobacterium nucleatum* |
| SBP00180 | Olive oil buttery | *Fusobacterium nucleatum* |
| SBP00180 | Olive oil buttery | *Fusobacterium periodonticum* |
| SBP00180 | Olive oil buttery | *Fusobacterium periodonticum* |
| SBP00180 | Olive oil buttery | *Gemella haemolysans* |
| SBP00180 | Olive oil buttery | *Gemella haemolysans* |
| SBP00180 | Olive oil buttery | *Geodermatophilus obscurus* |
| SBP00180 | Olive oil buttery | *Geodermatophilus obscurus* |
| SBP00180 | Olive oil buttery | *Glycocaulis alkaliphilus* |
| SBP00180 | Olive oil buttery | *Glycocaulis alkaliphilus* |
| SBP00180 | Olive oil buttery | *Halomonas* sp. 1513 |
| SBP00180 | Olive oil buttery | *Halomonas* sp. 1513 |
| SBP00180 | Olive oil buttery | *Hartmannibacter diazotrophicus* |
| SBP00180 | Olive oil buttery | *Hartmannibacter diazotrophicus* |
| SBP00180 | Olive oil buttery | *Herbaspirillum hiltneri* |
| SBP00180 | Olive oil buttery | *Herbaspirillum hiltneri* |
| SBP00180 | Olive oil buttery | *Herbaspirillum huttiense* |
| SBP00180 | Olive oil buttery | *Herbaspirillum huttiense* |
| SBP00180 | Olive oil buttery | *Herbaspirillum robiniae* |
| SBP00180 | Olive oil buttery | *Herbaspirillum robiniae* |
| SBP00180 | Olive oil buttery | *Herbaspirillum seropedicae* |
| SBP00180 | Olive oil buttery | *Herbaspirillum seropedicae* |
| SBP00180 | Olive oil buttery | Human endogenous retrovirus K |
| SBP00180 | Olive oil buttery | Human endogenous retrovirus K |
| SBP00180 | Olive oil buttery | *Hydrogenophaga crassostreae* |
| SBP00180 | Olive oil buttery | *Hydrogenophaga crassostreae* |
| SBP00180 | Olive oil buttery | *Hydrogenophaga pseudoflava* |
| SBP00180 | Olive oil buttery | *Hydrogenophaga pseudoflava* |
| SBP00180 | Olive oil buttery | *Hydrogenophaga* sp. NH-16 |
| SBP00180 | Olive oil buttery | *Hydrogenophaga* sp. NH-16 |
| SBP00180 | Olive oil buttery | *Hydrogenophaga* sp. PBC |
| SBP00180 | Olive oil buttery | *Hydrogenophaga* sp. PBC |
| SBP00180 | Olive oil buttery | *Hydrogenophaga* sp. RAC07 |
| SBP00180 | Olive oil buttery | *Hydrogenophaga* sp. RAC07 |
| SBP00180 | Olive oil buttery | *Hydrogenophilus thermoluteolus* |
| SBP00180 | Olive oil buttery | *Hydrogenophilus thermoluteolus* |
| SBP00180 | Olive oil buttery | *Hylemonella gracilis* |
| SBP00180 | Olive oil buttery | *Hylemonella gracilis* |
| SBP00180 | Olive oil buttery | *Hyphomonas* sp. Mor2 |
| SBP00180 | Olive oil buttery | *Hyphomonas* sp. Mor2 |
| SBP00180 | Olive oil buttery | *Inhella inkyongensis* |
| SBP00180 | Olive oil buttery | *Inhella inkyongensis* |
| SBP00180 | Olive oil buttery | *Isoptericola variabilis* |
| SBP00180 | Olive oil buttery | *Isoptericola variabilis* |
| SBP00180 | Olive oil buttery | *Janthinobacterium agaricidamnosum* |
| SBP00180 | Olive oil buttery | *Janthinobacterium agaricidamnosum* |
| SBP00180 | Olive oil buttery | *Janthinobacterium svalbardensis* |
| SBP00180 | Olive oil buttery | *Janthinobacterium svalbardensis* |
| SBP00180 | Olive oil buttery | *Jeongeupia* sp. USM3 |
| SBP00180 | Olive oil buttery | *Jeongeupia* sp. USM3 |
| SBP00180 | Olive oil buttery | *Jiangella alkaliphila* |
| SBP00180 | Olive oil buttery | *Jiangella alkaliphila* |
| SBP00180 | Olive oil buttery | *Kitasatospora albolonga* |
| SBP00180 | Olive oil buttery | *Kitasatospora albolonga* |
| SBP00180 | Olive oil buttery | *Kitasatospora* sp. MMS16-BH015 |
| SBP00180 | Olive oil buttery | *Kitasatospora* sp. MMS16-BH015 |
| SBP00180 | Olive oil buttery | *Klebsiella oxytoca* |
| SBP00180 | Olive oil buttery | *Klebsiella oxytoca* |
| SBP00180 | Olive oil buttery | *Klebsiella pneumoniae* |
| SBP00180 | Olive oil buttery | *Klebsiella pneumoniae* |
| SBP00180 | Olive oil buttery | *Kocuria indica* |
| SBP00180 | Olive oil buttery | *Kocuria indica* |
| SBP00180 | Olive oil buttery | *Kocuria rosea* |
| SBP00180 | Olive oil buttery | *Kocuria rosea* |
| SBP00180 | Olive oil buttery | *Komagataeibacter xylinus* |
| SBP00180 | Olive oil buttery | *Komagataeibacter xylinus* |
| SBP00180 | Olive oil buttery | *Kribbella flavida* |
| SBP00180 | Olive oil buttery | *Kribbella flavida* |
| SBP00180 | Olive oil buttery | *Lactobacillus crispatus* |
| SBP00180 | Olive oil buttery | *Lactobacillus crispatus* |
| SBP00180 | Olive oil buttery | *Lactobacillus curvatus* |
| SBP00180 | Olive oil buttery | *Lactobacillus curvatus* |
| SBP00180 | Olive oil buttery | *Lactobacillus johnsonii* |
| SBP00180 | Olive oil buttery | *Lactobacillus johnsonii* |
| SBP00180 | Olive oil buttery | *Lactobacillus kefiranofaciens* |
| SBP00180 | Olive oil buttery | *Lactobacillus kefiranofaciens* |

TABLE 3-continued

List of species identified in each metagenomic sample of each SBP Sample

| SBP ID | SBP Host Common Name | Genus sp. |
| --- | --- | --- |
| SBP00180 | Olive oil buttery | *Lactobacillus paracasei* |
| SBP00180 | Olive oil buttery | *Lactobacillus paracasei* |
| SBP00180 | Olive oil buttery | *Lactobacillus plantarum* |
| SBP00180 | Olive oil buttery | *Lactobacillus plantarum* |
| SBP00180 | Olive oil buttery | *Lactococcus lactis* |
| SBP00180 | Olive oil buttery | *Lactococcus lactis* |
| SBP00180 | Olive oil buttery | *Lautropia mirabilis* |
| SBP00180 | Olive oil buttery | *Lautropia mirabilis* |
| SBP00180 | Olive oil buttery | *Lawsonella clevelandensis* |
| SBP00180 | Olive oil buttery | *Lawsonella clevelandensis* |
| SBP00180 | Olive oil buttery | *Leclercia adecarboxylata* |
| SBP00180 | Olive oil buttery | *Leclercia adecarboxylata* |
| SBP00180 | Olive oil buttery | *Lentzea guizhouensis* |
| SBP00180 | Olive oil buttery | *Lentzea guizhouensis* |
| SBP00180 | Olive oil buttery | *Leptolyngbya* sp. NIES-3755 |
| SBP00180 | Olive oil buttery | *Leptolyngbya* sp. NIES-3755 |
| SBP00180 | Olive oil buttery | *Leptothrix cholodnii* |
| SBP00180 | Olive oil buttery | *Leptothrix cholodnii* |
| SBP00180 | Olive oil buttery | *Leuconostoc citreum* |
| SBP00180 | Olive oil buttery | *Leuconostoc citreum* |
| SBP00180 | Olive oil buttery | *Limnohabitans* sp. 63ED37-2 |
| SBP00180 | Olive oil buttery | *Limnohabitans* sp. 63ED37-2 |
| SBP00180 | Olive oil buttery | *Lysobacter antibioticus* |
| SBP00180 | Olive oil buttery | *Lysobacter antibioticus* |
| SBP00180 | Olive oil buttery | *Lysobacter* sp. TY2-98 |
| SBP00180 | Olive oil buttery | *Lysobacter* sp. TY2-98 |
| SBP00180 | Olive oil buttery | *Magnetospirillum* sp. XM-1 |
| SBP00180 | Olive oil buttery | *Magnetospirillum* sp. XM-1 |
| SBP00180 | Olive oil buttery | *Marmoricola scoriae* |
| SBP00180 | Olive oil buttery | *Marmoricola scoriae* |
| SBP00180 | Olive oil buttery | *Martelella mediterranea* |
| SBP00180 | Olive oil buttery | *Martelella mediterranea* |
| SBP00180 | Olive oil buttery | *Massilia albidiflava* |
| SBP00180 | Olive oil buttery | *Massilia albidiflava* |
| SBP00180 | Olive oil buttery | *Massilia armeniaca* |
| SBP00180 | Olive oil buttery | *Massilia armeniaca* |
| SBP00180 | Olive oil buttery | *Massilia lutea* |
| SBP00180 | Olive oil buttery | *Massilia lutea* |
| SBP00180 | Olive oil buttery | *Massilia oculi* |
| SBP00180 | Olive oil buttery | *Massilia oculi* |
| SBP00180 | Olive oil buttery | *Massilia plicata* |
| SBP00180 | Olive oil buttery | *Massilia plicata* |
| SBP00180 | Olive oil buttery | *Massilia putida* |
| SBP00180 | Olive oil buttery | *Massilia putida* |
| SBP00180 | Olive oil buttery | *Massilia* sp. NR 4-1 |
| SBP00180 | Olive oil buttery | *Massilia* sp. NR 4-1 |
| SBP00180 | Olive oil buttery | *Massilia* sp. WG5 |
| SBP00180 | Olive oil buttery | *Massilia* sp. WG5 |
| SBP00180 | Olive oil buttery | *Massilia* sp. YMA4 |
| SBP00180 | Olive oil buttery | *Massilia* sp. YMA4 |
| SBP00180 | Olive oil buttery | *Massilia umbonata* |
| SBP00180 | Olive oil buttery | *Massilia umbonata* |
| SBP00180 | Olive oil buttery | *Massilia violaceinigra* |
| SBP00180 | Olive oil buttery | *Massilia violaceinigra* |
| SBP00180 | Olive oil buttery | *Melaminivora* sp. SC2-7 |
| SBP00180 | Olive oil buttery | *Melaminivora* sp. SC2-7 |
| SBP00180 | Olive oil buttery | *Melaminivora* sp. SC2-9 |
| SBP00180 | Olive oil buttery | *Melaminivora* sp. SC2-9 |
| SBP00180 | Olive oil buttery | *Melittangium boletus* |
| SBP00180 | Olive oil buttery | *Melittangium boletus* |
| SBP00180 | Olive oil buttery | *Mesorhizobium amorphae* |
| SBP00180 | Olive oil buttery | *Mesorhizobium amorphae* |
| SBP00180 | Olive oil buttery | *Mesorhizobium australicum* |
| SBP00180 | Olive oil buttery | *Mesorhizobium australicum* |
| SBP00180 | Olive oil buttery | *Mesorhizobium ciceri* |
| SBP00180 | Olive oil buttery | *Mesorhizobium ciceri* |
| SBP00180 | Olive oil buttery | *Mesorhizobium japonicum* |
| SBP00180 | Olive oil buttery | *Mesorhizobium japonicum* |
| SBP00180 | Olive oil buttery | *Mesorhizobium loti* |
| SBP00180 | Olive oil buttery | *Mesorhizobium loti* |
| SBP00180 | Olive oil buttery | *Mesorhizobium oceanicum* |
| SBP00180 | Olive oil buttery | *Mesorhizobium oceanicum* |
| SBP00180 | Olive oil buttery | *Mesorhizobium opportunistum* |
| SBP00180 | Olive oil buttery | *Mesorhizobium opportunistum* |
| SBP00180 | Olive oil buttery | *Mesorhizobium* sp. DCY119 |
| SBP00180 | Olive oil buttery | *Mesorhizobium* sp. DCY119 |

TABLE 3-continued

List of species identified in each metagenomic sample of each SBP Sample

| SBP ID | SBP Host Common Name | Genus sp. |
|---|---|---|
| SBP00180 | Olive oil buttery | *Mesorhizobium* sp. M1B.F.Ca.ET.045.04.1.1 |
| SBP00180 | Olive oil buttery | *Mesorhizobium* sp. M1B.F.Ca.ET.045.04.1.1 |
| SBP00180 | Olive oil buttery | *Mesorhizobium* sp. M1D.F.Ca.ET.043.01.1.1 |
| SBP00180 | Olive oil buttery | *Mesorhizobium* sp. M1D.F.Ca.ET.043.01.1.1 |
| SBP00180 | Olive oil buttery | *Mesorhizobium* sp. M1E.F.Ca.ET.045.02.1.1 |
| SBP00180 | Olive oil buttery | *Mesorhizobium* sp. M1E.F.Ca.ET.045.02.1.1 |
| SBP00180 | Olive oil buttery | *Mesorhizobium* sp. M2A.F.Ca.ET.043.05.1.1 |
| SBP00180 | Olive oil buttery | *Mesorhizobium* sp. M2A.F.Ca.ET.043.05.1.1 |
| SBP00180 | Olive oil buttery | *Mesorhizobium* sp. M2A.F.Ca.ET.046.03.2.1 |
| SBP00180 | Olive oil buttery | *Mesorhizobium* sp. M2A.F.Ca.ET.046.03.2.1 |
| SBP00180 | Olive oil buttery | *Mesorhizobium* sp. M3A.F.Ca.ET.080.04.2.1 |
| SBP00180 | Olive oil buttery | *Mesorhizobium* sp. M3A.F.Ca.ET.080.04.2.1 |
| SBP00180 | Olive oil buttery | *Mesorhizobium* sp. M4B.F.Ca.ET.058.02.1.1 |
| SBP00180 | Olive oil buttery | *Mesorhizobium* sp. M4B.F.Ca.ET.058.02.1.1 |
| SBP00180 | Olive oil buttery | *Mesorhizobium* sp. M7A.F.Ce.TU.012.03.2.1 |
| SBP00180 | Olive oil buttery | *Mesorhizobium* sp. M7A.F.Ce.TU.012.03.2.1 |
| SBP00180 | Olive oil buttery | *Mesorhizobium* sp. M7D.F.Ca.US.005.01.1.1 |
| SBP00180 | Olive oil buttery | *Mesorhizobium* sp. M7D.F.Ca.US.005.01.1.1 |
| SBP00180 | Olive oil buttery | *Mesorhizobium* sp. M9A.F.Ca.ET.002.03.1.2 |
| SBP00180 | Olive oil buttery | *Mesorhizobium* sp. M9A.F.Ca.ET.002.03.1.2 |
| SBP00180 | Olive oil buttery | *Methylibium petroleiphilum* |
| SBP00180 | Olive oil buttery | *Methylibium petroleiphilum* |
| SBP00180 | Olive oil buttery | *Methylobacterium aquaticum* |
| SBP00180 | Olive oil buttery | *Methylobacterium aquaticum* |
| SBP00180 | Olive oil buttery | *Methylobacterium brachiatum* |
| SBP00180 | Olive oil buttery | *Methylobacterium brachiatum* |
| SBP00180 | Olive oil buttery | *Methylobacterium currus* |
| SBP00180 | Olive oil buttery | *Methylobacterium currus* |
| SBP00180 | Olive oil buttery | *Methylobacterium nodulans* |
| SBP00180 | Olive oil buttery | *Methylobacterium nodulans* |
| SBP00180 | Olive oil buttery | *Methylobacterium oryzae* |
| SBP00180 | Olive oil buttery | *Methylobacterium oryzae* |
| SBP00180 | Olive oil buttery | *Methylobacterium phyllosphaerae* |
| SBP00180 | Olive oil buttery | *Methylobacterium phyllosphaerae* |
| SBP00180 | Olive oil buttery | *Methylobacterium radiotolerans* |
| SBP00180 | Olive oil buttery | *Methylabacterium radiotolerans* |
| SBP00180 | Olive oil buttery | *Methylobacterium* sp. 17SD2-17 |
| SBP00180 | Olive oil buttery | *Methylobacterium* sp. 17SD2-17 |
| SBP00180 | Olive oil buttery | *Methylobacterium* sp. 17Sr1-1 |
| SBP00180 | Olive oil buttery | *Methylobacterium* sp. 17Sr1-1 |
| SBP00180 | Olive oil buttery | *Methylobacterium* sp. 17Sr1-28 |
| SBP00180 | Olive oil buttery | *Methylobacterium* sp. 17Sr1-28 |
| SBP00180 | Olive oil buttery | *Methylobacterium* sp. 17Sr1-43 |
| SBP00180 | Olive oil buttery | *Methylobacterium* sp. 17Sr1-43 |
| SBP00180 | Olive oil buttery | *Methylobacterium* sp. 4-46 |
| SBP00180 | Olive oil buttery | *Methylobacterium* sp. 4-46 |
| SBP00180 | Olive oil buttery | *Methylobacterium* sp. AMS5 |
| SBP00180 | Olive oil buttery | *Methylobacterium* sp. AMS5 |
| SBP00180 | Olive oil buttery | *Methylobacterium* sp. C1 |
| SBP00180 | Olive oil buttery | *Methylobacterium* sp. C1 |
| SBP00180 | Olive oil buttery | *Methylobacterium* sp. DM1 |
| SBP00180 | Olive oil buttery | *Methylabacterium* sp. DM1 |
| SBP00180 | Olive oil buttery | *Methylobacterium* sp. XJLW |
| SBP00180 | Olive oil buttery | *Methylobacterium* sp. XJLW |
| SBP00180 | Olive oil buttery | *Methylocaldum marinum* |
| SBP00180 | Olive oil buttery | *Methylocaldum marinum* |
| SBP00180 | Olive oil buttery | *Methylocella silvestris* |
| SBP00180 | Olive oil buttery | *Methylocella silvestris* |
| SBP00180 | Olive oil buttery | *Methylocella tundrae* |
| SBP00180 | Olive oil buttery | *Methylocella tundrae* |
| SBP00180 | Olive oil buttery | *Methylocystis bryophila* |
| SBP00180 | Olive oil buttery | *Methylocystis bryophila* |
| SBP00180 | Olive oil buttery | *Methylocystis* sp. SC2 |
| SBP00180 | Olive oil buttery | *Methylocystis* sp. SC2 |
| SBP00180 | Olive oil buttery | *Methylorubrum extorquens* |
| SBP00180 | Olive oil buttery | *Methylorubrum extorquens* |
| SBP00180 | Olive oil buttery | *Methylorubrum populi* |
| SBP00180 | Olive oil buttery | *Methylorubrum populi* |
| SBP00180 | Olive oil buttery | *Methylosinus trichosporium* |
| SBP00180 | Olive oil buttery | *Methylosinus trichosporium* |
| SBP00180 | Olive oil buttery | *Methyloversatilis* sp. RAC08 |
| SBP00180 | Olive oil buttery | *Methyloversatilis* sp. RAC08 |
| SBP00180 | Olive oil buttery | *Microbacterium hominis* |
| SBP00180 | Olive oil buttery | *Microbacterium hominis* |
| SBP00180 | Olive oil buttery | *Microbacterium lemovicicum* |
| SBP00180 | Olive oil buttery | *Microbacterium lemovicicum* |

TABLE 3-continued

List of species identified in each metagenomic sample of each SBP Sample

| SBP ID | SBP Host Common Name | Genus sp. |
|---|---|---|
| SBP00180 | Olive oil buttery | *Microbacterium oleivorans* |
| SBP00180 | Olive oil buttery | *Microbacterium oleivorans* |
| SBP00180 | Olive oil buttery | *Microbacterium pygmaeum* |
| SBP00180 | Olive oil buttery | *Microbacterium pygmaeum* |
| SBP00180 | Olive oil buttery | *Microbacterium* sp. No. 7 |
| SBP00180 | Olive oil buttery | *Microbacterium* sp. No. 7 |
| SBP00180 | Olive oil buttery | *Micrococcus luteus* |
| SBP00180 | Olive oil buttery | *Micrococcus luteus* |
| SBP00180 | Olive oil buttery | *Micromonospora viridifaciens* |
| SBP00180 | Olive oil buttery | *Micromonospora viridifaciens* |
| SBP00180 | Olive oil buttery | *Microterricola viridarii* |
| SBP00180 | Olive oil buttery | *Microterricola viridarii* |
| SBP00180 | Olive oil buttery | *Microvirga ossetica* |
| SBP00180 | Olive oil buttery | *Microvirga ossetica* |
| SBP00180 | Olive oil buttery | *Mitsuaria* sp. 7 |
| SBP00180 | Olive oil buttery | *Mitsuaria* sp. 7 |
| SBP00180 | Olive oil buttery | *Modestobacter marinus* |
| SBP00180 | Olive oil buttery | *Modestobacter marinus* |
| SBP00180 | Olive oil buttery | *Moraxella osloensis* |
| SBP00180 | Olive oil buttery | *Moraxella osloensis* |
| SBP00180 | Olive oil buttery | *Moritella yayanosii* |
| SBP00180 | Olive oil buttery | *Moritella yayanosii* |
| SBP00180 | Olive oil buttery | *Mycolicibacterium aurum* |
| SBP00180 | Olive oil buttery | *Mycolicibacterium aurum* |
| SBP00180 | Olive oil buttery | *Mycolicibacterium rhodesiae* |
| SBP00180 | Olive oil buttery | *Mycolicibacterium rhodesiae* |
| SBP00180 | Olive oil buttery | *Nakamurella panacisegetis* |
| SBP00180 | Olive oil buttery | *Nakamurella panacisegetis* |
| SBP00180 | Olive oil buttery | *Neisseria gonorrhoeae* |
| SBP00180 | Olive oil buttery | *Neisseria gonorrhoeae* |
| SBP00180 | Olive oil buttery | *Neisseria mucosa* |
| SBP00180 | Olive oil buttery | *Neisseria mucosa* |
| SBP00180 | Olive oil buttery | *Neisseria subflava* |
| SBP00180 | Olive oil buttery | *Neisseria subflava* |
| SBP00180 | Olive oil buttery | *Neorhizobium galegae* |
| SBP00180 | Olive oil buttery | *Neorhizobium galegae* |
| SBP00180 | Olive oil buttery | *Neorhizobium* sp. SOG26 |
| SBP00180 | Olive oil buttery | *Neorhizobium* sp. SOG26 |
| SBP00180 | Olive oil buttery | *Nitrobacter hamburgensis* |
| SBP00180 | Olive oil buttery | *Nitrobacter hamburgensis* |
| SBP00180 | Olive oil buttery | *Nitrobacter winogradskyi* |
| SBP00180 | Olive oil buttery | *Nitrobacter winogradskyi* |
| SBP00180 | Olive oil buttery | *Nitrospirillum amazonense* |
| SBP00180 | Olive oil buttery | *Nitrospirillum amazonense* |
| SBP00180 | Olive oil buttery | *Nocardia asteroides* |
| SBP00180 | Olive oil buttery | *Nocardia asteroides* |
| SBP00180 | Olive oil buttery | *Nocardia cyriacigeorgica* |
| SBP00180 | Olive oil buttery | *Nocardia cyriacigeorgica* |
| SBP00180 | Olive oil buttery | *Nocardioides* sp. 603 |
| SBP00180 | Olive oil buttery | *Nocardioides* sp. 603 |
| SBP00180 | Olive oil buttery | *Nonomuraea* sp. ATCC 55076 |
| SBP00180 | Olive oil buttery | *Nonomuraea* sp. ATCC 55076 |
| SBP00180 | Olive oil buttery | *Nostoc sphaeroides* |
| SBP00180 | Olive oil buttery | *Nostoc sphaeroides* |
| SBP00180 | Olive oil buttery | *Novosphingobium resinovorum* |
| SBP00180 | Olive oil buttery | *Novosphingobium resinovorum* |
| SBP00180 | Olive oil buttery | *Novosphingobium* sp. P6W |
| SBP00180 | Olive oil buttery | *Novosphingobium* sp. P6W |
| SBP00180 | Olive oil buttery | *Ochrobactrum anthropi* |
| SBP00180 | Olive oil buttery | *Ochrobactrum anthropi* |
| SBP00180 | Olive oil buttery | *Ochrobactrum* sp. A44 |
| SBP00180 | Olive oil buttery | *Ochrobactrum* sp. A44 |
| SBP00180 | Olive oil buttery | *Oligotropha carboxidovorans* |
| SBP00180 | Olive oil buttery | *Oligotropha carboxidovorans* |
| SBP00180 | Olive oil buttery | *Orrella dioscoreae* |
| SBP00180 | Olive oil buttery | *Orrella dioscoreae* |
| SBP00180 | Olive oil buttery | *Ottowia oryzae* |
| SBP00180 | Olive oil buttery | *Ottowia oryzae* |
| SBP00180 | Olive oil buttery | *Ottowia* sp. oral taxon 894 |
| SBP00180 | Olive oil buttery | *Ottowia* sp. oral taxon 894 |
| SBP00180 | Olive oil buttery | *Pandoraea faecigallinarum* |
| SBP00180 | Olive oil buttery | *Pandoraea faecigallinarum* |
| SBP00180 | Olive oil buttery | *Pandoraea norimbergensis* |
| SBP00180 | Olive oil buttery | *Pandoraea norimbergensis* |
| SBP00180 | Olive oil buttery | *Pandoraea pnomenusa* |
| SBP00180 | Olive oil buttery | *Pandoraea pnomenusa* |

TABLE 3-continued

List of species identified in each metagenomic sample of each SBP Sample

| SBP ID | SBP Host Common Name | Genus sp. |
|---|---|---|
| SBP00180 | Olive oil buttery | *Pandoraea pulmonicola* |
| SBP00180 | Olive oil buttery | *Pandoraea pulmonicola* |
| SBP00180 | Olive oil buttery | *Pandoraea vervacti* |
| SBP00180 | Olive oil buttery | *Pandoraea vervacti* |
| SBP00180 | Olive oil buttery | *Pannonibacter phragmitetus* |
| SBP00180 | Olive oil buttery | *Pannonibacter phragmitetus* |
| SBP00180 | Olive oil buttery | *Pantoea agglomerans* |
| SBP00180 | Olive oil buttery | *Pantoea agglomerans* |
| SBP00180 | Olive oil buttery | *Paraburkholderia aromaticivorans* |
| SBP00180 | Olive oil buttery | *Paraburkholderia aromaticivorans* |
| SBP00180 | Olive oil buttery | *Paraburkholderia caffeinilytica* |
| SBP00180 | Olive oil buttery | *Paraburkholderia caffeinilytica* |
| SBP00180 | Olive oil buttery | *Paraburkholderia caribensis* |
| SBP00180 | Olive oil buttery | *Paraburkholderia caribensis* |
| SBP00180 | Olive oil buttery | *Paraburkholderia fungorum* |
| SBP00180 | Olive oil buttery | *Paraburkholderia fungorum* |
| SBP00180 | Olive oil buttery | *Paraburkholderia hospita* |
| SBP00180 | Olive oil buttery | *Paraburkholderia hospita* |
| SBP00180 | Olive oil buttery | *Paraburkholderia phenoliruptrix* |
| SBP00180 | Olive oil buttery | *Paraburkholderia phenoliruptrix* |
| SBP00180 | Olive oil buttery | *Paraburkholderia phymatum* |
| SBP00180 | Olive oil buttery | *Paraburkholderia phymatum* |
| SBP00180 | Olive oil buttery | *Paraburkholderia phytofirmans* |
| SBP00180 | Olive oil buttery | *Paraburkholderia phytofirmans* |
| SBP00180 | Olive oil buttery | *Paraburkholderia sprentiae* |
| SBP00180 | Olive oil buttery | *Paraburkholderia sprentiae* |
| SBP00180 | Olive oil buttery | *Paraburkholderia terricola* |
| SBP00180 | Olive oil buttery | *Paraburkholderia terricola* |
| SBP00180 | Olive oil buttery | *Paraburkholderia xenovorans* |
| SBP00180 | Olive oil buttery | *Paraburkholderia xenovorans* |
| SBP00180 | Olive oil buttery | *Paracoccus yeei* |
| SBP00180 | Olive oil buttery | *Paracoccus yeei* |
| SBP00180 | Olive oil buttery | *Parvibaculum lavamentivorans* |
| SBP00180 | Olive oil buttery | *Parvibaculum lavamentivorans* |
| SBP00180 | Olive oil buttery | *Pasteurella multocida* |
| SBP00180 | Olive oil buttery | *Pasteurella multocida* |
| SBP00180 | Olive oil buttery | *Paucibacter* sp. KCTC 42545 |
| SBP00180 | Olive oil buttery | *Paucibacter* sp. KCTC 42545 |
| SBP00180 | Olive oil buttery | *Pediococcus pentosaceus* |
| SBP00180 | Olive oil buttery | *Pediococcus pentosaceus* |
| SBP00180 | Olive oil buttery | *Pedobacter* sp. G11 |
| SBP00180 | Olive oil buttery | *Pedobacter* sp. G11 |
| SBP00180 | Olive oil buttery | *Peptoniphilus harei* |
| SBP00180 | Olive oil buttery | *Peptoniphilus harei* |
| SBP00180 | Olive oil buttery | *Phaeobacter inhibens* |
| SBP00180 | Olive oil buttery | *Phaeobacter inhibens* |
| SBP00180 | Olive oil buttery | *Phenylobacterium zucineum* |
| SBP00180 | Olive oil buttery | *Phenylobacterium zucineum* |
| SBP00180 | Olive oil buttery | *Phreatobacter stygius* |
| SBP00180 | Olive oil buttery | *Phreatobacter stygius* |
| SBP00180 | Olive oil buttery | *Phyllobacterium zundukense* |
| SBP00180 | Olive oil buttery | *Phyllobacterium zundukense* |
| SBP00180 | Olive oil buttery | *Pigmentiphaga* sp. H8 |
| SBP00180 | Olive oil buttery | *Pigmentiphaga* sp. H8 |
| SBP00180 | Olive oil buttery | *Plantibacter* sp. |
| SBP00180 | Olive oil buttery | *Plantibacter* sp. |
| SBP00180 | Olive oil buttery | *Pleomorphomonas* sp. SM30 |
| SBP00180 | Olive oil buttery | *Pleomorphomonas* sp. SM30 |
| SBP00180 | Olive oil buttery | *Polaromonas naphthalenivorans* |
| SBP00180 | Olive oil buttery | *Polaromonas naphthalenivorans* |
| SBP00180 | Olive oil buttery | *Polaromonas* sp. JS666 |
| SBP00180 | Olive oil buttery | *Polaromonas* sp. JS666 |
| SBP00180 | Olive oil buttery | *Polaromonas* sp. SP1 |
| SBP00180 | Olive oil buttery | *Polaromonas* sp. SP1 |
| SBP00180 | Olive oil buttery | *Prevotella fusca* |
| SBP00180 | Olive oil buttery | *Prevotella fusca* |
| SBP00180 | Olive oil buttery | *Prevotella intermedia* |
| SBP00180 | Olive oil buttery | *Prevotella intermedia* |
| SBP00180 | Olive oil buttery | *Prevotella melaninogenica* |
| SBP00180 | Olive oil buttery | *Prevotella melaninogenica* |
| SBP00180 | Olive oil buttery | *Propionibacterium acidifaciens* |
| SBP00180 | Olive oil buttery | *Propionibacterium acidifaciens* |
| SBP00180 | Olive oil buttery | *Propionibacterium* sp. oral taxon 193 |
| SBP00180 | Olive oil buttery | *Propionibacterium* sp. oral taxon 193 |
| SBP00180 | Olive oil buttery | *Providencia rettgeri* |
| SBP00180 | Olive oil buttery | *Providencia rettgeri* |

TABLE 3-continued

List of species identified in each metagenomic sample of each SBP Sample

| SBP ID | SBP Host Common Name | Genus sp. |
|---|---|---|
| SBP00180 | Olive oil buttery | *Providencia* sp. WCHPr000369 |
| SBP00180 | Olive oil buttery | *Providencia* sp. WCHPr000369 |
| SBP00180 | Olive oil buttery | *Pseudolabrys taiwanensis* |
| SBP00180 | Olive oil buttery | *Pseudolabrys taiwanensis* |
| SBP00180 | Olive oil buttery | *Pseudomonas aeruginosa* |
| SBP00180 | Olive oil buttery | *Pseudomonas aeruginosa* |
| SBP00180 | Olive oil buttery | *Pseudomonas alkylphenolica* |
| SBP00180 | Olive oil buttery | *Pseudomonas alkylphenolica* |
| SBP00180 | Olive oil buttery | *Pseudomonas antarctica* |
| SBP00180 | Olive oil buttery | *Pseudomonas antarctica* |
| SBP00180 | Olive oil buttery | *Pseudomonas balearica* |
| SBP00180 | Olive oil buttery | *Pseudomonas balearica* |
| SBP00180 | Olive oil buttery | *Pseudomonas chlororaphis* |
| SBP00180 | Olive oil buttery | *Pseudomonas chlororaphis* |
| SBP00180 | Olive oil buttery | *Pseudomonas citronellolis* |
| SBP00180 | Olive oil buttery | *Pseudomonas citronellolis* |
| SBP00180 | Olive oil buttery | *Pseudomonas entomophila* |
| SBP00180 | Olive oil buttery | *Pseudomonas entomophila* |
| SBP00180 | Olive oil buttery | *Pseudomonas extremaustralis* |
| SBP00180 | Olive oil buttery | *Pseudomonas extremaustralis* |
| SBP00180 | Olive oil buttery | *Pseudomonas fluorescens* |
| SBP00180 | Olive oil buttery | *Pseudomonas fluorescens* |
| SBP00180 | Olive oil buttery | *Pseudomonas koreensis* |
| SBP00180 | Olive oil buttery | *Pseudomonas koreensis* |
| SBP00180 | Olive oil buttery | *Pseudomonas mandelii* |
| SBP00180 | Olive oil buttery | *Pseudomonas mandelii* |
| SBP00180 | Olive oil buttery | *Pseudomonas mendocina* |
| SBP00180 | Olive oil buttery | *Pseudomonas mendocina* |
| SBP00180 | Olive oil buttery | *Pseudomonas moraviensis* |
| SBP00180 | Olive oil buttery | *Pseudomonas moraviensis* |
| SBP00180 | Olive oil buttery | *Pseudomonas oryzihabitans* |
| SBP00180 | Olive oil buttery | *Pseudomonas oryzihabitans* |
| SBP00180 | Olive oil buttery | *Pseudomonas parafulva* |
| SBP00180 | Olive oil buttery | *Pseudomonas parafulva* |
| SBP00180 | Olive oil buttery | *Pseudomonas protegens* |
| SBP00180 | Olive oil buttery | *Pseudomonas protegens* |
| SBP00180 | Olive oil buttery | *Pseudomonas putida* |
| SBP00180 | Olive oil buttery | *Pseudomonas putida* |
| SBP00180 | Olive oil buttery | *Pseudomonas* sp. |
| SBP00180 | Olive oil buttery | *Pseudomonas* sp. |
| SBP00180 | Olive oil buttery | *Pseudomonas* sp. ATCC 13867 |
| SBP00180 | Olive oil buttery | *Pseudomonas* sp. ATCC 13867 |
| SBP00180 | Olive oil buttery | *Pseudomonas* sp. B10 |
| SBP00180 | Olive oil buttery | *Pseudomonas* sp. B10 |
| SBP00180 | Olive oil buttery | *Pseudomonas* sp. CMR5c |
| SBP00180 | Olive oil buttery | *Pseudomonas* sp. CMR5c |
| SBP00180 | Olive oil buttery | *Pseudomonas* sp. K-62 |
| SBP00180 | Olive oil buttery | *Pseudomonas* sp. K-62 |
| SBP00180 | Olive oil buttery | *Pseudomonas* sp. Leaf58 |
| SBP00180 | Olive oil buttery | *Pseudomonas* sp. Leaf58 |
| SBP00180 | Olive oil buttery | *Pseudomonas* sp. phDV1 |
| SBP00180 | Olive oil buttery | *Pseudomonas* sp. phDV1 |
| SBP00180 | Olive oil buttery | *Pseudomonas* sp. TCU-HL1 |
| SBP00180 | Olive oil buttery | *Pseudomonas* sp. TCU-HL1 |
| SBP00180 | Olive oil buttery | *Pseudomonas stutzeri* |
| SBP00180 | Olive oil buttery | *Pseudomonas stutzeri* |
| SBP00180 | Olive oil buttery | *Pseudomonas synxantha* |
| SBP00180 | Olive oil buttery | *Pseudomonas synxantha* |
| SBP00180 | Olive oil buttery | *Pseudomonas syringae* |
| SBP00180 | Olive oil buttery | *Pseudomonas syringae* |
| SBP00180 | Olive oil buttery | *Pseudomonas vancouverensis* |
| SBP00180 | Olive oil buttery | *Pseudomonas vancouverensis* |
| SBP00180 | Olive oil buttery | *Pseudonocardia autotrophica* |
| SBP00180 | Olive oil buttery | *Pseudonocardia autotrophica* |
| SBP00180 | Olive oil buttery | *Pseudonocardia dioxanivorans* |
| SBP00180 | Olive oil buttery | *Pseudonocardia dioxanivorans* |
| SBP00180 | Olive oil buttery | *Pseudorhodoplanes sinuspersici* |
| SBP00180 | Olive oil buttery | *Pseudorhodoplanes sinuspersici* |
| SBP00180 | Olive oil buttery | *Pseudoxanthomonas suwonensis* |
| SBP00180 | Olive oil buttery | *Pseudoxanthomonas suwonensis* |
| SBP00180 | Olive oil buttery | *Rahnella aquatilis* |
| SBP00180 | Olive oil buttery | *Rahnella aquatilis* |
| SBP00180 | Olive oil buttery | *Ralstonia insidiosa* |
| SBP00180 | Olive oil buttery | *Ralstonia insidiosa* |
| SBP00180 | Olive oil buttery | *Ralstonia mannitolilytica* |
| SBP00180 | Olive oil buttery | *Ralstonia mannitolilytica* |

TABLE 3-continued

List of species identified in each metagenomic sample of each SBP Sample

| SBP ID | SBP Host Common Name | Genus sp. |
|---|---|---|
| SBP00180 | Olive oil buttery | *Raistonia pickettii* |
| SBP00180 | Olive oil buttery | *Ralstonia pickettii* |
| SBP00180 | Olive oil buttery | *Ralstonia solanacearum* |
| SBP00180 | Olive oil buttery | *Ralstonia solanacearum* |
| SBP00180 | Olive oil buttery | *Ramlibacter tataouinensis* |
| SBP00180 | Olive oil buttery | *Ramlibacter tataouinensis* |
| SBP00180 | Olive oil buttery | *Raoultella ornithinolytica* |
| SBP00180 | Olive oil buttery | *Raoultella ornithinolytica* |
| SBP00180 | Olive oil buttery | *Raoultella terrigena* |
| SBP00180 | Olive oil buttery | *Raoultella terrigena* |
| SBP00180 | Olive oil buttery | *Rathayibacter tritici* |
| SBP00180 | Olive oil buttery | *Rathayibacter tritici* |
| SBP00180 | Olive oil buttery | *Rhizobacter gummiphilus* |
| SBP00180 | Olive oil buttery | *Rhizobacter gummiphilus* |
| SBP00180 | Olive oil buttery | *Rhizobium etli* |
| SBP00180 | Olive oil buttery | *Rhizobium etli* |
| SBP00180 | Olive oil buttery | *Rhizobium leguminosarum* |
| SBP00180 | Olive oil buttery | *Rhizobium leguminosarum* |
| SBP00180 | Olive oil buttery | *Rhizobium* sp. ACO-34A |
| SBP00180 | Olive oil buttery | *Rhizobium* sp. ACO-34A |
| SBP00180 | Olive oil buttery | *Rhizobium* sp. NXC24 |
| SBP00180 | Olive oil buttery | *Rhizobium* sp. NXC24 |
| SBP00180 | Olive oil buttery | *Rhizobium tropici* |
| SBP00180 | Olive oil buttery | *Rhizobium tropici* |
| SBP00180 | Olive oil buttery | *Rhodanobacter denitrificans* |
| SBP00180 | Olive oil buttery | *Rhodanobacter denitrificans* |
| SBP00180 | Olive oil buttery | *Rhodobacter sphaeroides* |
| SBP00180 | Olive oil buttery | *Rhodobacter sphaeroides* |
| SBP00180 | Olive oil buttery | *Rhodococcus fascians* |
| SBP00180 | Olive oil buttery | *Rhodococcus fascians* |
| SBP00180 | Olive oil buttery | *Rhodococcus opacus* |
| SBP00180 | Olive oil buttery | *Rhodococcus opacus* |
| SBP00180 | Olive oil buttery | *Rhodococcus* sp. PBTS 1 |
| SBP00180 | Olive oil buttery | *Rhodococcus* sp. PBTS 1 |
| SBP00180 | Olive oil buttery | *Rhodoferax antarcticus* |
| SBP00180 | Olive oil buttery | *Rhodoferax antarcticus* |
| SBP00180 | Olive oil buttery | *Rhodoferax ferrireducens* |
| SBP00180 | Olive oil buttery | *Rhodoferax ferrireducens* |
| SBP00180 | Olive oil buttery | *Rhodoferax koreense* |
| SBP00180 | Olive oil buttery | *Rhodoferax koreense* |
| SBP00180 | Olive oil buttery | *Rhodoferax saidenbachensis* |
| SBP00180 | Olive oil buttery | *Rhodoferax saidenbachensis* |
| SBP00180 | Olive oil buttery | *Rhodoplanes* sp. Z2-YC6860 |
| SBP00180 | Olive oil buttery | *Rhodoplanes* sp. Z2-YC6860 |
| SBP00180 | Olive oil buttery | *Rhodopseudomonas palustris* |
| SBP00180 | Olive oil buttery | *Rhodopseudomonas palustris* |
| SBP00180 | Olive oil buttery | *Rhodovulum sulfidophilum* |
| SBP00180 | Olive oil buttery | *Rhodovulum sulfidophilum* |
| SBP00180 | Olive oil buttery | *Roseateles depolymerans* |
| SBP00180 | Olive oil buttery | *Roseateles depolymerans* |
| SBP00180 | Olive oil buttery | *Roseomonas gilardii* |
| SBP00180 | Olive oil buttery | *Roseomonas gilardii* |
| SBP00180 | Olive oil buttery | *Roseomonas* sp. FDAARGOS_362 |
| SBP00180 | Olive oil buttery | *Roseomonas* sp. FDAARGOS_362 |
| SBP00180 | Olive oil buttery | *Rothia dentocariosa* |
| SBP00180 | Olive oil buttery | *Rothia dentocariosa* |
| SBP00180 | Olive oil buttery | *Rothia mucilaginosa* |
| SBP00180 | Olive oil buttery | *Rothia mucilaginosa* |
| SBP00180 | Olive oil buttery | *Rubrivivax gelatinosus* |
| SBP00180 | Olive oil buttery | *Rubrivivax gelatinosus* |
| SBP00180 | Olive oil buttery | *Saccharomonospora azurea* |
| SBP00180 | Olive oil buttery | *Saccharomonospora azurea* |
| SBP00180 | Olive oil buttery | *Sandaracinus amylolyticus* |
| SBP00180 | Olive oil buttery | *Sandaracinus amylolyticus* |
| SBP00180 | Olive oil buttery | *Sanguibacter keddieii* |
| SBP00180 | Olive oil buttery | *Sanguibacter keddieii* |
| SBP00180 | Olive oil buttery | *Serinicoccus* sp. JLT9 |
| SBP00180 | Olive oil buttery | *Serinicoccus* sp. JLT9 |
| SBP00180 | Olive oil buttery | *Serpentinomonas mccroryi* |
| SBP00180 | Olive oil buttery | *Serpentinomonas mccroryi* |
| SBP00180 | Olive oil buttery | *Serpentinomonas raichei* |
| SBP00180 | Olive oil buttery | *Serpentinomonas raichei* |
| SBP00180 | Olive oil buttery | *Serratia marcescens* |
| SBP00180 | Olive oil buttery | *Serratia marcescens* |
| SBP00180 | Olive oil buttery | *Shewanella benthica* |
| SBP00180 | Olive oil buttery | *Shewanella benthica* |

TABLE 3-continued

List of species identified in each metagenomic sample of each SBP Sample

| SBP ID | SBP Host Common Name | Genus sp. |
| --- | --- | --- |
| SBP00180 | Olive oil buttery | *Shinella* sp. HZN7 |
| SBP00180 | Olive oil buttery | *Shinella* sp. HZN7 |
| SBP00180 | Olive oil buttery | *Simplicispira suum* |
| SBP00180 | Olive oil buttery | *Simplicispira suum* |
| SBP00180 | Olive oil buttery | *Sinomonas atrocyanea* |
| SBP00180 | Olive oil buttery | *Sinomonas atrocyanea* |
| SBP00180 | Olive oil buttery | *Sinorhizobium fredii* |
| SBP00180 | Olive oil buttery | *Sinorhizobium fredii* |
| SBP00180 | Olive oil buttery | *Sinorhizobium meliloti* |
| SBP00180 | Olive oil buttery | *Sinorhizobium meliloti* |
| SBP00180 | Olive oil buttery | *Sinorhizobium* sp. RAC02 |
| SBP00180 | Olive oil buttery | *Sinorhizobium* sp. RAC02 |
| SBP00180 | Olive oil buttery | *Sorangium cellulosum* |
| SBP00180 | Olive oil buttery | *Sorangium cellulosum* |
| SBP00180 | Olive oil buttery | *Sphingobium amiense* |
| SBP00180 | Olive oil buttery | *Sphingobium amiense* |
| SBP00180 | Olive oil buttery | *Sphingobium cloacae* |
| SBP00180 | Olive oil buttery | *Sphingobium cloacae* |
| SBP00180 | Olive oil buttery | *Sphingobium herbicidovorans* |
| SBP00180 | Olive oil buttery | *Sphingobium herbicidovorans* |
| SBP00180 | Olive oil buttery | *Sphingobium hydrophobicum* |
| SBP00180 | Olive oil buttery | *Sphingobium hydrophobicum* |
| SBP00180 | Olive oil buttery | *Sphingobium* sp. EP60837 |
| SBP00180 | Olive oil buttery | *Sphingobium* sp. EP60837 |
| SBP00180 | Olive oil buttery | *Sphingobium* sp. MI1205 |
| SBP00180 | Olive oil buttery | *Sphingobium* sp. MI1205 |
| SBP00180 | Olive oil buttery | *Sphingobium* sp. RAC03 |
| SBP00180 | Olive oil buttery | *Sphingobium* sp. RAC03 |
| SBP00180 | Olive oil buttery | *Sphingobium yanoikuyae* |
| SBP00180 | Olive oil buttery | *Sphingobium yanoikuyae* |
| SBP00180 | Olive oil buttery | *Sphingomonas koreensis* |
| SBP00180 | Olive oil buttery | *Sphingomonas koreensis* |
| SBP00180 | Olive oil buttery | *Sphingomonas panacis* |
| SBP00180 | Olive oil buttery | *Sphingomonas panacis* |
| SBP00180 | Olive oil buttery | *Sphingomonas paucimobilis* |
| SBP00180 | Olive oil buttery | *Sphingomonas paucimobilis* |
| SBP00180 | Olive oil buttery | *Sphingomonas sanxanigenens* |
| SBP00180 | Olive oil buttery | *Sphingomonas sanxanigenens* |
| SBP00180 | Olive oil buttery | *Sphingomonas* sp. AAP5 |
| SBP00180 | Olive oil buttery | *Sphingomonas* sp. AAP5 |
| SBP00180 | Olive oil buttery | *Sphingomonas* sp. Cra20 |
| SBP00180 | Olive oil buttery | *Sphingomonas* sp. Cra20 |
| SBP00180 | Olive oil buttery | *Sphingomonas* sp. FARSPH |
| SBP00180 | Olive oil buttery | *Sphingomonas* sp. FARSPH |
| SBP00180 | Olive oil buttery | *Sphingomonas* sp. KC8 |
| SBP00180 | Olive oil buttery | *Sphingomonas* sp. KC8 |
| SBP00180 | Olive oil buttery | *Sphingomonas* sp. LK11 |
| SBP00180 | Olive oil buttery | *Sphingomonas* sp. LK11 |
| SBP00180 | Olive oil buttery | *Sphingomonas* sp. LM7 |
| SBP00180 | Olive oil buttery | *Sphingomonas* sp. LM7 |
| SBP00180 | Olive oil buttery | *Sphingomonas* sp. MM-1 |
| SBP00180 | Olive oil buttery | *Sphingomonas* sp. MM-1 |
| SBP00180 | Olive oil buttery | *Sphingomonas* sp. YZ-8 |
| SBP00180 | Olive oil buttery | *Sphingomonas* sp. YZ-8 |
| SBP00180 | Olive oil buttery | *Sphingomonas taxi* |
| SBP00180 | Olive oil buttery | *Sphingomonas taxi* |
| SBP00180 | Olive oil buttery | *Sphingomonas wittichii* |
| SBP00180 | Olive oil buttery | *Sphingomonas wittichii* |
| SBP00180 | Olive oil buttery | *Sphingopyxis fribergensis* |
| SBP00180 | Olive oil buttery | *Sphingopyxis fribergensis* |
| SBP00180 | Olive oil buttery | *Sphingopyxis macrogoltabida* |
| SBP00180 | Olive oil buttery | *Sphingopyxis macrogoltabida* |
| SBP00180 | Olive oil buttery | *Sphingopyxis* sp. 113P3 |
| SBP00180 | Olive oil buttery | *Sphingopyxis* sp. 113P3 |
| SBP00180 | Olive oil buttery | *Sphingopyxis* sp. QXT-31 |
| SBP00180 | Olive oil buttery | *Sphingopyxis* sp. QXT-31 |
| SBP00180 | Olive oil buttery | *Sphingorhabdus* sp. YGSMI21 |
| SBP00180 | Olive oil buttery | *Sphingorhabdus* sp. YGSMI21 |
| SBP00180 | Olive oil buttery | *Sphingosinicella microcystinivorans* |
| SBP00180 | Olive oil buttery | *Sphingosinicella microcystinivorans* |
| SBP00180 | Olive oil buttery | *Staphylococcus aureus* |
| SBP00180 | Olive oil buttery | *Staphylococcus aureus* |
| SBP00180 | Olive oil buttery | *Staphylococcus epidermidis* |
| SBP00180 | Olive oil buttery | *Staphylococcus epidermidis* |
| SBP00180 | Olive oil buttery | *Staphylococcus haemolyticus* |
| SBP00180 | Olive oil buttery | *Staphylococcus haemolyticus* |

TABLE 3-continued

List of species identified in each metagenomic sample of each SBP Sample

| SBP ID | SBP Host Common Name | Genus sp. |
|---|---|---|
| SBP00180 | Olive oil buttery | *Staphylococcus hominis* |
| SBP00180 | Olive oil buttery | *Staphylococcus hominis* |
| SBP00180 | Olive oil buttery | *Staphylococcus nepalensis* |
| SBP00180 | Olive oil buttery | *Staphylococcus nepalensis* |
| SBP00180 | Olive oil buttery | *Staphylococcus saprophyticus* |
| SBP00180 | Olive oil buttery | *Staphylococcus saprophyticus* |
| SBP00180 | Olive oil buttery | *Starkeya novella* |
| SBP00180 | Olive oil buttery | *Starkeya novella* |
| SBP00180 | Olive oil buttery | *Stella vacuolata* |
| SBP00180 | Olive oil buttery | *Stella vacuolata* |
| SBP00180 | Olive oil buttery | *Stenotrophomonas maltophilia* |
| SBP00180 | Olive oil buttery | *Stenotrophomonas maltophilia* |
| SBP00180 | Olive oil buttery | *Sterolibacteriaceae bacterium* JSB |
| SBP00180 | Olive oil buttery | *Sterolibacteriaceae bacterium* JSB |
| SBP00180 | Olive oil buttery | *Streptacidiphilus* sp. DSM 106435 |
| SBP00180 | Olive oil buttery | *Streptacidiphilus* sp. DSM 106435 |
| SBP00180 | Olive oil buttery | *Streptococcus cristatus* |
| SBP00180 | Olive oil buttery | *Streptococcus cristatus* |
| SBP00180 | Olive oil buttery | *Streptococcus mitis* |
| SBP00180 | Olive oil buttery | *Streptococcus mitis* |
| SBP00180 | Olive oil buttery | *Streptococcus oralis* |
| SBP00180 | Olive oil buttery | *Streptococcus oralis* |
| SBP00180 | Olive oil buttery | *Streptococcus pneumoniae* |
| SBP00180 | Olive oil buttery | *Streptococcus pneumoniae* |
| SBP00180 | Olive oil buttery | *Streptococcus sanguinis* |
| SBP00180 | Olive oil buttery | *Streptococcus sanguinis* |
| SBP00180 | Olive oil buttery | *Streptococcus* sp. ChDC B345 |
| SBP00180 | Olive oil buttery | *Streptococcus* sp. ChDC B345 |
| SBP00180 | Olive oil buttery | *Streptococcus thermophilus* |
| SBP00180 | Olive oil buttery | *Streptococcus thermophilus* |
| SBP00180 | Olive oil buttery | *Streptomyces alboflavus* |
| SBP00180 | Olive oil buttery | *Streptomyces alboflavus* |
| SBP00180 | Olive oil buttery | *Streptomyces globosus* |
| SBP00180 | Olive oil buttery | *Streptomyces globosus* |
| SBP00180 | Olive oil buttery | *Streptomyces griseorubiginosus* |
| SBP00180 | Olive oil buttery | *Streptomyces griseorubiginosus* |
| SBP00180 | Olive oil buttery | *Streptomyces hygroscopicus* |
| SBP00180 | Olive oil buttery | *Streptomyces hygroscopicus* |
| SBP00180 | Olive oil buttery | *Streptomyces scabiei* |
| SBP00180 | Olive oil buttery | *Streptomyces scabiei* |
| SBP00180 | Olive oil buttery | *Streptomyces* sp. 769 |
| SBP00180 | Olive oil buttery | *Streptomyces* sp. 769 |
| SBP00180 | Olive oil buttery | *Streptomyces* sp. M2 |
| SBP00180 | Olive oil buttery | *Streptomyces* sp. M2 |
| SBP00180 | Olive oil buttery | *Streptomyces* sp. P3 |
| SBP00180 | Olive oil buttery | *Streptomyces* sp. P3 |
| SBP00180 | Olive oil buttery | *Sulfuritortus calidifontis* |
| SBP00180 | Olive oil buttery | *Sulfuritortus calidifontis* |
| SBP00180 | Olive oil buttery | *Thauera aromatica* |
| SBP00180 | Olive oil buttery | *Thauera aromatica* |
| SBP00180 | Olive oil buttery | *Thauera* sp. K11 |
| SBP00180 | Olive oil buttery | *Thauera* sp. K11 |
| SBP00180 | Olive oil buttery | *Thioflavicoccus mobilis* |
| SBP00180 | Olive oil buttery | *Thioflavicoccus mobilis* |
| SBP00180 | Olive oil buttery | *Thiomonas arsenitoxydans* |
| SBP00180 | Olive oil buttery | *Thiomonas arsenitoxydans* |
| SBP00180 | Olive oil buttery | *Thiomonas intermedia* |
| SBP00180 | Olive oil buttery | *Thiomonas intermedia* |
| SBP00180 | Olive oil buttery | *Thiomonas* sp. X19 |
| SBP00180 | Olive oil buttery | *Thiomonas* sp. X19 |
| SBP00180 | Olive oil buttery | *Tistrella mobilis* |
| SBP00180 | Olive oil buttery | *Tistrella mobilis* |
| SBP00180 | Olive oil buttery | *Tsukamurella paurometabola* |
| SBP00180 | Olive oil buttery | *Tsukamurella paurometabola* |
| SBP00180 | Olive oil buttery | *Variibacter gotjawalensis* |
| SBP00180 | Olive oil buttery | *Variibacter gotjawalensis* |
| SBP00180 | Olive oil buttery | *Variovorax boronicumulans* |
| SBP00180 | Olive oil buttery | *Variovorax boronicumulans* |
| SBP00180 | Olive oil buttery | *Variovorax paradoxus* |
| SBP00180 | Olive oil buttery | *Variovorax paradoxus* |
| SBP00180 | Olive oil buttery | *Variovorax* sp. HW608 |
| SBP00180 | Olive oil buttery | *Variovorax* sp. HW608 |
| SBP00180 | Olive oil buttery | *Variovorax* sp. PAMC 28711 |
| SBP00180 | Olive oil buttery | *Variovorax* sp. PAMC 28711 |
| SBP00180 | Olive oil buttery | *Variovorax* sp. PMC12 |
| SBP00180 | Olive oil buttery | *Variovorax* sp. PMC12 |

TABLE 3-continued

List of species identified in each metagenomic sample of each SBP Sample

| SBP ID | SBP Host Common Name | Genus sp. |
|---|---|---|
| SBP00180 | Olive oil buttery | *Verminephrobacter eiseniae* |
| SBP00180 | Olive oil buttery | *Verminephrobacter eiseniae* |
| SBP00180 | Olive oil buttery | *Vibrio rumoiensis* |
| SBP00180 | Olive oil buttery | *Vibrio rumoiensis* |
| SBP00180 | Olive oil buttery | *Vogesella* sp. LIG4 |
| SBP00180 | Olive oil buttery | *Vogesella* sp. LIG4 |
| SBP00180 | Olive oil buttery | *Xanthobacter autotrophicus* |
| SBP00180 | Olive oil buttery | *Xanthobacter autotrophicus* |
| SBP00180 | Olive oil buttery | *Xanthomonas arboricola* |
| SBP00180 | Olive oil buttery | *Xanthomonas arboricola* |
| SBP00180 | Olive oil buttery | *Xanthomonas campestris* |
| SBP00180 | Olive oil buttery | *Xanthomonas campestris* |
| SBP00180 | Olive oil buttery | *Xanthomonas oryzae* |
| SBP00180 | Olive oil buttery | *Xanthomonas oryzae* |
| SBP00180 | Olive oil buttery | *Xanthomonas sacchari* |
| SBP00180 | Olive oil buttery | *Xanthomonas sacchari* |
| SBP00180 | Olive oil buttery | *Xylanimonas cellulosilytica* |
| SBP00180 | Olive oil buttery | *Xylanimonas cellulosilytica* |
| SBP00183 | Fermented Pepper Paste | [*Polyangium*] *brachysporum* |
| SBP00183 | Fermented Pepper Paste | *Achromobacter denitrificans* |
| SBP00183 | Fermented Pepper Paste | *Achromobacter insolitus* |
| SBP00183 | Fermented Pepper Paste | *Achromobacter spanius* |
| SBP00183 | Fermented Pepper Paste | *Achromobacter xylosoxidans* |
| SBP00183 | Fermented Pepper Paste | *Acidovorax avenae* |
| SBP00183 | Fermented Pepper Paste | *Acidovorax carolinensis* |
| SBP00183 | Fermented Pepper Paste | *Acidovorax citrulli* |
| SBP00183 | Fermented Pepper Paste | *Acidovorax* sp. 1608163 |
| SBP00183 | Fermented Pepper Paste | *Acidovorax* sp. KKS102 |
| SBP00183 | Fermented Pepper Paste | *Acidovorax* sp. T1 |
| SBP00183 | Fermented Pepper Paste | *Acinetobacter calcoaceticus* |
| SBP00183 | Fermented Pepper Paste | *Actinoalloteichus* sp. AHMU CJ021 |
| SBP00183 | Fermented Pepper Paste | *Actinoplanes friuliensis* |
| SBP00183 | Fermented Pepper Paste | *Actinoplanes teichomyceticus* |
| SBP00183 | Fermented Pepper Paste | *Aeromicrobium* sp. 592 |
| SBP00183 | Fermented Pepper Paste | *Afipia* sp. GAS231 |
| SBP00183 | Fermented Pepper Paste | *Agrobacterium fabrum* |
| SBP00183 | Fermented Pepper Paste | *Agrobacterium larrymoorei* |
| SBP00183 | Fermented Pepper Paste | *Agrobacterium rhizogenes* |
| SBP00183 | Fermented Pepper Paste | *Agrobacterium* sp. |
| SBP00183 | Fermented Pepper Paste | *Agrobacterium* sp. H13-3 |
| SBP00183 | Fermented Pepper Paste | *Agrobacterium* sp. RAC06 |
| SBP00183 | Fermented Pepper Paste | *Agrobacterium tumefaciens* |
| SBP00183 | Fermented Pepper Paste | *Agrobacterium vitis* |
| SBP00183 | Fermented Pepper Paste | *Agromyces aureus* |
| SBP00183 | Fermented Pepper Paste | *Agromyces flavus* |
| SBP00183 | Fermented Pepper Paste | *Agromyces* sp. 30A |
| SBP00183 | Fermented Pepper Paste | *Agromyces* sp. LHK192 |
| SBP00183 | Fermented Pepper Paste | *Alicycliphilus denitrificans* |
| SBP00183 | Fermented Pepper Paste | *Alphaproteobacteria bacterium* WS11 |
| SBP00183 | Fermented Pepper Paste | *Aminobacter aminovorans* |
| SBP00183 | Fermented Pepper Paste | *Aminobacter* sp. MSH1 |
| SBP00183 | Fermented Pepper Paste | *Aquabacterium olei* |
| SBP00183 | Fermented Pepper Paste | *Arthrobacter alpinus* |
| SBP00183 | Fermented Pepper Paste | *Arthrobacter* sp. PAMC 25486 |
| SBP00183 | Fermented Pepper Paste | *Arthrobacter* sp. PGP41 |
| SBP00183 | Fermented Pepper Paste | *Arthrobacter* sp. QXT-31 |
| SBP00183 | Fermented Pepper Paste | *Arthrobacter* sp. Rue61a |
| SBP00183 | Fermented Pepper Paste | *Arthrobacter* sp. U41 |
| SBP00183 | Fermented Pepper Paste | *Arthrobacter* sp. YN |
| SBP00183 | Fermented Pepper Paste | *Atlantibacter hermannii* |
| SBP00183 | Fermented Pepper Paste | *Aureimonas* sp. AU20 |
| SBP00183 | Fermented Pepper Paste | *Bacillus amyloliquefaciens* |
| SBP00183 | Fermented Pepper Paste | *Bacillus cereus* |
| SBP00183 | Fermented Pepper Paste | *Bacillus safensis* |
| SBP00183 | Fermented Pepper Paste | *Bacillus thermoamylovorans* |
| SBP00183 | Fermented Pepper Paste | *Bacteroides vulgatus* |
| SBP00183 | Fermented Pepper Paste | *Bifidobacterium thermophilum* |
| SBP00183 | Fermented Pepper Paste | *Blastococcus saxobsidens* |
| SBP00183 | Fermented Pepper Paste | *Bordetella* genomosp. 8 |
| SBP00183 | Fermented Pepper Paste | *Bordetella hinzii* |
| SBP00183 | Fermented Pepper Paste | *Bosea* sp. AS-1 |
| SBP00183 | Fermented Pepper Paste | *Bosea vaviloviae* |
| SBP00183 | Fermented Pepper Paste | *Bradyrhizobiaceae bacterium* SG-6C |
| SBP00183 | Fermented Pepper Paste | *Bradyrhizobium diazoefficiens* |
| SBP00183 | Fermented Pepper Paste | *Bradyrhizobium erythrophlei* |
| SBP00183 | Fermented Pepper Paste | *Bradyrhizobium guangdongense* |

TABLE 3-continued

List of species identified in each metagenomic sample of each SBP Sample

| SBP ID | SBP Host Common Name | Genus sp. |
| --- | --- | --- |
| SBP00183 | Fermented Pepper Paste | *Bradyrhizobium guangxiense* |
| SBP00183 | Fermented Pepper Paste | *Bradyrhizobium icense* |
| SBP00183 | Fermented Pepper Paste | *Bradyrhizobium japonicum* |
| SBP00183 | Fermented Pepper Paste | *Bradyrhizobium lablabi* |
| SBP00183 | Fermented Pepper Paste | *Bradyrhizobium oligotrophicum* |
| SBP00183 | Fermented Pepper Paste | *Bradyrhizobium ottawaense* |
| SBP00183 | Fermented Pepper Paste | *Bradyrhizobium* sp. |
| SBP00183 | Fermented Pepper Paste | *Bradyrhizobium* sp. 2 39S1MB |
| SBP00183 | Fermented Pepper Paste | *Bradyrhizobium* sp. 3 |
| SBP00183 | Fermented Pepper Paste | *Bradyrhizobium* sp. 3 85S1MB |
| SBP00183 | Fermented Pepper Paste | *Bradyrhizobium* sp. BTAi1 |
| SBP00183 | Fermented Pepper Paste | *Bradyrhizobium* sp. CCBAU 51670 |
| SBP00183 | Fermented Pepper Paste | *Bradyrhizobium* sp. CCBAU 51778 |
| SBP00183 | Fermented Pepper Paste | *Bradyrhizobium* sp. CCGE-LA001 |
| SBP00183 | Fermented Pepper Paste | *Bradyrhizobium* sp. ORS 278 |
| SBP00183 | Fermented Pepper Paste | *Bradyrhizobium* sp. ORS 285 |
| SBP00183 | Fermented Pepper Paste | *Bradyrhizobium* sp. ORS 3257 |
| SBP00183 | Fermented Pepper Paste | *Bradyrhizobium* sp. S23321 |
| SBP00183 | Fermented Pepper Paste | *Bradyrhizobium* sp. SK17 |
| SBP00183 | Fermented Pepper Paste | *Bradyrhizobium* sp. WSM471 |
| SBP00183 | Fermented Pepper Paste | *Brenneria goodwinii* |
| SBP00183 | Fermented Pepper Paste | *Burkholderia contaminans* |
| SBP00183 | Fermented Pepper Paste | *Burkholderia gladioli* |
| SBP00183 | Fermented Pepper Paste | *Burkholderia pseudomallei* |
| SBP00183 | Fermented Pepper Paste | *Burkholderiales bacterium* JOSHI_001 |
| SBP00183 | Fermented Pepper Paste | *Buttiauxella* sp. 3AFRM03 |
| SBP00183 | Fermented Pepper Paste | Cauliflower mosaic virus |
| SBP00183 | Fermented Pepper Paste | *Cedecea neteri* |
| SBP00183 | Fermented Pepper Paste | *Cellulomonas fimi* |
| SBP00183 | Fermented Pepper Paste | *Chromobacterium vaccinii* |
| SBP00183 | Fermented Pepper Paste | *Chryseobacterium carnis* |
| SBP00183 | Fermented Pepper Paste | *Citrobacter amalonaticus* |
| SBP00183 | Fermented Pepper Paste | *Citrobacter freundii* |
| SBP00183 | Fermented Pepper Paste | *Clavibacter michiganensis* |
| SBP00183 | Fermented Pepper Paste | *Cloacibacterium normanense* |
| SBP00183 | Fermented Pepper Paste | *Collimonas arenae* |
| SBP00183 | Fermented Pepper Paste | *Collimonas fungivorans* |
| SBP00183 | Fermented Pepper Paste | *Comamonas aquatica* |
| SBP00183 | Fermented Pepper Paste | *Comamonas serinivorans* |
| SBP00183 | Fermented Pepper Paste | *Comamonas terrigena* |
| SBP00183 | Fermented Pepper Paste | *Comamonas testosteroni* |
| SBP00183 | Fermented Pepper Paste | *Confluentimicrobium* sp. EMB200-NS6 |
| SBP00183 | Fermented Pepper Paste | *Corallococcus coralloides* |
| SBP00183 | Fermented Pepper Paste | *Croceicoccus marinus* |
| SBP00183 | Fermented Pepper Paste | *Cronobacter sakazakii* |
| SBP00183 | Fermented Pepper Paste | *Cronobacter universalis* |
| SBP00183 | Fermented Pepper Paste | *Cryobacterium arcticum* |
| SBP00183 | Fermented Pepper Paste | *Cupriavidus basilensis* |
| SBP00183 | Fermented Pepper Paste | *Cupriavidus gilardii* |
| SBP00183 | Fermented Pepper Paste | *Cupriavidus metallidurans* |
| SBP00183 | Fermented Pepper Paste | *Cupriavidus necator* |
| SBP00183 | Fermented Pepper Paste | *Cupriavidus oxalaticus* |
| SBP00183 | Fermented Pepper Paste | *Cupriavidus pinatubonensis* |
| SBP00183 | Fermented Pepper Paste | *Cupriavidus taiwanensis* |
| SBP00183 | Fermented Pepper Paste | *Curtobacterium pusillum* |
| SBP00183 | Fermented Pepper Paste | *Curtobacterium* sp. BH-2-1-1 |
| SBP00183 | Fermented Pepper Paste | *Curtobacterium* sp. MR_MD2014 |
| SBP00183 | Fermented Pepper Paste | *Curtobacterium* sp. SGAir0471 |
| SBP00183 | Fermented Pepper Paste | *Cutibacterium acnes* |
| SBP00183 | Fermented Pepper Paste | *Delftia tsuruhatensis* |
| SBP00183 | Fermented Pepper Paste | *Devosia* sp. A16 |
| SBP00183 | Fermented Pepper Paste | *Devosia* sp. H5989 |
| SBP00183 | Fermented Pepper Paste | *Dickeya dadantii* |
| SBP00183 | Fermented Pepper Paste | *Dickeya zeae* |
| SBP00183 | Fermented Pepper Paste | *Dokdonella koreensis* |
| SBP00183 | Fermented Pepper Paste | *Edwardsiella tarda* |
| SBP00183 | Fermented Pepper Paste | *Ensifer adhaerens* |
| SBP00183 | Fermented Pepper Paste | *Enterobacter asburiae* |
| SBP00183 | Fermented Pepper Paste | *Enterobacter bugandensis* |
| SBP00183 | Fermented Pepper Paste | *Enterobacter cancerogenus* |
| SBP00183 | Fermented Pepper Paste | *Enterobacter cloacae* |
| SBP00183 | Fermented Pepper Paste | *Enterobacter cloacae* complex sp. |
| SBP00183 | Fermented Pepper Paste | *Enterobacter cloacae* complex sp. ECNIH7 |
| SBP00183 | Fermented Pepper Paste | *Enterobacter cloacae* complex sp. FDA-CDC-AR_0132 |
| SBP00183 | Fermented Pepper Paste | *Enterobacter cloacae* complex sp. FDA-CDC-AR_0164 |
| SBP00183 | Fermented Pepper Paste | *Enterobacter hormaechef* |

TABLE 3-continued

List of species identified in each metagenomic sample of each SBP Sample

| SBP ID | SBP Host Common Name | Genus sp. |
|---|---|---|
| SBP00183 | Fermented Pepper Paste | *Enterobacter kobei* |
| SBP00183 | Fermented Pepper Paste | *Enterobacter ludwigii* |
| SBP00183 | Fermented Pepper Paste | *Enterobacter roggenkampii* |
| SBP00183 | Fermented Pepper Paste | *Enterobacter soli* |
| SBP00183 | Fermented Pepper Paste | *Enterobacter* sp. 638 |
| SBP00183 | Fermented Pepper Paste | *Enterobacter* sp. DKU_NT_01 |
| SBP00183 | Fermented Pepper Paste | *Enterobacter* sp. E20 |
| SBP00183 | Fermented Pepper Paste | *Enterobacter* sp. FY-07 |
| SBP00183 | Fermented Pepper Paste | *Enterobacter* sp. HK169 |
| SBP00183 | Fermented Pepper Paste | *Enterobacter* sp. N18-03635 |
| SBP00183 | Fermented Pepper Paste | *Enterobacter* sp. ODB01 |
| SBP00183 | Fermented Pepper Paste | *Enterobacter* sp. SA187 |
| SBP00183 | Fermented Pepper Paste | *Enterococcus cecorum* |
| SBP00183 | Fermented Pepper Paste | *Enterococcus faecalis* |
| SBP00183 | Fermented Pepper Paste | *Enterococcus* sp. CR-Ec1 |
| SBP00183 | Fermented Pepper Paste | *Erwinia billingiae* |
| SBP00183 | Fermented Pepper Paste | *Erwinia gerundensis* |
| SBP00183 | Fermented Pepper Paste | *Erwinia* sp. |
| SBP00183 | Fermented Pepper Paste | *Escherichia coli* |
| SBP00183 | Fermented Pepper Paste | *Escherichia phage* HK639 |
| SBP00183 | Fermented Pepper Paste | *Flavobacterium johnsoniae* |
| SBP00183 | Fermented Pepper Paste | *Frondihabitans* sp. 762G35 |
| SBP00183 | Fermented Pepper Paste | *Frondihabitans* sp. PAMC 28766 |
| SBP00183 | Fermented Pepper Paste | *Gibbsiella quercinecans* |
| SBP00183 | Fermented Pepper Paste | *Hafnia alvei* |
| SBP00183 | Fermented Pepper Paste | *Halomonas* sp. hl-4 |
| SBP00183 | Fermented Pepper Paste | *Halomonas subglaciescola* |
| SBP00183 | Fermented Pepper Paste | *Herbaspirillum huttiense* |
| SBP00183 | Fermented Pepper Paste | *Herbaspirillum robiniae* |
| SBP00183 | Fermented Pepper Paste | *Herbaspirillum rubrisubalbicans* |
| SBP00183 | Fermented Pepper Paste | *Hydrogenophaga pseudoflava* |
| SBP00183 | Fermented Pepper Paste | *Hydrogenophaga* sp. NH-16 |
| SBP00183 | Fermented Pepper Paste | *Hydrogenophaga* sp. PBC |
| SBP00183 | Fermented Pepper Paste | *Hymenobacter* sp. APR13 |
| SBP00183 | Fermented Pepper Paste | *Inhella inkyongensis* |
| SBP00183 | Fermented Pepper Paste | *Isoptericola dokdonensis* |
| SBP00183 | Fermented Pepper Paste | *Janthinobacterium agaricidamnosum* |
| SBP00183 | Fermented Pepper Paste | *Janthinobacterium* sp. 1_2014MBL_MicDiv |
| SBP00183 | Fermented Pepper Paste | *Janthinobacterium svalbardensis* |
| SBP00183 | Fermented Pepper Paste | *Klebsiella aerogenes* |
| SBP00183 | Fermented Pepper Paste | *Klebsiella michiganensis* |
| SBP00183 | Fermented Pepper Paste | *Klebsiella oxytoca* |
| SBP00183 | Fermented Pepper Paste | *Klebsiella pneumoniae* |
| SBP00183 | Fermented Pepper Paste | *Klebsiella quasipneumoniae* |
| SBP00183 | Fermented Pepper Paste | *Klebsiella* sp. FDAARGOS_511 |
| SBP00183 | Fermented Pepper Paste | *Klebsiella* sp. M5al |
| SBP00183 | Fermented Pepper Paste | *Klebsiella* sp. WCHKl090001 |
| SBP00183 | Fermented Pepper Paste | *Klebsiella variicola* |
| SBP00183 | Fermented Pepper Paste | *Kluyvera intermedia* |
| SBP00183 | Fermented Pepper Paste | *Kocuria rosea* |
| SBP00183 | Fermented Pepper Paste | *Lactobacillus alimentarius* |
| SBP00183 | Fermented Pepper Paste | *Lactobacillus backii* |
| SBP00183 | Fermented Pepper Paste | *Lactobacillus brevis* |
| SBP00183 | Fermented Pepper Paste | *Lactobacillus casei* |
| SBP00183 | Fermented Pepper Paste | *Lactobacillus coryniformis* |
| SBP00183 | Fermented Pepper Paste | *Lactobacillus crustorum* |
| SBP00183 | Fermented Pepper Paste | *Lactobacillus curvatus* |
| SBP00183 | Fermented Pepper Paste | *Lactobacillus delbrueckii* |
| SBP00183 | Fermented Pepper Paste | *Lactobacillus fermentum* |
| SBP00183 | Fermented Pepper Paste | *Lactobacillus gallinarum* |
| SBP00183 | Fermented Pepper Paste | *Lactobacillus helveticus* |
| SBP00183 | Fermented Pepper Paste | *Lactobacillus kefiranofaciens* |
| SBP00183 | Fermented Pepper Paste | *Lactobacillus paracasei* |
| SBP00183 | Fermented Pepper Paste | *Lactobacillus paraplantarum* |
| SBP00183 | Fermented Pepper Paste | *Lactobacillus pentosus* |
| SBP00183 | Fermented Pepper Paste | *Lactobacillus phage* A2 |
| SBP00183 | Fermented Pepper Paste | *Lactobacillus phage* iLp1308 |
| SBP00183 | Fermented Pepper Paste | *Lactobacillus phage* J-1 |
| SBP00183 | Fermented Pepper Paste | *Lactobacillus plantarum* |
| SBP00183 | Fermented Pepper Paste | *Lactobacillus rhamnosus* |
| SBP00183 | Fermented Pepper Paste | *Lactobacillus sakei* |
| SBP00183 | Fermented Pepper Paste | *Lactobacillus sanfranciscensis* |
| SBP00183 | Fermented Pepper Paste | *Lactobacillus zymae* |
| SBP00183 | Fermented Pepper Paste | *Lactococcus lactis* |
| SBP00183 | Fermented Pepper Paste | *Laribacter hongkongensis* |
| SBP00183 | Fermented Pepper Paste | *Leclercia adecarboxylata* |

TABLE 3-continued

List of species identified in each metagenomic sample of each SBP Sample

| SBP ID | SBP Host Common Name | Genus sp. |
|---|---|---|
| SBP00183 | Fermented Pepper Paste | *Leifsonia* sp. 21MFCrub1.1 |
| SBP00183 | Fermented Pepper Paste | *Leifsonia xyli* |
| SBP00183 | Fermented Pepper Paste | *Lelliottia amnigena* |
| SBP00183 | Fermented Pepper Paste | *Lelliottia nimipressuralis* |
| SBP00183 | Fermented Pepper Paste | *Leptothrix cholodnii* |
| SBP00183 | Fermented Pepper Paste | *Leuconostoc carnosum* |
| SBP00183 | Fermented Pepper Paste | *Leuconostoc citreum* |
| SBP00183 | Fermented Pepper Paste | *Leuconostoc garlicum* |
| SBP00183 | Fermented Pepper Paste | *Leuconostoc gelidum* |
| SBP00183 | Fermented Pepper Paste | *Leuconostoc kimchii* |
| SBP00183 | Fermented Pepper Paste | *Leuconostoc lactis* |
| SBP00183 | Fermented Pepper Paste | *Leuconostoc mesenteroides* |
| SBP00183 | Fermented Pepper Paste | *Limnohabitans* sp. 63ED37-2 |
| SBP00183 | Fermented Pepper Paste | *Listeria monocytogenes* |
| SBP00183 | Fermented Pepper Paste | *Lysinimonas* sp. 2DFWR-13 |
| SBP00183 | Fermented Pepper Paste | *Lysobacter enzymogenes* |
| SBP00183 | Fermented Pepper Paste | *Martelella mediterranea* |
| SBP00183 | Fermented Pepper Paste | *Massilia armeniaca* |
| SBP00183 | Fermented Pepper Paste | *Massilia oculi* |
| SBP00183 | Fermented Pepper Paste | *Massilia putida* |
| SBP00183 | Fermented Pepper Paste | *Massilia* sp. NR 4-1 |
| SBP00183 | Fermented Pepper Paste | *Massilia* sp. YMA4 |
| SBP00183 | Fermented Pepper Paste | *Melaminivora* sp. SC2-7 |
| SBP00183 | Fermented Pepper Paste | *Mesorhizobium amorphae* |
| SBP00183 | Fermented Pepper Paste | *Mesorhizobium opportunistum* |
| SBP00183 | Fermented Pepper Paste | *Mesorhizobium* sp. DCY119 |
| SBP00183 | Fermented Pepper Paste | *Mesorhizobium* sp. M1B.F.Ca.ET.045.04.1.1 |
| SBP00183 | Fermented Pepper Paste | *Mesorhizobium* sp. M4B.F.Ca.ET.058.02.1.1 |
| SBP00183 | Fermented Pepper Paste | *Methylibium petroleiphilum* |
| SBP00183 | Fermented Pepper Paste | *Methylobacterium aquaticum* |
| SBP00183 | Fermented Pepper Paste | *Methylobacterium brachiatum* |
| SBP00183 | Fermented Pepper Paste | *Methylobacterium currus* |
| SBP00183 | Fermented Pepper Paste | *Methylobacterium nodulans* |
| SBP00183 | Fermented Pepper Paste | *Methylobacterium radiotolerans* |
| SBP00183 | Fermented Pepper Paste | *Methylobacterium* sp. 17SD2-17 |
| SBP00183 | Fermented Pepper Paste | *Methylobacterium* sp. 17Sr1-28 |
| SBP00183 | Fermented Pepper Paste | *Methylobacterium* sp. 17Sr1-43 |
| SBP00183 | Fermented Pepper Paste | *Methylobacterium* sp. 4-46 |
| SBP00183 | Fermented Pepper Paste | *Methylobacterium* sp. AMS5 |
| SBP00183 | Fermented Pepper Paste | *Methylobacterium* sp. C1 |
| SBP00183 | Fermented Pepper Paste | *Methylobacterium* sp. DM1 |
| SBP00183 | Fermented Pepper Paste | *Methylobacterium* sp. XILW |
| SBP00183 | Fermented Pepper Paste | *Methylorubrum extorquens* |
| SBP00183 | Fermented Pepper Paste | *Methylorubrum populi* |
| SBP00183 | Fermented Pepper Paste | *Microbacterium foliorum* |
| SBP00183 | Fermented Pepper Paste | *Microbacterium hominis* |
| SBP00183 | Fermented Pepper Paste | *Microbacterium lemovicicum* |
| SBP00183 | Fermented Pepper Paste | *Microbacterium oxydans* |
| SBP00183 | Fermented Pepper Paste | *Microbacterium pygmaeum* |
| SBP00183 | Fermented Pepper Paste | *Microbacterium sediminis* |
| SBP00183 | Fermented Pepper Paste | *Microbacterium* sp. 1.5R |
| SBP00183 | Fermented Pepper Paste | *Microbacterium* sp. 10M-3C3 |
| SBP00183 | Fermented Pepper Paste | *Microbacterium* sp. BH-3-3-3 |
| SBP00183 | Fermented Pepper Paste | *Microbacterium* sp. No. 7 |
| SBP00183 | Fermented Pepper Paste | *Microbacterium* sp. Y-01 |
| SBP00183 | Fermented Pepper Paste | *Micrococcus luteus* |
| SBP00183 | Fermented Pepper Paste | *Microterricola viridaril* |
| SBP00183 | Fermented Pepper Paste | *Microvirga ossetica* |
| SBP00183 | Fermented Pepper Paste | *Microvirga* sp. 17 mud 1-3 |
| SBP00183 | Fermented Pepper Paste | *Mitsuaria* sp. 7 |
| SBP00183 | Fermented Pepper Paste | *Mixta calida* |
| SBP00183 | Fermented Pepper Paste | *Morganella morganii* |
| SBP00183 | Fermented Pepper Paste | *Mycetocola* sp. 449 |
| SBP00183 | Fermented Pepper Paste | *Mycobacterium* sp. DL90 |
| SBP00183 | Fermented Pepper Paste | *Neorhizobium galegae* |
| SBP00183 | Fermented Pepper Paste | *Neorhizobium* sp. NCHU2750 |
| SBP00183 | Fermented Pepper Paste | *Neorhizobium* sp. SOG26 |
| SBP00183 | Fermented Pepper Paste | *Nitrobacter hamburgensis* |
| SBP00183 | Fermented Pepper Paste | *Nitrobacter winogradskyi* |
| SBP00183 | Fermented Pepper Paste | *Nitrospirillum amazonense* |
| SBP00183 | Fermented Pepper Paste | *Nocardioides humi* |
| SBP00183 | Fermented Pepper Paste | *Nocardiopsis dassonvillei* |
| SBP00183 | Fermented Pepper Paste | *Novosphingobium resinovorum* |
| SBP00183 | Fermented Pepper Paste | *Obesumbacterium proteus* |
| SBP00183 | Fermented Pepper Paste | *Ochrobactrum anthropi* |
| SBP00183 | Fermented Pepper Paste | *Paenarthrobacter aurescens* |

TABLE 3-continued

List of species identified in each metagenomic sample of each SBP Sample

| SBP ID | SBP Host Common Name | Genus sp. |
|---|---|---|
| SBP00183 | Fermented Pepper Paste | *Paenibacillus durus* |
| SBP00183 | Fermented Pepper Paste | *Pandoraea oxalativorans* |
| SBP00183 | Fermented Pepper Paste | *Pandoraea pnomenusa* |
| SBP00183 | Fermented Pepper Paste | *Pannonibacter phragmitetus* |
| SBP00183 | Fermented Pepper Paste | *Pantoea agglomerans* |
| SBP00183 | Fermented Pepper Paste | *Pantoea vagans* |
| SBP00183 | Fermented Pepper Paste | *Paraburkholderia caribensis* |
| SBP00183 | Fermented Pepper Paste | *Paraburkholderia fungorum* |
| SBP00183 | Fermented Pepper Paste | *Paraburkholderia phymatum* |
| SBP00183 | Fermented Pepper Paste | *Paraburkholderia terricola* |
| SBP00183 | Fermented Pepper Paste | *Paracoccus* sp. Arc7-R13 |
| SBP00183 | Fermented Pepper Paste | *Pasteurella multocida* |
| SBP00183 | Fermented Pepper Paste | *Paucibacter* sp. KCTC 42545 |
| SBP00183 | Fermented Pepper Paste | *Pectobacterium atrosepticum* |
| SBP00183 | Fermented Pepper Paste | *Pectobacterium carotovorum* |
| SBP00183 | Fermented Pepper Paste | *Pectobacterium parmentieri* |
| SBP00183 | Fermented Pepper Paste | *Pediococcus acidilactici* |
| SBP00183 | Fermented Pepper Paste | *Pediococcus inopinatus* |
| SBP00183 | Fermented Pepper Paste | *Pediococcus pentosaceus* |
| SBP00183 | Fermented Pepper Paste | *Photobacterium damselae* |
| SBP00183 | Fermented Pepper Paste | *Phyllobacterium zundukense* |
| SBP00183 | Fermented Pepper Paste | *Phytobacter* sp. SCO41 |
| SBP00183 | Fermented Pepper Paste | *Plantibacter flavus* |
| SBP00183 | Fermented Pepper Paste | *Plantibacter* sp. |
| SBP00183 | Fermented Pepper Paste | *Plantibacter* sp. PA-3-X8 |
| SBP00183 | Fermented Pepper Paste | *Plautia stali* |
| SBP00183 | Fermented Pepper Paste | *Polaromonas naphthalenivorans* |
| SBP00183 | Fermented Pepper Paste | *Polaromonas* sp. JS666 |
| SBP00183 | Fermented Pepper Paste | *Polaromonas* sp. SP1 |
| SBP00183 | Fermented Pepper Paste | *Polymorphum gilvum* |
| SBP00183 | Fermented Pepper Paste | *Proteus mirabilis* |
| SBP00183 | Fermented Pepper Paste | *Proteus* sp. 3M |
| SBP00183 | Fermented Pepper Paste | *Providencia alcalifaciens* |
| SBP00183 | Fermented Pepper Paste | *Providencia heimbachae* |
| SBP00183 | Fermented Pepper Paste | *Providencia rettgeri* |
| SBP00183 | Fermented Pepper Paste | *Providencia rustigianii* |
| SBP00183 | Fermented Pepper Paste | *Providencia sneebia* |
| SBP00183 | Fermented Pepper Paste | *Providencia* sp. WCHPr000369 |
| SBP00183 | Fermented Pepper Paste | *Providencia stuartii* |
| SBP00183 | Fermented Pepper Paste | *Pseudarthrobacter equi* |
| SBP00183 | Fermented Pepper Paste | *Pseudarthrobacter phenanthrenivorans* |
| SBP00183 | Fermented Pepper Paste | *Pseudarthrobacter sulfonivorans* |
| SBP00183 | Fermented Pepper Paste | *Pseudolabrys taiwanensis* |
| SBP00183 | Fermented Pepper Paste | *Pseudomonas aeruginosa* |
| SBP00183 | Fermented Pepper Paste | *Pseudomonas agarici* |
| SBP00183 | Fermented Pepper Paste | *Pseudomonas alkylphenolica* |
| SBP00183 | Fermented Pepper Paste | *Pseudomonas arsenicoxydans* |
| SBP00183 | Fermented Pepper Paste | *Pseudomonas azotoformans* |
| SBP00183 | Fermented Pepper Paste | *Pseudomonas balearica* |
| SBP00183 | Fermented Pepper Paste | *Pseudomonas brassicacearum* |
| SBP00183 | Fermented Pepper Paste | *Pseudomonas brenneri* |
| SBP00183 | Fermented Pepper Paste | *Pseudomonas chlororaphis* |
| SBP00183 | Fermented Pepper Paste | *Pseudomonas cichorii* |
| SBP00183 | Fermented Pepper Paste | *Pseudomonas citronellolis* |
| SBP00183 | Fermented Pepper Paste | *Pseudomonas corrugata* |
| SBP00183 | Fermented Pepper Paste | *Pseudomonas cremoricolorata* |
| SBP00183 | Fermented Pepper Paste | *Pseudomonas entomophila* |
| SBP00183 | Fermented Pepper Paste | *Pseudomonas extremaustralis* |
| SBP00183 | Fermented Pepper Paste | *Pseudomonas extremorientalis* |
| SBP00183 | Fermented Pepper Paste | *Pseudomonas fluorescens* |
| SBP00183 | Fermented Pepper Paste | *Pseudomonas frederiksbergensis* |
| SBP00183 | Fermented Pepper Paste | *Pseudomonas granadensis* |
| SBP00183 | Fermented Pepper Paste | *Pseudomonas koreensis* |
| SBP00183 | Fermented Pepper Paste | *Pseudomonas kribbensis* |
| SBP00183 | Fermented Pepper Paste | *Pseudomonas libanensis* |
| SBP00183 | Fermented Pepper Paste | *Pseudomonas lini* |
| SBP00183 | Fermented Pepper Paste | *Pseudomonas mandelii* |
| SBP00183 | Fermented Pepper Paste | *Pseudomonas mediterranea* |
| SBP00183 | Fermented Pepper Paste | *Pseudomonas mendocina* |
| SBP00183 | Fermented Pepper Paste | *Pseudomonas monteilii* |
| SBP00183 | Fermented Pepper Paste | *Pseudomonas moraviensis* |
| SBP00183 | Fermented Pepper Paste | *Pseudomonas mosselii* |
| SBP00183 | Fermented Pepper Paste | *Pseudomonas mucidolens* |
| SBP00183 | Fermented Pepper Paste | *Pseudomonas orientalis* |
| SBP00183 | Fermented Pepper Paste | *Pseudomonas oryzae* |
| SBP00183 | Fermented Pepper Paste | *Pseudomonas poae* |

TABLE 3-continued

List of species identified in each metagenomic sample of each SBP Sample

| SBP ID | SBP Host Common Name | Genus sp. |
| --- | --- | --- |
| SBP00183 | Fermented Pepper Paste | *Pseudomonas prosekii* |
| SBP00183 | Fermented Pepper Paste | *Pseudomonas protegens* |
| SBP00183 | Fermented Pepper Paste | *Pseudomonas putida* |
| SBP00183 | Fermented Pepper Paste | *Pseudomonas reinekei* |
| SBP00183 | Fermented Pepper Paste | *Pseudomonas resinovorans* |
| SBP00183 | Fermented Pepper Paste | *Pseudomonas rhizosphaerae* |
| SBP00183 | Fermented Pepper Paste | *Pseudomonas saudiphocaensis* |
| SBP00183 | Fermented Pepper Paste | *Pseudomonas silesiensis* |
| SBP00183 | Fermented Pepper Paste | *Pseudomonas sp.* |
| SBP00183 | Fermented Pepper Paste | *Pseudomonas sp.* 09C 129 |
| SBP00183 | Fermented Pepper Paste | *Pseudomonas sp.* 31-12 |
| SBP00183 | Fermented Pepper Paste | *Pseudomonas sp.* 7SR1 |
| SBP00183 | Fermented Pepper Paste | *Pseudomonas sp.* A214 |
| SBP00183 | Fermented Pepper Paste | *Pseudomonas sp.* CC6-YY-74 |
| SBP00183 | Fermented Pepper Paste | *Pseudomonas sp.* CCOS 191 |
| SBP00183 | Fermented Pepper Paste | *Pseudomonas sp.* CMR12a |
| SBP00183 | Fermented Pepper Paste | *Pseudomonas sp.* CMR5c |
| SBP00183 | Fermented Pepper Paste | *Pseudomonas sp.* DR 5-09 |
| SBP00183 | Fermented Pepper Paste | *Pseudomonas sp.* GR 6-02 |
| SBP00183 | Fermented Pepper Paste | *Pseudomonas sp.* HLS-6 |
| SBP00183 | Fermented Pepper Paste | *Pseudomonas sp.* K2W31S-8 |
| SBP00183 | Fermented Pepper Paste | *Pseudomonas sp.* LAB-08 |
| SBP00183 | Fermented Pepper Paste | *Pseudomonas sp.* LBUM920 |
| SBP00183 | Fermented Pepper Paste | *Pseudomonas sp.* Leaf58 |
| SBP00183 | Fermented Pepper Paste | *Pseudomonas sp.* LG1E9 |
| SBP00183 | Fermented Pepper Paste | *Pseudomonas sp.* MYb193 |
| SBP00183 | Fermented Pepper Paste | *Pseudomonas sp.* NS1(2017) |
| SBP00183 | Fermented Pepper Paste | *Pseudomonas sp.* RU47 |
| SBP00183 | Fermented Pepper Paste | *Pseudomonas sp.* S09G 359 |
| SBP00183 | Fermented Pepper Paste | *Pseudomonas sp.* StFLB209 |
| SBP00183 | Fermented Pepper Paste | *Pseudomonas sp.* SWI36 |
| SBP00183 | Fermented Pepper Paste | *Pseudomonas sp.* SXM-1 |
| SBP00183 | Fermented Pepper Paste | *Pseudomonas sp.* TCU-HL1 |
| SBP00183 | Fermented Pepper Paste | *Pseudomonas sp.* URMO17WK12:I11 |
| SBP00183 | Fermented Pepper Paste | *Pseudomonas sp.* UW4 |
| SBP00183 | Fermented Pepper Paste | *Pseudomonas sp.* 2003-0.4C(8344-21) |
| SBP00183 | Fermented Pepper Paste | *Pseudomonas stutzeri* |
| SBP00183 | Fermented Pepper Paste | *Pseudomonas synxantha* |
| SBP00183 | Fermented Pepper Paste | *Pseudomonas syringae* |
| SBP00183 | Fermented Pepper Paste | *Pseudomonas taetrolens* |
| SBP00183 | Fermented Pepper Paste | *Pseudomonas thivervalensis* |
| SBP00183 | Fermented Pepper Paste | *Pseudomonas tolaasii* |
| SBP00183 | Fermented Pepper Paste | *Pseudomonas trivialis* |
| SBP00183 | Fermented Pepper Paste | *Pseudomonas umsongensis* |
| SBP00183 | Fermented Pepper Paste | *Pseudomonas vancouverensis* |
| SBP00183 | Fermented Pepper Paste | *Pseudomonas veronii* |
| SBP00183 | Fermented Pepper Paste | *Pseudomonas versuta* |
| SBP00183 | Fermented Pepper Paste | *Pseudomonas viridiflava* |
| SBP00183 | Fermented Pepper Paste | *Pseudomonas yamanorum* |
| SBP00183 | Fermented Pepper Paste | *Rahnella aquatilis* |
| SBP00183 | Fermented Pepper Paste | *Rahnella sp.* ERMR1:05 |
| SBP00183 | Fermented Pepper Paste | *Rahnella sp.* Y9602 |
| SBP00183 | Fermented Pepper Paste | *Ralstonia insidiosa* |
| SBP00183 | Fermented Pepper Paste | *Ralstonia mannitolilytica* |
| SBP00183 | Fermented Pepper Paste | *Raistonia pickettii* |
| SBP00183 | Fermented Pepper Paste | *Ralstonia solanacearum* |
| SBP00183 | Fermented Pepper Paste | *Ramlibacter tataouinensis* |
| SBP00183 | Fermented Pepper Paste | *Raoultella ornithinolytica* |
| SBP00183 | Fermented Pepper Paste | *Raoultella planticola* |
| SBP00183 | Fermented Pepper Paste | *Rathayibacter festucae* |
| SBP00183 | Fermented Pepper Paste | *Rathayibacter tritici* |
| SBP00183 | Fermented Pepper Paste | *Rhizobacter gummiphilus* |
| SBP00183 | Fermented Pepper Paste | *Rhizobium etli* |
| SBP00183 | Fermented Pepper Paste | *Rhizobium favelukesii* |
| SBP00183 | Fermented Pepper Paste | *Rhizobium jaguaris* |
| SBP00183 | Fermented Pepper Paste | *Rhizobium leguminosarum* |
| SBP00183 | Fermented Pepper Paste | *Rhizobium sp.* 11515TR |
| SBP00183 | Fermented Pepper Paste | *Rhizobium sp.* ACO-34A |
| SBP00183 | Fermented Pepper Paste | *Rhizobium sp.* NT-26 |
| SBP00183 | Fermented Pepper Paste | *Rhizobium sp.* NXC14 |
| SBP00183 | Fermented Pepper Paste | *Rhizobium sp.* NXC24 |
| SBP00183 | Fermented Pepper Paste | *Rhodococcus coprophilus* |
| SBP00183 | Fermented Pepper Paste | *Rhodococcus fascians* |
| SBP00183 | Fermented Pepper Paste | *Rhodococcus ruber* |
| SBP00183 | Fermented Pepper Paste | *Rhodococcus sp.* PBTS 2 |
| SBP00183 | Fermented Pepper Paste | *Rhodoferax koreense* |

TABLE 3-continued

List of species identified in each metagenomic sample of each SBP Sample

| SBP ID | SBP Host Common Name | Genus sp. |
|---|---|---|
| SBP00183 | Fermented Pepper Paste | Rhodopseudomonas palustris |
| SBP00183 | Fermented Pepper Paste | Rhodovulum sp. P5 |
| SBP00183 | Fermented Pepper Paste | Roseateles depolymerans |
| SBP00183 | Fermented Pepper Paste | Rubrivivax gelatinosus |
| SBP00183 | Fermented Pepper Paste | Saccharothrix espanaensis |
| SBP00183 | Fermented Pepper Paste | Salinigranum rubrum |
| SBP00183 | Fermented Pepper Paste | Salinivibrio kushneri |
| SBP00183 | Fermented Pepper Paste | Salmonella enterica |
| SBP00183 | Fermented Pepper Paste | Salmonella phage SSU5 |
| SBP00183 | Fermented Pepper Paste | Sanguibacter keddieii |
| SBP00183 | Fermented Pepper Paste | Serpentinomonas raichei |
| SBP00183 | Fermented Pepper Paste | Serratia liquefaciens |
| SBP00183 | Fermented Pepper Paste | Serratia marcescens |
| SBP00183 | Fermented Pepper Paste | Serratia plymuthica |
| SBP00183 | Fermented Pepper Paste | Serratia sp. |
| SBP00183 | Fermented Pepper Paste | Serratia sp. ATCC 39006 |
| SBP00183 | Fermented Pepper Paste | Shewanella putrefaciens |
| SBP00183 | Fermented Pepper Paste | Shewanella sp. ANA-3 |
| SBP00183 | Fermented Pepper Paste | Shinella sp. HZN7 |
| SBP00183 | Fermented Pepper Paste | Sinomonas atrocyanea |
| SBP00183 | Fermented Pepper Paste | Sinorhizobium fredii |
| SBP00183 | Fermented Pepper Paste | Sinorhizobium medicae |
| SBP00183 | Fermented Pepper Paste | Sinorhizobium meliloti |
| SBP00183 | Fermented Pepper Paste | Sinorhizobium sp. RAC02 |
| SBP00183 | Fermented Pepper Paste | Sodalis praecaptivus |
| SBP00183 | Fermented Pepper Paste | Sorangium cellulosum |
| SBP00183 | Fermented Pepper Paste | Sphingobium baderi |
| SBP00183 | Fermented Pepper Paste | Sphingobium sp. RAC03 |
| SBP00183 | Fermented Pepper Paste | Sphingobium sp. SCG-1 |
| SBP00183 | Fermented Pepper Paste | Sphingobium yanoikuyae |
| SBP00183 | Fermented Pepper Paste | Sphingomonas panacis |
| SBP00183 | Fermented Pepper Paste | Sphingomonas sp. AAP5 |
| SBP00183 | Fermented Pepper Paste | Sphingomonas sp. FARSPH |
| SBP00183 | Fermented Pepper Paste | Sphingomonas sp. KC8 |
| SBP00183 | Fermented Pepper Paste | Sphingomonas sp. LM7 |
| SBP00183 | Fermented Pepper Paste | Sphingomonas taxi |
| SBP00183 | Fermented Pepper Paste | Sphingomonas wittichii |
| SBP00183 | Fermented Pepper Paste | Sphingopyxis sp. 113P3 |
| SBP00183 | Fermented Pepper Paste | Staphylococcus aureus |
| SBP00183 | Fermented Pepper Paste | Staphylococcus haemolyticus |
| SBP00183 | Fermented Pepper Paste | Staphylococcus xylosus |
| SBP00183 | Fermented Pepper Paste | Starkeya novella |
| SBP00183 | Fermented Pepper Paste | Stenotrophomonas acidaminiphila |
| SBP00183 | Fermented Pepper Paste | Stenotrophomonas maltophilia |
| SBP00183 | Fermented Pepper Paste | Stenotrophomonas rhizophila |
| SBP00183 | Fermented Pepper Paste | Stenotrophomonas sp. ZAC14A_NAIMI4_1 |
| SBP00183 | Fermented Pepper Paste | Stenotrophomonas sp. ZAC14D2_NAIMI4_6 |
| SBP00183 | Fermented Pepper Paste | Streptomyces lydicus |
| SBP00183 | Fermented Pepper Paste | Streptomyces niveus |
| SBP00183 | Fermented Pepper Paste | Synechococcus sp. NIES-970 |
| SBP00183 | Fermented Pepper Paste | Thauera sp. K11 |
| SBP00183 | Fermented Pepper Paste | Tobacco vein clearing virus |
| SBP00183 | Fermented Pepper Paste | Variovorax boronicumulans |
| SBP00183 | Fermented Pepper Paste | Variovorax paradoxus |
| SBP00183 | Fermented Pepper Paste | Variovorax sp. HW608 |
| SBP00183 | Fermented Pepper Paste | Variovorax sp. PAMC 28711 |
| SBP00183 | Fermented Pepper Paste | Variovorax sp. PMC12 |
| SBP00183 | Fermented Pepper Paste | Verminephrobacter eiseniae |
| SBP00183 | Fermented Pepper Paste | Vibrio anguillarum |
| SBP00183 | Fermented Pepper Paste | Vibrio nigripulchritudo |
| SBP00183 | Fermented Pepper Paste | Vibrio parahaemolyticus |
| SBP00183 | Fermented Pepper Paste | Weissella cibaria |
| SBP00183 | Fermented Pepper Paste | Weissella hellenica |
| SBP00183 | Fermented Pepper Paste | Weissella jogaejeotgali |
| SBP00183 | Fermented Pepper Paste | Weissella koreensis |
| SBP00183 | Fermented Pepper Paste | Weissella soli |
| SBP00183 | Fermented Pepper Paste | Weissella viridescens |
| SBP00183 | Fermented Pepper Paste | Woeseia oceani |
| SBP00183 | Fermented Pepper Paste | Xanthobacter autotrophicus |
| SBP00183 | Fermented Pepper Paste | Xanthomonas oryzae |
| SBP00183 | Fermented Pepper Paste | Xenorhabdus poinarii |
| SBP00183 | Fermented Pepper Paste | Yersinia enterocolitica |
| SBP00183 | Fermented Pepper Paste | Yersinia pseudotuberculosis |
| SBP00183 | Fermented Pepper Paste | Yersinia ruckeri |
| SBP00183 (SBE00925) | Fermented Pepper Paste | Alcanivorax sp. N3-2A |
| SBP00183 (SBE00925) | Fermented Pepper Paste | Bacillus cereus |

TABLE 3-continued

List of species identified in each metagenomic sample of each SBP Sample

| SBP ID | SBP Host Common Name | Genus sp. |
| --- | --- | --- |
| SBP00183 (SBE00925) | Fermented Pepper Paste | *Bacillus coagulans* |
| SBP00183 (SBE00925) | Fermented Pepper Paste | *Bacillus* sp. FJAT-22090 |
| SBP00183 (SBE00925) | Fermented Pepper Paste | *Clostridium saccharoperbutylacetonicum* |
| SBP00183 (SBE00925) | Fermented Pepper Paste | *Halomonas* sp. JS92-SW72 |
| SBP00183 (SBE00925) | Fermented Pepper Paste | *Hydrogenophaga* sp. NH-16 |
| SBP00183 (SBE00925) | Fermented Pepper Paste | *Janthinobacterium agaricidamnosum* |
| SBP00183 (SBE00925) | Fermented Pepper Paste | *Janthinobacterium* sp. 1_2014MBL_MicDiv |
| SBP00183 (SBE00925) | Fermented Pepper Paste | *Janthinobacterium* sp. LM6 |
| SBP00183 (SBE00925) | Fermented Pepper Paste | *Janthinobacterium svalbardensis* |
| SBP00183 (SBE00925) | Fermented Pepper Paste | *Lactobacillus acidipiscis* |
| SBP00183 (SBE00925) | Fermented Pepper Paste | *Lactobacillus allii* |
| SBP00183 (SBE00925) | Fermented Pepper Paste | *Lactobacillus amylophilus* |
| SBP00183 (SBE00925) | Fermented Pepper Paste | *Lactobacillus backii* |
| SBP00183 (SBE00925) | Fermented Pepper Paste | *Lactobacillus bombi* |
| SBP00183 (SBE00925) | Fermented Pepper Paste | *Lactobacillus brevis* |
| SBP00183 (SBE00925) | Fermented Pepper Paste | *Lactobacillus buchneri* |
| SBP00183 (SBE00925) | Fermented Pepper Paste | *Lactobacillus casei* |
| SBP00183 (SBE00925) | Fermented Pepper Paste | *Lactobacillus coryniformis* |
| SBP00183 (SBE00925) | Fermented Pepper Paste | *Lactobacillus crustorum* |
| SBP00183 (SBE00925) | Fermented Pepper Paste | *Lactobacillus curvatus* |
| SBP00183 (SBE00925) | Fermented Pepper Paste | *Lactobacillus delbrueckii* |
| SBP00183 (SBE00925) | Fermented Pepper Paste | *Lactobacillus fermentum* |
| SBP00183 (SBE00925) | Fermented Pepper Paste | *Lactobacillus gallinarum* |
| SBP00183 (SBE00925) | Fermented Pepper Paste | *Lactobacillus helveticus* |
| SBP00183 (SBE00925) | Fermented Pepper Paste | *Lactobacillus hokkaidonensis* |
| SBP00183 (SBE00925) | Fermented Pepper Paste | *Lactobacillus kefiranofaciens* |
| SBP00183 (SBE00925) | Fermented Pepper Paste | *Lactobacillus oligofermentans* |
| SBP00183 (SBE00925) | Fermented Pepper Paste | *Lactobacillus parabuchneri* |
| SBP00183 (SBE00925) | Fermented Pepper Paste | *Lactobacillus paracasei* |
| SBP00183 (SBE00925) | Fermented Pepper Paste | *Lactobacillus paracollinoides* |
| SBP00183 (SBE00925) | Fermented Pepper Paste | *Lactobacillus paraplantarum* |
| SBP00183 (SBE00925) | Fermented Pepper Paste | *Lactobacillus pentosus* |
| SBP00183 (SBE00925) | Fermented Pepper Paste | *Lactobacillus phage* A2 |
| SBP00183 (SBE00925) | Fermented Pepper Paste | *Lactobacillus phage* iLp1308 |
| SBP00183 (SBE00925) | Fermented Pepper Paste | *Lactobacillus phage* iLp84 |
| SBP00183 (SBE00925) | Fermented Pepper Paste | *Lactobacillus phage* J-1 |
| SBP00183 (SBE00925) | Fermented Pepper Paste | *Lactobacillus phage* Lrm1 |
| SBP00183 (SBE00925) | Fermented Pepper Paste | *Lactobacillus phage* phig1e |
| SBP00183 (SBE00925) | Fermented Pepper Paste | *Lactobacillus plantarum* |
| SBP00183 (SBE00925) | Fermented Pepper Paste | *Lactobacillus rhamnosus* |
| SBP00183 (SBE00925) | Fermented Pepper Paste | *Lactobacillus sakei* |
| SBP00183 (SBE00925) | Fermented Pepper Paste | *Lactobacillus salivarius* |
| SBP00183 (SBE00925) | Fermented Pepper Paste | *Lactobacillus sanfranciscensis* |
| SBP00183 (SBE00925) | Fermented Pepper Paste | *Lactobacillus* sp. CBA3605 |
| SBP00183 (SBE00925) | Fermented Pepper Paste | *Lactobacillus* sp. CBA3606 |
| SBP00183 (SBE00925) | Fermented Pepper Paste | *Lactobacillus* sp. D1501 |
| SBP00183 (SBE00925) | Fermented Pepper Paste | *Lactobacillus zymae* |
| SBP00183 (SBE00925) | Fermented Pepper Paste | *Lactococcus lactis* |
| SBP00183 (SBE00925) | Fermented Pepper Paste | *Leuconostoc citreum* |
| SBP00183 (SBE00925) | Fermented Pepper Paste | *Leuconostoc lactis* |
| SBP00183 (SBE00925) | Fermented Pepper Paste | *Marivirga tractuosa* |
| SBP00183 (SBE00925) | Fermented Pepper Paste | *Melissococcus plutonius* |
| SBP00183 (SBE00925) | Fermented Pepper Paste | *Moraxella osloensis* |
| SBP00183 (SBE00925) | Fermented Pepper Paste | *Oenococcus kitaharae* |
| SBP00183 (SBE00925) | Fermented Pepper Paste | *Pantoea agglomerans* |
| SBP00183 (SBE00925) | Fermented Pepper Paste | *Pantoea rwandensis* |
| SBP00183 (SBE00925) | Fermented Pepper Paste | *Pantoea vagans* |
| SBP00183 (SBE00925) | Fermented Pepper Paste | *Pediococcus acidilactici* |
| SBP00183 (SBE00925) | Fermented Pepper Paste | *Pediococcus claussenii* |
| SBP00183 (SBE00925) | Fermented Pepper Paste | *Pediococcus damnosus* |
| SBP00183 (SBE00925) | Fermented Pepper Paste | *Pediococcus inopinatus* |
| SBP00183 (SBE00925) | Fermented Pepper Paste | *Pediococcus pentosaceus* |
| SBP00183 (SBE00925) | Fermented Pepper Paste | *Providencia* sp. WCHPr000369 |
| SBP00183 (SBE00925) | Fermented Pepper Paste | *Pseudomonas chlororaphis* |
| SBP00183 (SBE00925) | Fermented Pepper Paste | *Pseudomonas fluorescens* |
| SBP00183 (SBE00925) | Fermented Pepper Paste | *Pseudomonas frederiksbergensis* |
| SBP00183 (SBE00925) | Fermented Pepper Paste | *Pseudomonas koreensis* |
| SBP00183 (SBE00925) | Fermented Pepper Paste | *Pseudomonas moraviensis* |
| SBP00183 (SBE00925) | Fermented Pepper Paste | *Pseudomonas putida* |
| SBP00183 (SBE00925) | Fermented Pepper Paste | *Pseudomonas* sp. B10 |
| SBP00183 (SBE00925) | Fermented Pepper Paste | *Rahnella aquatilis* |
| SBP00183 (SBE00925) | Fermented Pepper Paste | *Serratia marcescens* |
| SBP00183 (SBE00925) | Fermented Pepper Paste | *Sphingomonas* sp. LK11 |
| SBP00183 (SBE00925) | Fermented Pepper Paste | *Spirosoma pollinicola* |
| SBP00183 (SBE00925) | Fermented Pepper Paste | *Stenotrophomonas maltophilia* |
| SBP00183 (SBE00925) | Fermented Pepper Paste | *Weissella jogaejeotgali* |

TABLE 3-continued

List of species identified in each metagenomic sample of each SBP Sample

| SBP ID | SBP Host Common Name | Genus sp. |
| --- | --- | --- |
| SBP00183 (SBE00933) | Fermented Pepper Paste | Acinetobacter lactucae |
| SBP00183 (SBE00933) | Fermented Pepper Paste | Acinetobacter sp. WCHA55 |
| SBP00183 (SBE00933) | Fermented Pepper Paste | Alcanivorax sp. N3-2A |
| SBP00183 (SBE00933) | Fermented Pepper Paste | Bacillus cereus |
| SBP00183 (SBE00933) | Fermented Pepper Paste | Bacillus subtilis |
| SBP00183 (SBE00933) | Fermented Pepper Paste | Bacillus thuringiensis |
| SBP00183 (SBE00933) | Fermented Pepper Paste | Buchnera aphidicola |
| SBP00183 (SBE00933) | Fermented Pepper Paste | Clostridium botulinum |
| SBP00183 (SBE00933) | Fermented Pepper Paste | Clostridium pasteurianum |
| SBP00183 (SBE00933) | Fermented Pepper Paste | Clostridium saccharoperbutylacetonicum |
| SBP00183 (SBE00933) | Fermented Pepper Paste | Curtobacterium pusillum |
| SBP00183 (SBE00933) | Fermented Pepper Paste | Curtobacterium sp. BH-2-1-1 |
| SBP00183 (SBE00933) | Fermented Pepper Paste | Curtobacterium sp. MR_MD2014 |
| SBP00183 (SBE00933) | Fermented Pepper Paste | Enterobacter cloacae |
| SBP00183 (SBE00933) | Fermented Pepper Paste | Enterobacter hormaechei |
| SBP00183 (SBE00933) | Fermented Pepper Paste | Erwinia billingiae |
| SBP00183 (SBE00933) | Fermented Pepper Paste | Erwinia gerundensis |
| SBP00183 (SBE00933) | Fermented Pepper Paste | Exiguobacterium sp. MH3 |
| SBP00183 (SBE00933) | Fermented Pepper Paste | Faecalibacterium prausnitzii |
| SBP00183 (SBE00933) | Fermented Pepper Paste | Halomonas sp. JS92-SW72 |
| SBP00183 (SBE00933) | Fermented Pepper Paste | Hydrogenophaga sp. NH-16 |
| SBP00183 (SBE00933) | Fermented Pepper Paste | Lactobacillus allii |
| SBP00183 (SBE00933) | Fermented Pepper Paste | Lactobacillus amylophilus |
| SBP00183 (SBE00933) | Fermented Pepper Paste | Lactobacillus backii |
| SBP00183 (SBE00933) | Fermented Pepper Paste | Lactobacillus bombi |
| SBP00183 (SBE00933) | Fermented Pepper Paste | Lactobacillus brevis |
| SBP00183 (SBE00933) | Fermented Pepper Paste | Lactobacillus buchneri |
| SBP00183 (SBE00933) | Fermented Pepper Paste | Lactobacillus casei |
| SBP00183 (SBE00933) | Fermented Pepper Paste | Lactobacillus coryniformis |
| SBP00183 (SBE00933) | Fermented Pepper Paste | Lactobacillus curvatus |
| SBP00183 (SBE00933) | Fermented Pepper Paste | Lactobacillus delbrueckii |
| SBP00183 (SBE00933) | Fermented Pepper Paste | Lactobacillus fermentum |
| SBP00183 (SBE00933) | Fermented Pepper Paste | Lactobacillus gallinarum |
| SBP00183 (SBE00933) | Fermented Pepper Paste | Lactobacillus gasseri |
| SBP00183 (SBE00933) | Fermented Pepper Paste | Lactobacillus helveticus |
| SBP00183 (SBE00933) | Fermented Pepper Paste | Lactobacillus hokkaidonensis |
| SBP00183 (SBE00933) | Fermented Pepper Paste | Lactobacillus kefiranofaciens |
| SBP00183 (SBE00933) | Fermented Pepper Paste | Lactobacillus oligofermentans |
| SBP00183 (SBE00933) | Fermented Pepper Paste | Lactobacillus parabuchneri |
| SBP00183 (SBE00933) | Fermented Pepper Paste | Lactobacillus paracasei |
| SBP00183 (SBE00933) | Fermented Pepper Paste | Lactobacillus paracollinoides |
| SBP00183 (SBE00933) | Fermented Pepper Paste | Lactobacillus paraplantarum |
| SBP00183 (SBE00933) | Fermented Pepper Paste | Lactobacillus pentosus |
| SBP00183 (SBE00933) | Fermented Pepper Paste | Lactobacillus phage phigle |
| SBP00183 (SBE00933) | Fermented Pepper Paste | Lactobacillus plantarum |
| SBP00183 (SBE00933) | Fermented Pepper Paste | Lactobacillus rhamnosus |
| SBP00183 (SBE00933) | Fermented Pepper Paste | Lactobacillus sakei |
| SBP00183 (SBE00933) | Fermented Pepper Paste | Lactobacillus salivarius |
| SBP00183 (SBE00933) | Fermented Pepper Paste | Lactobacillus sanfranciscensis |
| SBP00183 (SBE00933) | Fermented Pepper Paste | Lactobacillus sp. CBA3605 |
| SBP00183 (SBE00933) | Fermented Pepper Paste | Lactobacillus sp. CBA3606 |
| SBP00183 (SBE00933) | Fermented Pepper Paste | Lactobacillus sp. D1501 |
| SBP00183 (SBE00933) | Fermented Pepper Paste | Lactobacillus zymae |
| SBP00183 (SBE00933) | Fermented Pepper Paste | Lactococcus lactis |
| SBP00183 (SBE00933) | Fermented Pepper Paste | Lelliottia amnigena |
| SBP00183 (SBE00933) | Fermented Pepper Paste | Leuconostoc citreum |
| SBP00183 (SBE00933) | Fermented Pepper Paste | Leuconostoc gelidum |
| SBP00183 (SBE00933) | Fermented Pepper Paste | Limnobaculum parvum |
| SBP00183 (SBE00933) | Fermented Pepper Paste | Lysinibacillus sp. YS11 |
| SBP00183 (SBE00933) | Fermented Pepper Paste | Marivirga tractuosa |
| SBP00183 (SBE00933) | Fermented Pepper Paste | Melissococcus plutonius |
| SBP00183 (SBE00933) | Fermented Pepper Paste | Moraxella osloensis |
| SBP00183 (SBE00933) | Fermented Pepper Paste | Oenococcus kitaharae |
| SBP00183 (SBE00933) | Fermented Pepper Paste | Paenarthrobacter aurescens |
| SBP00183 (SBE00933) | Fermented Pepper Paste | Pantoea agglomerans |
| SBP00183 (SBE00933) | Fermented Pepper Paste | Pantoea rwandensis |
| SBP00183 (SBE00933) | Fermented Pepper Paste | Pantoea vagans |
| SBP00183 (SBE00933) | Fermented Pepper Paste | Pediococcus acidilactici |
| SBP00183 (SBE00933) | Fermented Pepper Paste | Pediococcus claussenii |
| SBP00183 (SBE00933) | Fermented Pepper Paste | Pediococcus damnosus |
| SBP00183 (SBE00933) | Fermented Pepper Paste | Pediococcus inopinatus |
| SBP00183 (SBE00933) | Fermented Pepper Paste | Pediococcus pentosaceus |
| SBP00183 (SBE00933) | Fermented Pepper Paste | Providencia rettgeri |
| SBP00183 (SBE00933) | Fermented Pepper Paste | Providencia sp. WCHPr000369 |
| SBP00183 (SBE00933) | Fermented Pepper Paste | Pseudomonas chlororaphis |
| SBP00183 (SBE00933) | Fermented Pepper Paste | Pseudomonas fluorescens |

TABLE 3-continued

List of species identified in each metagenomic sample of each SBP Sample

| SBP ID | SBP Host Common Name | Genus sp. |
|---|---|---|
| SBP00183 (SBE00933) | Fermented Pepper Paste | *Pseudomonas frederiksbergensis* |
| SBP00183 (SBE00933) | Fermented Pepper Paste | *Pseudomonas koreensis* |
| SBP00183 (SBE00933) | Fermented Pepper Paste | *Pseudomonas moraviensis* |
| SBP00183 (SBE00933) | Fermented Pepper Paste | *Pseudomonas protegens* |
| SBP00183 (SBE00933) | Fermented Pepper Paste | *Pseudomonas putida* |
| SBP00183 (SBE00933) | Fermented Pepper Paste | *Pseudomonas* sp. B10 |
| SBP00183 (SBE00933) | Fermented Pepper Paste | *Pseudomonas* sp. RU47 |
| SBP00183 (SBE00933) | Fermented Pepper Paste | *Rahnella aquatilis* |
| SBP00183 (SBE00933) | Fermented Pepper Paste | *Rahnella* sp. ERMR1:05 |
| SBP00183 (SBE00933) | Fermented Pepper Paste | *Rahnella* sp. Y9602 |
| SBP00183 (SBE00933) | Fermented Pepper Paste | *Rickettsiales bacterium* Ac37b |
| SBP00183 (SBE00933) | Fermented Pepper Paste | *Serratia ficaria* |
| SBP00183 (SBE00933) | Fermented Pepper Paste | *Serratia marcescens* |
| SBP00183 (SBE00933) | Fermented Pepper Paste | *Serratia* sp. FS14 |
| SBP00183 (SBE00933) | Fermented Pepper Paste | *Serratia* sp. YD25 |
| SBP00183 (SBE00933) | Fermented Pepper Paste | Skunkpox virus |
| SBP00183 (SBE00933) | Fermented Pepper Paste | *Spirosoma pollinicola* |
| SBP00183 (SBE00933) | Fermented Pepper Paste | *Stenotrophomonas maltophilia* |
| SBP00183 (SBE00933) | Fermented Pepper Paste | *Streptococcus suis* |
| SBP00183 (SBE00933) | Fermented Pepper Paste | *Vibrio casei* |
| SBP00183 (SBE00933) | Fermented Pepper Paste | *Weissella jogaejeotgali* |
| SBP00188 | Asian pear | [*Enterobacter*] *lignolyticus* |
| SBP00188 | Asian pear | [*Enterobacter*] *lignolyticus* |
| SBP00188 | Asian pear | [*Pseudomonas*] *mesoacidophila* |
| SBP00188 | Asian pear | [*Pseudomonas*] *mesoacidophila* |
| SBP00188 | Asian pear | *Acanthocystis turfacea chlorella* virus 1 |
| SBP00188 | Asian pear | *Acanthocystis turfacea chlorella* virus 1 |
| SBP00188 | Asian pear | *Achromobacter denitrificans* |
| SBP00188 | Asian pear | *Achromobacter denitrificans* |
| SBP00188 | Asian pear | *Achromobacter insolitus* |
| SBP00188 | Asian pear | *Achromobacter insolitus* |
| SBP00188 | Asian pear | *Achromobacter* sp. B7 |
| SBP00188 | Asian pear | *Achromobacter* sp. B7 |
| SBP00188 | Asian pear | *Achromobacter* sp. MFA1 R4 |
| SBP00188 | Asian pear | *Achromobacter* sp. MFA1 R4 |
| SBP00188 | Asian pear | *Achromobacter spanius* |
| SBP00188 | Asian pear | *Achromobacter spanius* |
| SBP00188 | Asian pear | *Achromobacter xylosoxidans* |
| SBP00188 | Asian pear | *Achromobacter xylosoxidans* |
| SBP00188 | Asian pear | *Acidovorax* sp. KKS102 |
| SBP00188 | Asian pear | *Acidovorax* sp. KKS102 |
| SBP00188 | Asian pear | *Acinetobacter calcoaceticus* |
| SBP00188 | Asian pear | *Acinetobacter calcoaceticus* |
| SBP00188 | Asian pear | *Acinetobacter* sp. TTH0-4 |
| SBP00188 | Asian pear | *Acinetobacter* sp. TTH0-4 |
| SBP00188 | Asian pear | *Actinoplanes derwentensis* |
| SBP00188 | Asian pear | *Actinoplanes derwentensis* |
| SBP00188 | Asian pear | *Actinoplanes* sp. ATCC 31351 |
| SBP00188 | Asian pear | *Actinoplanes* sp. ATCC 31351 |
| SBP00188 | Asian pear | *Aeromonas hydrophila* |
| SBP00188 | Asian pear | *Aeromonas hydrophila* |
| SBP00188 | Asian pear | *Aeromonas* sp. |
| SBP00188 | Asian pear | *Aeromonas* sp. |
| SBP00188 | Asian pear | *Agarilytica rhodophyticola* |
| SBP00188 | Asian pear | *Agarilytica rhodophyticola* |
| SBP00188 | Asian pear | *Agrobacterium fabrum* |
| SBP00188 | Asian pear | *Agrobacterium fabrum* |
| SBP00188 | Asian pear | *Agrobacterium larrymoorei* |
| SBP00188 | Asian pear | *Agrobacterium larrymoorei* |
| SBP00188 | Asian pear | *Agrobacterium rhizogenes* |
| SBP00188 | Asian pear | *Agrobacterium rhizogenes* |
| SBP00188 | Asian pear | *Agrobacterium* sp. |
| SBP00188 | Asian pear | *Agrobacterium* sp. |
| SBP00188 | Asian pear | *Agrobacterium* sp. RAC06 |
| SBP00188 | Asian pear | *Agrobacterium* sp. RAC06 |
| SBP00188 | Asian pear | *Agrobacterium tumefaciens* |
| SBP00188 | Asian pear | *Agrobacterium tumefaciens* |
| SBP00188 | Asian pear | *Alcaligenes aquatilis* |
| SBP00188 | Asian pear | *Alcaligenes aquatilis* |
| SBP00188 | Asian pear | *Alicycliphilus denitrificans* |
| SBP00188 | Asian pear | *Alicycliphilus denitrificans* |
| SBP00188 | Asian pear | *Alphaproteobacteria bacterium* WS11 |
| SBP00188 | Asian pear | *Alphaproteobacteria bacterium* WS11 |
| SBP00188 | Asian pear | *Altererythrobacter* sp. 811 |
| SBP00188 | Asian pear | *Altererythrobacter* sp. 811 |
| SBP00188 | Asian pear | *Anabaenopsis circularis* |

TABLE 3-continued

List of species identified in each metagenomic sample of each SBP Sample

| SBP ID | SBP Host Common Name | Genus sp. |
|---|---|---|
| SBP00188 | Asian pear | *Anabaenopsis circularis* |
| SBP00188 | Asian pear | *Aquabacterium olei* |
| SBP00188 | Asian pear | *Aquabacterium olei* |
| SBP00188 | Asian pear | *Aquimarina* sp. AD1 |
| SBP00188 | Asian pear | *Aquimarina* sp. AD1 |
| SBP00188 | Asian pear | *Archaeoglobus fulgidus* |
| SBP00188 | Asian pear | *Archaeoglobus fulgidus* |
| SBP00188 | Asian pear | *Arcobacter anaerophilus* |
| SBP00188 | Asian pear | *Arcobacter anaerophilus* |
| SBP00188 | Asian pear | *Aromatoleum aromaticum* |
| SBP00188 | Asian pear | *Aromatoleum aromaticum* |
| SBP00188 | Asian pear | *Asaia bogorensis* |
| SBP00188 | Asian pear | *Asaia bogorensis* |
| SBP00188 | Asian pear | *Asticcacaulis excentricus* |
| SBP00188 | Asian pear | *Asticcacaulis excentricus* |
| SBP00188 | Asian pear | *Atlantibacter hermannii* |
| SBP00188 | Asian pear | *Atlantibacter hermannii* |
| SBP00188 | Asian pear | *Azospirillum* sp. CFH 70021 |
| SBP00188 | Asian pear | *Azospirillum* sp. CFH 70021 |
| SBP00188 | Asian pear | *Bacillus altitudinis* |
| SBP00188 | Asian pear | *Bacillus altitudinis* |
| SBP00188 | Asian pear | *Bacillus megaterium* |
| SBP00188 | Asian pear | *Bacillus megaterium* |
| SBP00188 | Asian pear | *Bacillus mycoides* |
| SBP00188 | Asian pear | *Bacillus mycoides* |
| SBP00188 | Asian pear | *Bacillus safensis* |
| SBP00188 | Asian pear | *Bacillus safensis* |
| SBP00188 | Asian pear | *Bacillus* sp. (in: Bacteria) |
| SBP00188 | Asian pear | *Bacillus* sp. (in: Bacteria) |
| SBP00188 | Asian pear | *Bacillus* sp. FJAT-42376 |
| SBP00188 | Asian pear | *Bacillus* sp. FJAT-42376 |
| SBP00188 | Asian pear | *Bordetella avium* |
| SBP00188 | Asian pear | *Bordetella avium* |
| SBP00188 | Asian pear | *Bordetella flabilis* |
| SBP00188 | Asian pear | *Bordetella flabilis* |
| SBP00188 | Asian pear | *Bordetella* genomosp. 13 |
| SBP00188 | Asian pear | *Bordetella* genomosp. 13 |
| SBP00188 | Asian pear | *Bordetella* genomosp. 9 |
| SBP00188 | Asian pear | *Bordetella* genomosp. 9 |
| SBP00188 | Asian pear | *Bordetella petrii* |
| SBP00188 | Asian pear | *Bordetella petrii* |
| SBP00188 | Asian pear | *Bordetella* sp. N |
| SBP00188 | Asian pear | *Bordetella* sp. N |
| SBP00188 | Asian pear | *Bosea vaviloviae* |
| SBP00188 | Asian pear | *Bosea vaviloviae* |
| SBP00188 | Asian pear | *Bradyrhizobium icense* |
| SBP00188 | Asian pear | *Bradyrhizobium icense* |
| SBP00188 | Asian pear | *Brevundimonas diminuta* |
| SBP00188 | Asian pear | *Brevundimonas diminuta* |
| SBP00188 | Asian pear | *Brevundimonas naejangsanensis* |
| SBP00188 | Asian pear | *Brevundimonas naejangsanensis* |
| SBP00188 | Asian pear | *Brevundimonas* sp. DS20 |
| SBP00188 | Asian pear | *Brevundimonas* sp. DS20 |
| SBP00188 | Asian pear | *Brevundimonas* sp. GW460-12-10-14-LB2 |
| SBP00188 | Asian pear | *Brevundimonas* sp. GW460-12-10-14-LB2 |
| SBP00188 | Asian pear | *Brevundimonas* sp. LM2 |
| SBP00188 | Asian pear | *Brevundimonas* sp. LM2 |
| SBP00188 | Asian pear | *Brevundimonas subvibrioides* |
| SBP00188 | Asian pear | *Brevundimonas subvibrioides* |
| SBP00188 | Asian pear | *Brevundimonas vesicularis* |
| SBP00188 | Asian pear | *Brevundimonas vesicularis* |
| SBP00188 | Asian pear | *Burkholderia cenocepacia* |
| SBP00188 | Asian pear | *Burkholderia cenocepacia* |
| SBP00188 | Asian pear | *Burkholderia gladioli* |
| SBP00188 | Asian pear | *Burkholderia gladioli* |
| SBP00188 | Asian pear | *Burkholderia pseudomallei* |
| SBP00188 | Asian pear | *Burkholderia pseudomallei* |
| SBP00188 | Asian pear | *Burkholderia* sp. CCGE1002 |
| SBP00188 | Asian pear | *Burkholderia* sp. CCGE1002 |
| SBP00188 | Asian pear | *Burkholderia territorii* |
| SBP00188 | Asian pear | *Burkholderia territorii* |
| SBP00188 | Asian pear | *Buttiauxella* sp. 3AFRM03 |
| SBP00188 | Asian pear | *Buttiauxella* sp. 3AFRM03 |
| SBP00188 | Asian pear | *Campylobacter jejuni* |
| SBP00188 | Asian pear | *Campylobacter jejuni* |
| SBP00188 | Asian pear | *Candidatus Arthromitus* sp. SFB-rat-Yit |

TABLE 3-continued

List of species identified in each metagenomic sample of each SBP Sample

| SBP ID | SBP Host Common Name | Genus sp. |
|---|---|---|
| SBP00188 | Asian pear | *Candidatus Arthromitus* sp. SFB-rat-Yit |
| SBP00188 | Asian pear | *Candidatus Hamiltonella defensa* |
| SBP00188 | Asian pear | *Candidatus Hamiltonella defensa* |
| SBP00188 | Asian pear | *Candidatus Methylopumilus planktonicus* |
| SBP00188 | Asian pear | *Candidatus Methylopumilus planktonicus* |
| SBP00188 | Asian pear | *Candidatus Thioglobus autotrophicus* |
| SBP00188 | Asian pear | *Candidatus Thioglobus autotrophicus* |
| SBP00188 | Asian pear | *Carnobacterium* sp. 17-4 |
| SBP00188 | Asian pear | *Carnobacterium* sp. 17-4 |
| SBP00188 | Asian pear | *Carnobacterium* sp. CP1 |
| SBP00188 | Asian pear | *Carnobacterium* sp. CP1 |
| SBP00188 | Asian pear | *Caulobacter flavus* |
| SBP00188 | Asian pear | *Caulobacter flavus* |
| SBP00188 | Asian pear | *Caulobacter* sp. K31 |
| SBP00188 | Asian pear | *Caulobacter* sp. K31 |
| SBP00188 | Asian pear | *Cedecea lapagei* |
| SBP00188 | Asian pear | *Cedecea lapagei* |
| SBP00188 | Asian pear | *Cedecea neteri* |
| SBP00188 | Asian pear | *Cedecea neteri* |
| SBP00188 | Asian pear | *Chryseobacterium balustinum* |
| SBP00188 | Asian pear | *Chryseobacterium balustinum* |
| SBP00188 | Asian pear | *Chryseobacterium carnipullorum* |
| SBP00188 | Asian pear | *Chryseobacterium carnipullorum* |
| SBP00188 | Asian pear | *Chryseobacterium glaciei* |
| SBP00188 | Asian pear | *Chryseobacterium glaciei* |
| SBP00188 | Asian pear | *Chryseobacterium gleum* |
| SBP00188 | Asian pear | *Chryseobacterium gleum* |
| SBP00188 | Asian pear | *Chryseobacterium indologenes* |
| SBP00188 | Asian pear | *Chryseobacterium indologenes* |
| SBP00188 | Asian pear | *Chryseobacterium indoltheticum* |
| SBP00188 | Asian pear | *Chryseobacterium indoltheticum* |
| SBP00188 | Asian pear | *Citrobacter farmeri* |
| SBP00188 | Asian pear | *Citrobacter farmeri* |
| SBP00188 | Asian pear | *Citrobacter freundii* |
| SBP00188 | Asian pear | *Citrobacter freundii* |
| SBP00188 | Asian pear | *Citrobacter koseri* |
| SBP00188 | Asian pear | *Citrobacter koseri* |
| SBP00188 | Asian pear | *Citromicrobium* sp. JL477 |
| SBP00188 | Asian pear | *Citromicrobium* sp. JL477 |
| SBP00188 | Asian pear | *Clavibacter michiganensis* |
| SBP00188 | Asian pear | *Clavibacter michiganensis* |
| SBP00188 | Asian pear | *Clostridiaceae bacterium* 14S0207 |
| SBP00188 | Asian pear | *Clostridiaceae bacterium* 14S0207 |
| SBP00188 | Asian pear | *Clostridium argentinense* |
| SBP00188 | Asian pear | *Clostridium argentinense* |
| SBP00188 | Asian pear | *Clostridium beijerinckii* |
| SBP00188 | Asian pear | *Clostridium beijerinckii* |
| SBP00188 | Asian pear | *Clostridium botulinum* |
| SBP00188 | Asian pear | *Clostridium botulinum* |
| SBP00188 | Asian pear | *Clostridium pasteurianum* |
| SBP00188 | Asian pear | *Clostridium pasteurianum* |
| SBP00188 | Asian pear | *Clostridium septicum* |
| SBP00188 | Asian pear | *Clostridium septicum* |
| SBP00188 | Asian pear | *Collimonas arenae* |
| SBP00188 | Asian pear | *Collimonas arenae* |
| SBP00188 | Asian pear | *Collimonas fungivorans* |
| SBP00188 | Asian pear | *Collimonas fungivorans* |
| SBP00188 | Asian pear | *Collimonas pratensis* |
| SBP00188 | Asian pear | *Collimonas pratensis* |
| SBP00188 | Asian pear | *Comamonas aquatica* |
| SBP00188 | Asian pear | *Comamonas aquatica* |
| SBP00188 | Asian pear | *Corynebacterium ammoniagenes* |
| SBP00188 | Asian pear | *Corynebacterium ammoniagenes* |
| SBP00188 | Asian pear | *Corynebacterium segmentosum* |
| SBP00188 | Asian pear | *Corynebacterium segmentosum* |
| SBP00188 | Asian pear | *Corynebacterium simulans* |
| SBP00188 | Asian pear | *Corynebacterium simulans* |
| SBP00188 | Asian pear | *Corynebacterium striatum* |
| SBP00188 | Asian pear | *Corynebacterium striatum* |
| SBP00188 | Asian pear | *Croceicoccus marinus* |
| SBP00188 | Asian pear | *Croceicoccus marinus* |
| SBP00188 | Asian pear | *Cupriavidus basilensis* |
| SBP00188 | Asian pear | *Cupriavidus basilensis* |
| SBP00188 | Asian pear | *Cupriavidus gilardii* |
| SBP00188 | Asian pear | *Cupriavidus gilardii* |
| SBP00188 | Asian pear | *Cupriavidus metallidurans* |

TABLE 3-continued

List of species identified in each metagenomic sample of each SBP Sample

| SBP ID | SBP Host Common Name | Genus sp. |
|---|---|---|
| SBP00188 | Asian pear | *Cupriavidus metallidurans* |
| SBP00188 | Asian pear | *Cupriavidus necator* |
| SBP00188 | Asian pear | *Cupriavidus necator* |
| SBP00188 | Asian pear | *Cupriavidus oxalaticus* |
| SBP00188 | Asian pear | *Cupriavidus oxalaticus* |
| SBP00188 | Asian pear | *Cupriavidus pauculus* |
| SBP00188 | Asian pear | *Cupriavidus pauculus* |
| SBP00188 | Asian pear | *Cupriavidus pinatubonensis* |
| SBP00188 | Asian pear | *Cupriavidus pinatubonensis* |
| SBP00188 | Asian pear | *Cupriavidus taiwanensis* |
| SBP00188 | Asian pear | *Cupriavidus taiwanensis* |
| SBP00188 | Asian pear | *Curtobacterium pusillum* |
| SBP00188 | Asian pear | *Curtobacterium pusillum* |
| SBP00188 | Asian pear | *Curtobacterium* sp. BH-2-1-1 |
| SBP00188 | Asian pear | *Curtobacterium* sp. BH-2-1-1 |
| SBP00188 | Asian pear | *Curtobacterium* sp. MR_MD2014 |
| SBP00188 | Asian pear | *Curtobacterium* sp. MR_MD2014 |
| SBP00188 | Asian pear | *Curtobacterium* sp. SGAir0471 |
| SBP00188 | Asian pear | *Curtobacterium* sp. SGAir0471 |
| SBP00188 | Asian pear | *Cutibacterium acnes* |
| SBP00188 | Asian pear | *Cutibacterium acnes* |
| SBP00188 | Asian pear | *Delftia* sp. |
| SBP00188 | Asian pear | *Delftia* sp. |
| SBP00188 | Asian pear | *Desulfurispirillum indicum* |
| SBP00188 | Asian pear | *Desulfurispirillum indicum* |
| SBP00188 | Asian pear | *Dickeya dadantii* |
| SBP00188 | Asian pear | *Dickeya dadantii* |
| SBP00188 | Asian pear | *Dickeya zeae* |
| SBP00188 | Asian pear | *Dickeya zeae* |
| SBP00188 | Asian pear | *Diolcogaster facetosa bracovirus* |
| SBP00188 | Asian pear | *Diolcogaster facetosa bracovirus* |
| SBP00188 | Asian pear | *Echinicola strongylocentroti* |
| SBP00188 | Asian pear | *Echinicola strongylocentroti* |
| SBP00188 | Asian pear | *Ensifer adhaerens* |
| SBP00188 | Asian pear | *Ensifer adhaerens* |
| SBP00188 | Asian pear | *Enterobacter cloacae* |
| SBP00188 | Asian pear | *Enterobacter cloacae* |
| SBP00188 | Asian pear | *Enterobacter cloacae* complex sp. |
| SBP00188 | Asian pear | *Enterobacter cloacae* complex sp. |
| SBP00188 | Asian pear | *Enterobacter ludwigii* |
| SBP00188 | Asian pear | *Enterobacter ludwigii* |
| SBP00188 | Asian pear | *Enterococcus faecalis* |
| SBP00188 | Asian pear | *Enterococcus faecalis* |
| SBP00188 | Asian pear | *Erwinia billingiae* |
| SBP00188 | Asian pear | *Erwinia billingiae* |
| SBP00188 | Asian pear | *Erwinia gerundensis* |
| SBP00188 | Asian pear | *Erwinia gerundensis* |
| SBP00188 | Asian pear | *Erwinia* sp. |
| SBP00188 | Asian pear | *Erwinia* sp. |
| SBP00188 | Asian pear | *Erwinia tasmaniensis* |
| SBP00188 | Asian pear | *Erwinia tasmaniensis* |
| SBP00188 | Asian pear | *Escherichia coli* |
| SBP00188 | Asian pear | *Escherichia coli* |
| SBP00188 | Asian pear | *Eubacterium limosum* |
| SBP00188 | Asian pear | *Eubacterium limosum* |
| SBP00188 | Asian pear | *Fibrella aestuarina* |
| SBP00188 | Asian pear | *Fibrella aestuarina* |
| SBP00188 | Asian pear | *Fischerella* sp. NIES-4106 |
| SBP00188 | Asian pear | *Fischerella* sp. NIES-4106 |
| SBP00188 | Asian pear | *Flavobacterium kingsejongi* |
| SBP00188 | Asian pear | *Flavobacterium kingsejongi* |
| SBP00188 | Asian pear | *Francisella* sp. CA97-1460 |
| SBP00188 | Asian pear | *Francisella* sp. CA97-1460 |
| SBP00188 | Asian pear | *Fusobacterium nucleatum* |
| SBP00188 | Asian pear | *Fusobacterium nucleatum* |
| SBP00188 | Asian pear | *Fusobacterium periodonticum* |
| SBP00188 | Asian pear | *Fusobacterium periodonticum* |
| SBP00188 | Asian pear | *Gibbsiella quercinecans* |
| SBP00188 | Asian pear | *Gibbsiella quercinecans* |
| SBP00188 | Asian pear | *Gilliamella apicola* |
| SBP00188 | Asian pear | *Gilliamella apicola* |
| SBP00188 | Asian pear | *Gluconobacter oxydans* |
| SBP00188 | Asian pear | *Gluconobacter oxydans* |
| SBP00188 | Asian pear | *Gordonia* sp. MMS17-SY073 |
| SBP00188 | Asian pear | *Gordonia* sp. MMS17-SY073 |
| SBP00188 | Asian pear | *Hafnia paralvei* |

TABLE 3-continued

List of species identified in each metagenomic sample of each SBP Sample

| SBP ID | SBP Host Common Name | Genus sp. |
|---|---|---|
| SBP00188 | Asian pear | *Hafnia paralvei* |
| SBP00188 | Asian pear | *Haliscomenobacter hydrossis* |
| SBP00188 | Asian pear | *Haliscomenobacter hydrossis* |
| SBP00188 | Asian pear | *Halomonas* sp. 'Soap Lake #7' |
| SBP00188 | Asian pear | *Halomonas* sp. 'Soap Lake #7' |
| SBP00188 | Asian pear | *Halomonas* sp. hl-4 |
| SBP00188 | Asian pear | *Halomonas* sp. hl-4 |
| SBP00188 | Asian pear | *Heliobacterium modesticaldum* |
| SBP00188 | Asian pear | *Heliobacterium modesticaldum* |
| SBP00188 | Asian pear | *Herbaspirillum hiltneri* |
| SBP00188 | Asian pear | *Herbaspirillum hiltneri* |
| SBP00188 | Asian pear | *Herbaspirillum huttiense* |
| SBP00188 | Asian pear | *Herbaspirillum huttiense* |
| SBP00188 | Asian pear | *Herbaspirillum robiniae* |
| SBP00188 | Asian pear | *Herbaspirillum robiniae* |
| SBP00188 | Asian pear | *Herbaspirillum rubrisubalbicans* |
| SBP00188 | Asian pear | *Herbaspirillum rubrisubalbicans* |
| SBP00188 | Asian pear | *Herbaspirillum seropedicae* |
| SBP00188 | Asian pear | *Herbaspirillum seropedicae* |
| SBP00188 | Asian pear | *Herbaspirillum* sp. meg3 |
| SBP00188 | Asian pear | *Herbaspirillum* sp. meg3 |
| SBP00188 | Asian pear | *Ignavibacterium album* |
| SBP00188 | Asian pear | *Ignavibacterium album* |
| SBP00188 | Asian pear | *Janthinobacterium agaricidamnosum* |
| SBP00188 | Asian pear | *Janthinobacterium agaricidamnosum* |
| SBP00188 | Asian pear | *Janthinobacterium* sp. 1_2014MBL_MicDiv |
| SBP00188 | Asian pear | *Janthinobacterium* sp. 1_2014MBL_MicDiv |
| SBP00188 | Asian pear | *Janthinobacterium* sp. 17J80-10 |
| SBP00188 | Asian pear | *Janthinobacterium* sp. 17180-10 |
| SBP00188 | Asian pear | *Janthinobacterium* sp. LM6 |
| SBP00188 | Asian pear | *Janthinobacterium* sp. LM6 |
| SBP00188 | Asian pear | *Janthinobacterium* sp. Marseille |
| SBP00188 | Asian pear | *Janthinobacterium* sp. Marseille |
| SBP00188 | Asian pear | *Janthinobacterium svalbardensis* |
| SBP00188 | Asian pear | *Janthinobacterium svalbardensis* |
| SBP00188 | Asian pear | *Jeongeupia* sp. USM3 |
| SBP00188 | Asian pear | *Jeongeupia* sp. USM3 |
| SBP00188 | Asian pear | *Ketogulonicigenium robustum* |
| SBP00188 | Asian pear | *Ketogulonicigenium robustum* |
| SBP00188 | Asian pear | *Klebsiella michiganensis* |
| SBP00188 | Asian pear | *Klebsiella michiganensis* |
| SBP00188 | Asian pear | *Klebsiella oxytoca* |
| SBP00188 | Asian pear | *Klebsiella oxytoca* |
| SBP00188 | Asian pear | *Klebsiella pneumoniae* |
| SBP00188 | Asian pear | *Klebsiella pneumoniae* |
| SBP00188 | Asian pear | *Kocuria rosea* |
| SBP00188 | Asian pear | *Kocuria rosea* |
| SBP00188 | Asian pear | *Komagataeibacter xylinus* |
| SBP00188 | Asian pear | *Komagataeibacter xylinus* |
| SBP00188 | Asian pear | *Kosakonia cowanii* |
| SBP00188 | Asian pear | *Kosakonia cowanii* |
| SBP00188 | Asian pear | *Kosakonia oryzae* |
| SBP00188 | Asian pear | *Kosakonia oryzae* |
| SBP00188 | Asian pear | *Lactobacillus brevis* |
| SBP00188 | Asian pear | *Lactobacillus brevis* |
| SBP00188 | Asian pear | *Lactobacillus curvatus* |
| SBP00188 | Asian pear | *Lactobacillus curvatus* |
| SBP00188 | Asian pear | *Lactobacillus mucosae* |
| SBP00188 | Asian pear | *Lactobacillus mucosae* |
| SBP00188 | Asian pear | *Lactobacillus salivarius* |
| SBP00188 | Asian pear | *Lactobacillus salivarius* |
| SBP00188 | Asian pear | *Lactococcus lactis* |
| SBP00188 | Asian pear | *Lactococcus lactis* |
| SBP00188 | Asian pear | *Leclercia adecarboxylata* |
| SBP00188 | Asian pear | *Leclercia adecarboxylata* |
| SBP00188 | Asian pear | *Leifsonia* sp. 21MFCrub1.1 |
| SBP00188 | Asian pear | *Leifsonia* sp. 21MFCrub1.1 |
| SBP00188 | Asian pear | *Leifsonia xyli* |
| SBP00188 | Asian pear | *Leifsonia xyli* |
| SBP00188 | Asian pear | *Lelliottia amnigena* |
| SBP00188 | Asian pear | *Lelliottia amnigena* |
| SBP00188 | Asian pear | *Leuconostoc carnosum* |
| SBP00188 | Asian pear | *Leuconostoc carnosum* |
| SBP00188 | Asian pear | *Leuconostoc citreum* |
| SBP00188 | Asian pear | *Leuconostoc citreum* |
| SBP00188 | Asian pear | *Limnohabitans* sp. 63ED37-2 |

TABLE 3-continued

List of species identified in each metagenomic sample of each SBP Sample

| SBP ID | SBP Host Common Name | Genus sp. |
|---|---|---|
| SBP00188 | Asian pear | *Limnohabitans* sp. 63ED37-2 |
| SBP00188 | Asian pear | *Listeria innocua* |
| SBP00188 | Asian pear | *Listeria innocua* |
| SBP00188 | Asian pear | *Listeria monocytogenes* |
| SBP00188 | Asian pear | *Listeria monocytogenes* |
| SBP00188 | Asian pear | *Luteibacter rhizovicinus* |
| SBP00188 | Asian pear | *Luteibacter rhizovicinus* |
| SBP00188 | Asian pear | *Luteimonas* sp. JM171 |
| SBP00188 | Asian pear | *Luteimonas* sp. JM171 |
| SBP00188 | Asian pear | *Lysobacter antibioticus* |
| SBP00188 | Asian pear | *Lysobacter antibioticus* |
| SBP00188 | Asian pear | *Lysobacter capsici* |
| SBP00188 | Asian pear | *Lysobacter capsici* |
| SBP00188 | Asian pear | *Lysobacter enzymogenes* |
| SBP00188 | Asian pear | *Lysobacter enzymogenes* |
| SBP00188 | Asian pear | *Magnetospirillum magneticum* |
| SBP00188 | Asian pear | *Magnetospirillum magneticum* |
| SBP00188 | Asian pear | *Massilia albidiflava* |
| SBP00188 | Asian pear | *Massilia albidiflava* |
| SBP00188 | Asian pear | *Massilia armeniaca* |
| SBP00188 | Asian pear | *Massilia armeniaca* |
| SBP00188 | Asian pear | *Massilia lutea* |
| SBP00188 | Asian pear | *Massilia lutea* |
| SBP00188 | Asian pear | *Massilia oculi* |
| SBP00188 | Asian pear | *Massilia oculi* |
| SBP00188 | Asian pear | *Massilia plicata* |
| SBP00188 | Asian pear | *Massilia plicata* |
| SBP00188 | Asian pear | *Massilia putida* |
| SBP00188 | Asian pear | *Massilia putida* |
| SBP00188 | Asian pear | *Massilia* sp. NR 4-1 |
| SBP00188 | Asian pear | *Massilia* sp. NR 4-1 |
| SBP00188 | Asian pear | *Massilia* sp. WG5 |
| SBP00188 | Asian pear | *Massilia* sp. WG5 |
| SBP00188 | Asian pear | *Massilia* sp. YMA4 |
| SBP00188 | Asian pear | *Massilia* sp. YMA4 |
| SBP00188 | Asian pear | *Massilia umbonata* |
| SBP00188 | Asian pear | *Massilia umbonata* |
| SBP00188 | Asian pear | *Massilia violaceinigra* |
| SBP00188 | Asian pear | *Massilia violaceinigra* |
| SBP00188 | Asian pear | *Megavirus chiliensis* |
| SBP00188 | Asian pear | *Megavirus chiliensis* |
| SBP00188 | Asian pear | *Methanocella paludicola* |
| SBP00188 | Asian pear | *Methanocella paludicola* |
| SBP00188 | Asian pear | *Methanosarcina barkeri* |
| SBP00188 | Asian pear | *Methanosarcina barkeri* |
| SBP00188 | Asian pear | *Methyloversatilis* sp. RAC08 |
| SBP00188 | Asian pear | *Methyloversatilis* sp. RAC08 |
| SBP00188 | Asian pear | *Microbacterium foliorum* |
| SBP00188 | Asian pear | *Microbacterium foliorum* |
| SBP00188 | Asian pear | *Microbacterium oxydans* |
| SBP00188 | Asian pear | *Microbacterium oxydans* |
| SBP00188 | Asian pear | *Microbacterium pygmaeum* |
| SBP00188 | Asian pear | *Microbacterium pygmaeum* |
| SBP00188 | Asian pear | *Microbacterium sediminis* |
| SBP00188 | Asian pear | *Microbacterium sediminis* |
| SBP00188 | Asian pear | *Microbacterium* sp. BH-3-3-3 |
| SBP00188 | Asian pear | *Microbacterium* sp. BH-3-3-3 |
| SBP00188 | Asian pear | *Microbacterium* sp. CGR1 |
| SBP00188 | Asian pear | *Microbacterium* sp. CGR1 |
| SBP00188 | Asian pear | *Micromonospora zamorensis* |
| SBP00188 | Asian pear | *Micromonospora zamorensis* |
| SBP00188 | Asian pear | *Mitsuaria* sp. 7 |
| SBP00188 | Asian pear | *Mitsuaria* sp. 7 |
| SBP00188 | Asian pear | *Mixta calida* |
| SBP00188 | Asian pear | *Mixta calida* |
| SBP00188 | Asian pear | *Mixta gaviniae* |
| SBP00188 | Asian pear | *Mixta gaviniae* |
| SBP00188 | Asian pear | *Moorea producens* |
| SBP00188 | Asian pear | *Moorea producens* |
| SBP00188 | Asian pear | *Moraxella osloensis* |
| SBP00188 | Asian pear | *Moraxella osloensis* |
| SBP00188 | Asian pear | *Mucilaginibacter* sp. HYN0043 |
| SBP00188 | Asian pear | *Mucilaginibacter* sp. HYN0043 |
| SBP00188 | Asian pear | *Mucilaginibacter* sp. PAMC 26640 |
| SBP00188 | Asian pear | *Mucilaginibacter* sp. PAMC 26640 |
| SBP00188 | Asian pear | *Myxococcus xanthus* |

TABLE 3-continued

List of species identified in each metagenomic sample of each SBP Sample

| SBP ID | SBP Host Common Name | Genus sp. |
|---|---|---|
| SBP00188 | Asian pear | *Myxococcus xanthus* |
| SBP00188 | Asian pear | *Neorhizobium galegae* |
| SBP00188 | Asian pear | *Neorhizobium galegae* |
| SBP00188 | Asian pear | *Neorhizobium* sp. NCHU2750 |
| SBP00188 | Asian pear | *Neorhizobium* sp. NCHU2750 |
| SBP00188 | Asian pear | *Neorhizobium* sp. SOG26 |
| SBP00188 | Asian pear | *Neorhizobium* sp. SOG26 |
| SBP00188 | Asian pear | *Nocardia farcinica* |
| SBP00188 | Asian pear | *Nocardia farcinica* |
| SBP00188 | Asian pear | *Nocardia* sp. CFHS0054 |
| SBP00188 | Asian pear | *Nocardia* sp. CFHS0054 |
| SBP00188 | Asian pear | *Nocardia* sp. Y48 |
| SBP00188 | Asian pear | *Nocardia* sp. Y48 |
| SBP00188 | Asian pear | *Nostoc linckia* |
| SBP00188 | Asian pear | *Nostoc linckia* |
| SBP00188 | Asian pear | *Nostoc* sp. CENA543 |
| SBP00188 | Asian pear | *Nostoc* sp. CENA543 |
| SBP00188 | Asian pear | *Novosphingobium pentaromativorans* |
| SBP00188 | Asian pear | *Novosphingobium pentaromativorans* |
| SBP00188 | Asian pear | *Novosphingobium resinovorum* |
| SBP00188 | Asian pear | *Novosphingobium resinovorum* |
| SBP00188 | Asian pear | *Novosphingobium* sp. P6W |
| SBP00188 | Asian pear | *Novosphingobium* sp. P6W |
| SBP00188 | Asian pear | *Novosphingobium* sp. PP1Y |
| SBP00188 | Asian pear | *Novosphingobium* sp. PP1Y |
| SBP00188 | Asian pear | *Novosphingobium* sp. THN1 |
| SBP00188 | Asian pear | *Novosphingobium* sp. THN1 |
| SBP00188 | Asian pear | *Oleiphilus messinensis* |
| SBP00188 | Asian pear | *Oleiphilus messinensis* |
| SBP00188 | Asian pear | *Orrella dioscoreae* |
| SBP00188 | Asian pear | *Orrella dioscoreae* |
| SBP00188 | Asian pear | *Paenibacillus crassostreae* |
| SBP00188 | Asian pear | *Paenibacillus crassostreae* |
| SBP00188 | Asian pear | *Paenibacillus durus* |
| SBP00188 | Asian pear | *Paenibacillus durus* |
| SBP00188 | Asian pear | *Paenibacillus* sp. 32O-W |
| SBP00188 | Asian pear | *Paenibacillus* sp. 32O-W |
| SBP00188 | Asian pear | *Paenibacillus* sp. FSL H7-0357 |
| SBP00188 | Asian pear | *Paenibacillus* sp. FSL H7-0357 |
| SBP00188 | Asian pear | *Paenibacillus* sp. FSL R7-0273 |
| SBP00188 | Asian pear | *Paenibacillus* sp. FSL R7-0273 |
| SBP00188 | Asian pear | *Paenisporosarcina antarctica* |
| SBP00188 | Asian pear | *Paenisporosarcina antarctica* |
| SBP00188 | Asian pear | *Pandoraea pnomenusa* |
| SBP00188 | Asian pear | *Pandoraea pnomenusa* |
| SBP00188 | Asian pear | *Pandoraea vervacti* |
| SBP00188 | Asian pear | *Pandoraea vervacti* |
| SBP00188 | Asian pear | *Pantoea agglomerans* |
| SBP00188 | Asian pear | *Pantoea agglomerans* |
| SBP00188 | Asian pear | *Pantoea ananatis* |
| SBP00188 | Asian pear | *Pantoea ananatis* |
| SBP00188 | Asian pear | *Pantoea rwandensis* |
| SBP00188 | Asian pear | *Pantoea rwandensis* |
| SBP00188 | Asian pear | *Pantoea* sp. At-9b |
| SBP00188 | Asian pear | *Pantoea* sp. At-9b |
| SBP00188 | Asian pear | *Pantoea* sp. PSNIH1 |
| SBP00188 | Asian pear | *Pantoea* sp. PSNIH1 |
| SBP00188 | Asian pear | *Pantoea vagans* |
| SBP00188 | Asian pear | *Pantoea vagans* |
| SBP00188 | Asian pear | *Paraburkholderia hospita* |
| SBP00188 | Asian pear | *Paraburkholderia hospita* |
| SBP00188 | Asian pear | *Paraburkholderia* sp. SOS3 |
| SBP00188 | Asian pear | *Paraburkholderia* sp. SOS3 |
| SBP00188 | Asian pear | *Paraburkholderia terricola* |
| SBP00188 | Asian pear | *Paraburkholderia terricola* |
| SBP00188 | Asian pear | *Paracoccus* sp. Arc7-R13 |
| SBP00188 | Asian pear | *Paracoccus* sp. Arc7-R13 |
| SBP00188 | Asian pear | *Paramecium bursaria Chlorella* virus 1 |
| SBP00188 | Asian pear | *Paramecium bursaria Chlorella* virus 1 |
| SBP00188 | Asian pear | *Pasteurella multocida* |
| SBP00188 | Asian pear | *Pasteurella multocida* |
| SBP00188 | Asian pear | *Pediococcus pentosaceus* |
| SBP00188 | Asian pear | *Pediococcus pentosaceus* |
| SBP00188 | Asian pear | *Pelolinea submarina* |
| SBP00188 | Asian pear | *Pelolinea submarina* |
| SBP00188 | Asian pear | *Persicobacter* sp. JZB09 |

TABLE 3-continued

List of species identified in each metagenomic sample of each SBP Sample

| SBP ID | SBP Host Common Name | Genus sp. |
|---|---|---|
| SBP00188 | Asian pear | *Persicobacter* sp. JZB09 |
| SBP00188 | Asian pear | *Phaeobacter inhibens* |
| SBP00188 | Asian pear | *Phaeobacter inhibens* |
| SBP00188 | Asian pear | *Phenylobacterium zucineum* |
| SBP00188 | Asian pear | *Phenylobacterium zucineum* |
| SBP00188 | Asian pear | *Photobacterium damselae* |
| SBP00188 | Asian pear | *Photobacterium damselae* |
| SBP00188 | Asian pear | *Phyllobacterium zundukense* |
| SBP00188 | Asian pear | *Phyllobacterium zundukense* |
| SBP00188 | Asian pear | *Phytobacter* sp. SCO41 |
| SBP00188 | Asian pear | *Phytobacter* sp. SCO41 |
| SBP00188 | Asian pear | *Plantibacter flavus* |
| SBP00188 | Asian pear | *Plantibacter flavus* |
| SBP00188 | Asian pear | *Plantibacter* sp. |
| SBP00188 | Asian pear | *Plantibacter* sp. |
| SBP00188 | Asian pear | *Plantibacter* sp. PA-3-X8 |
| SBP00188 | Asian pear | *Plantibacter* sp. PA-3-X8 |
| SBP00188 | Asian pear | *Plautia stali* |
| SBP00188 | Asian pear | *Plautia stali* |
| SBP00188 | Asian pear | *Plautia stali* symbiont |
| SBP00188 | Asian pear | *Plautia stali* symbiont |
| SBP00188 | Asian pear | *Polaribacter reichenbachii* |
| SBP00188 | Asian pear | *Polaribacter reichenbachii* |
| SBP00188 | Asian pear | *Polaromonas naphthalenivorans* |
| SBP00188 | Asian pear | *Polaromonas naphthalenivorans* |
| SBP00188 | Asian pear | *Prochlorococcus marinus* |
| SBP00188 | Asian pear | *Prochlorococcus marinus* |
| SBP00188 | Asian pear | *Pseudoalteromonas* sp. SM9913 |
| SBP00188 | Asian pear | *Pseudoalteromonas* sp. SM9913 |
| SBP00188 | Asian pear | *Pseudoalteromonas spongiae* |
| SBP00188 | Asian pear | *Pseudoalteromonas spongiae* |
| SBP00188 | Asian pear | *Pseudomonas aeruginosa* |
| SBP00188 | Asian pear | *Pseudomonas aeruginosa* |
| SBP00188 | Asian pear | *Pseudomonas agarici* |
| SBP00188 | Asian pear | *Pseudomonas agarici* |
| SBP00188 | Asian pear | *Pseudomonas alcaligenes* |
| SBP00188 | Asian pear | *Pseudomonas alcaligenes* |
| SBP00188 | Asian pear | *Pseudomonas alkylphenolica* |
| SBP00188 | Asian pear | *Pseudomonas alkylphenolica* |
| SBP00188 | Asian pear | *Pseudomonas amygdali* |
| SBP00188 | Asian pear | *Pseudomonas amygdali* |
| SBP00188 | Asian pear | *Pseudomonas antarctica* |
| SBP00188 | Asian pear | *Pseudomonas antarctica* |
| SBP00188 | Asian pear | *Pseudomonas arsenicoxydans* |
| SBP00188 | Asian pear | *Pseudomonas arsenicoxydans* |
| SBP00188 | Asian pear | *Pseudomonas azotoformans* |
| SBP00188 | Asian pear | *Pseudomonas azotoformans* |
| SBP00188 | Asian pear | *Pseudomonas balearica* |
| SBP00188 | Asian pear | *Pseudomonas balearica* |
| SBP00188 | Asian pear | *Pseudomonas brassicacearum* |
| SBP00188 | Asian pear | *Pseudomonas brassicacearum* |
| SBP00188 | Asian pear | *Pseudomonas brenneri* |
| SBP00188 | Asian pear | *Pseudomonas brenneri* |
| SBP00188 | Asian pear | *Pseudomonas chlororaphis* |
| SBP00188 | Asian pear | *Pseudomonas chlororaphis* |
| SBP00188 | Asian pear | *Pseudomonas cichorii* |
| SBP00188 | Asian pear | *Pseudomonas cichorii* |
| SBP00188 | Asian pear | *Pseudomonas citronellolis* |
| SBP00188 | Asian pear | *Pseudomonas citronellolis* |
| SBP00188 | Asian pear | *Pseudomonas corrugata* |
| SBP00188 | Asian pear | *Pseudomonas corrugata* |
| SBP00188 | Asian pear | *Pseudomonas cremoricolorata* |
| SBP00188 | Asian pear | *Pseudomonas cremoricolorata* |
| SBP00188 | Asian pear | *Pseudomonas entomophila* |
| SBP00188 | Asian pear | *Pseudomonas entomophila* |
| SBP00188 | Asian pear | *Pseudomonas extremaustralis* |
| SBP00188 | Asian pear | *Pseudomonas extremaustralis* |
| SBP00188 | Asian pear | *Pseudomonas extremorientalis* |
| SBP00188 | Asian pear | *Pseudomonas extremorientalis* |
| SBP00188 | Asian pear | *Pseudomonas fluorescens* |
| SBP00188 | Asian pear | *Pseudomonas fluorescens* |
| SBP00188 | Asian pear | *Pseudomonas frederiksbergensis* |
| SBP00188 | Asian pear | *Pseudomonas frederiksbergensis* |
| SBP00188 | Asian pear | *Pseudomonas fulva* |
| SBP00188 | Asian pear | *Pseudomonas fulva* |
| SBP00188 | Asian pear | *Pseudomonas granadensis* |

TABLE 3-continued

List of species identified in each metagenomic sample of each SBP Sample

| SBP ID | SBP Host Common Name | Genus sp. |
|---|---|---|
| SBP00188 | Asian pear | *Pseudomonas granadensis* |
| SBP00188 | Asian pear | *Pseudomonas koreensis* |
| SBP00188 | Asian pear | *Pseudomonas koreensis* |
| SBP00188 | Asian pear | *Pseudomonas kribbensis* |
| SBP00188 | Asian pear | *Pseudomonas kribbensis* |
| SBP00188 | Asian pear | *Pseudomonas libanensis* |
| SBP00188 | Asian pear | *Pseudomonas libanensis* |
| SBP00188 | Asian pear | *Pseudomonas lini* |
| SBP00188 | Asian pear | *Pseudomonas lini* |
| SBP00188 | Asian pear | *Pseudomonas mandelii* |
| SBP00188 | Asian pear | *Pseudomonas mandelii* |
| SBP00188 | Asian pear | *Pseudomonas mendocina* |
| SBP00188 | Asian pear | *Pseudomonas mendocina* |
| SBP00188 | Asian pear | *Pseudomonas monteilii* |
| SBP00188 | Asian pear | *Pseudomonas monteilii* |
| SBP00188 | Asian pear | *Pseudomonas moraviensis* |
| SBP00188 | Asian pear | *Pseudomonas moraviensis* |
| SBP00188 | Asian pear | *Pseudomonas mosselii* |
| SBP00188 | Asian pear | *Pseudomonas mosselii* |
| SBP00188 | Asian pear | *Pseudomonas mucidolens* |
| SBP00188 | Asian pear | *Pseudomonas mucidolens* |
| SBP00188 | Asian pear | *Pseudomonas orientalis* |
| SBP00188 | Asian pear | *Pseudomonas orientalis* |
| SBP00188 | Asian pear | *Pseudomonas palleroniana* |
| SBP00188 | Asian pear | *Pseudomonas palleroniana* |
| SBP00188 | Asian pear | *Pseudomonas parafulva* |
| SBP00188 | Asian pear | *Pseudomonas parafulva* |
| SBP00188 | Asian pear | *Pseudomonas poae* |
| SBP00188 | Asian pear | *Pseudomonas poae* |
| SBP00188 | Asian pear | *Pseudomonas prosekii* |
| SBP00188 | Asian pear | *Pseudomonas prosekii* |
| SBP00188 | Asian pear | *Pseudomonas protegens* |
| SBP00188 | Asian pear | *Pseudomonas protegens* |
| SBP00188 | Asian pear | *Pseudomonas psychrophila* |
| SBP00188 | Asian pear | *Pseudomonas psychrophila* |
| SBP00188 | Asian pear | *Pseudomonas psychrotolerans* |
| SBP00188 | Asian pear | *Pseudomonas psychrotolerans* |
| SBP00188 | Asian pear | *Pseudomonas putida* |
| SBP00188 | Asian pear | *Pseudomonas putida* |
| SBP00188 | Asian pear | *Pseudomonas reinekei* |
| SBP00188 | Asian pear | *Pseudomonas reinekei* |
| SBP00188 | Asian pear | *Pseudomonas resinovorans* |
| SBP00188 | Asian pear | *Pseudomonas resinovorans* |
| SBP00188 | Asian pear | *Pseudomonas rhizosphaerae* |
| SBP00188 | Asian pear | *Pseudomonas rhizosphaerae* |
| SBP00188 | Asian pear | *Pseudomonas sabulinigri* |
| SBP00188 | Asian pear | *Pseudomonas sabulinigri* |
| SBP00188 | Asian pear | *Pseudomonas silesiensis* |
| SBP00188 | Asian pear | *Pseudomonas silesiensis* |
| SBP00188 | Asian pear | *Pseudomonas sp.* |
| SBP00188 | Asian pear | *Pseudomonas sp.* |
| SBP00188 | Asian pear | *Pseudomonas sp.* 09C 129 |
| SBP00188 | Asian pear | *Pseudomonas sp.* 09C 129 |
| SBP00188 | Asian pear | *Pseudomonas sp.* 31-12 |
| SBP00188 | Asian pear | *Pseudomonas sp.* 31-12 |
| SBP00188 | Asian pear | *Pseudomonas sp.* 7SR1 |
| SBP00188 | Asian pear | *Pseudomonas sp.* 7SR1 |
| SBP00188 | Asian pear | *Pseudomonas sp.* A214 |
| SBP00188 | Asian pear | *Pseudomonas sp.* A214 |
| SBP00188 | Asian pear | *Pseudomonas sp.* CC6-YY-74 |
| SBP00188 | Asian pear | *Pseudomonas sp.* CC6-YY-74 |
| SBP00188 | Asian pear | *Pseudomonas sp.* CCOS 191 |
| SBP00188 | Asian pear | *Pseudomonas sp.* CCOS 191 |
| SBP00188 | Asian pear | *Pseudomonas sp.* CMR12a |
| SBP00188 | Asian pear | *Pseudomonas sp.* CMR12a |
| SBP00188 | Asian pear | *Pseudomonas sp.* CMR5c |
| SBP00188 | Asian pear | *Pseudomonas sp.* CMR5c |
| SBP00188 | Asian pear | *Pseudomonas sp.* DR 5-09 |
| SBP00188 | Asian pear | *Pseudomonas sp.* DR 5-09 |
| SBP00188 | Asian pear | *Pseudomonas sp.* DY-1 |
| SBP00188 | Asian pear | *Pseudomonas sp.* DY-1 |
| SBP00188 | Asian pear | *Pseudomonas sp.* GR 6-02 |
| SBP00188 | Asian pear | *Pseudomonas sp.* GR 6-02 |
| SBP00188 | Asian pear | *Pseudomonas sp.* HLS-6 |
| SBP00188 | Asian pear | *Pseudomonas sp.* HLS-6 |
| SBP00188 | Asian pear | *Pseudomonas sp.* LAB-08 |

TABLE 3-continued

List of species identified in each metagenomic sample of each SBP Sample

| SBP ID | SBP Host Common Name | Genus sp. |
|---|---|---|
| SBP00188 | Asian pear | *Pseudomonas* sp. LAB-08 |
| SBP00188 | Asian pear | *Pseudomonas* sp. LBUM920 |
| SBP00188 | Asian pear | *Pseudomonas* sp. LBUM920 |
| SBP00188 | Asian pear | *Pseudomonas* sp. Leaf58 |
| SBP00188 | Asian pear | *Pseudomonas* sp. Leaf58 |
| SBP00188 | Asian pear | *Pseudomonas* sp. LG1D9 |
| SBP00188 | Asian pear | *Pseudomonas* sp. LG1D9 |
| SBP00188 | Asian pear | *Pseudomonas* sp. LG1E9 |
| SBP00188 | Asian pear | *Pseudomonas* sp. LG1E9 |
| SBP00188 | Asian pear | *Pseudomonas* sp. LTJR-52 |
| SBP00188 | Asian pear | *Pseudomonas* sp. LTJR-52 |
| SBP00188 | Asian pear | *Pseudomonas* sp. MYb193 |
| SBP00188 | Asian pear | *Pseudomonas* sp. MYb193 |
| SBP00188 | Asian pear | *Pseudomonas* sp. NC02 |
| SBP00188 | Asian pear | *Pseudomonas* sp. NC02 |
| SBP00188 | Asian pear | *Pseudomonas* sp. NS1(2017) |
| SBP00188 | Asian pear | *Pseudomonas* sp. NS1(2017) |
| SBP00188 | Asian pear | *Pseudomonas* sp. Os17 |
| SBP00188 | Asian pear | *Pseudomonas* sp. Os17 |
| SBP00188 | Asian pear | *Pseudomonas* sp. RU47 |
| SBP00188 | Asian pear | *Pseudomonas* sp. RU47 |
| SBP00188 | Asian pear | *Pseudomonas* sp. S09G 359 |
| SBP00188 | Asian pear | *Pseudomonas* sp. S09G 359 |
| SBP00188 | Asian pear | *Pseudomonas* sp. StFLB209 |
| SBP00188 | Asian pear | *Pseudomonas* sp. StFLB209 |
| SBP00188 | Asian pear | *Pseudomonas* sp. SXM-1 |
| SBP00188 | Asian pear | *Pseudomonas* sp. SXM-1 |
| SBP00188 | Asian pear | *Pseudomonas* sp. TCU-HL1 |
| SBP00188 | Asian pear | *Pseudomonas* sp. TCU-HL1 |
| SBP00188 | Asian pear | *Pseudomonas* sp. URMO17WK12:I11 |
| SBP00188 | Asian pear | *Pseudomonas* sp. URMO17WK12:I11 |
| SBP00188 | Asian pear | *Pseudomonas* sp. UW4 |
| SBP00188 | Asian pear | *Pseudomonas* sp. UW4 |
| SBP00188 | Asian pear | *Pseudomonas* sp. Z003-0.4C(8344-21) |
| SBP00188 | Asian pear | *Pseudomonas* sp. Z003-0.4C(8344-21) |
| SBP00188 | Asian pear | *Pseudomonas stutzeri* |
| SBP00188 | Asian pear | *Pseudomonas stutzeri* |
| SBP00188 | Asian pear | *Pseudomonas synxantha* |
| SBP00188 | Asian pear | *Pseudomonas synxantha* |
| SBP00188 | Asian pear | *Pseudomonas syringae* |
| SBP00188 | Asian pear | *Pseudomonas syringae* |
| SBP00188 | Asian pear | *Pseudomonas syringae* group genomosp. 3 |
| SBP00188 | Asian pear | *Pseudomonas syringae* group genomosp. 3 |
| SBP00188 | Asian pear | *Pseudomonas taetrolens* |
| SBP00188 | Asian pear | *Pseudomonas taetrolens* |
| SBP00188 | Asian pear | *Pseudomonas tolaasii* |
| SBP00188 | Asian pear | *Pseudomonas tolaasii* |
| SBP00188 | Asian pear | *Pseudomonas trivialis* |
| SBP00188 | Asian pear | *Pseudomonas trivialis* |
| SBP00188 | Asian pear | *Pseudomonas umsongensis* |
| SBP00188 | Asian pear | *Pseudomonas umsongensis* |
| SBP00188 | Asian pear | *Pseudomonas vancouverensis* |
| SBP00188 | Asian pear | *Pseudomonas vancouverensis* |
| SBP00188 | Asian pear | *Pseudomonas veronii* |
| SBP00188 | Asian pear | *Pseudomonas veronii* |
| SBP00188 | Asian pear | *Pseudomonas versuta* |
| SBP00188 | Asian pear | *Pseudomonas versuta* |
| SBP00188 | Asian pear | *Pseudomonas viridiflava* |
| SBP00188 | Asian pear | *Pseudomonas viridiflava* |
| SBP00188 | Asian pear | *Pseudomonas yamanorum* |
| SBP00188 | Asian pear | *Pseudomonas yamanorum* |
| SBP00188 | Asian pear | *Pseudoxanthomonas spadix* |
| SBP00188 | Asian pear | *Pseudoxanthomonas spadix* |
| SBP00188 | Asian pear | *Pseudoxanthomonas suwonensis* |
| SBP00188 | Asian pear | *Pseudoxanthomonas suwonensis* |
| SBP00188 | Asian pear | *Psychrobacter alimentarius* |
| SBP00188 | Asian pear | *Psychrobacter alimentarius* |
| SBP00188 | Asian pear | *Rahnella aquatilis* |
| SBP00188 | Asian pear | *Rahnella aquatilis* |
| SBP00188 | Asian pear | *Rahnella* sp. ERMR1:05 |
| SBP00188 | Asian pear | *Rahnella* sp. ERMR1:05 |
| SBP00188 | Asian pear | *Ralstonia insidiosa* |
| SBP00188 | Asian pear | *Raistonia insidiosa* |
| SBP00188 | Asian pear | *Ralstonia mannitolilytica* |
| SBP00188 | Asian pear | *Ralstonia mannitolilytica* |
| SBP00188 | Asian pear | *Ralstonia pickettii* |

TABLE 3-continued

List of species identified in each metagenomic sample of each SBP Sample

| SBP ID | SBP Host Common Name | Genus sp. |
|---|---|---|
| SBP00188 | Asian pear | *Ralstonia pickettii* |
| SBP00188 | Asian pear | *Ralstonia solanacearum* |
| SBP00188 | Asian pear | *Ralstonia solanacearum* |
| SBP00188 | Asian pear | *Ramlibacter tataouinensis* |
| SBP00188 | Asian pear | *Ramlibacter tataouinensis* |
| SBP00188 | Asian pear | *Raoultella ornithinolytica* |
| SBP00188 | Asian pear | *Raoultella ornithinolytica* |
| SBP00188 | Asian pear | *Raoultella terrigena* |
| SBP00188 | Asian pear | *Raoultella terrigena* |
| SBP00188 | Asian pear | *Rathayibacter festucae* |
| SBP00188 | Asian pear | *Rathayibacter festucae* |
| SBP00188 | Asian pear | *Rhizobium etli* |
| SBP00188 | Asian pear | *Rhizobium etli* |
| SBP00188 | Asian pear | *Rhizobium favelukesii* |
| SBP00188 | Asian pear | *Rhizobium favelukesii* |
| SBP00188 | Asian pear | *Rhizobium jaguaris* |
| SBP00188 | Asian pear | *Rhizobium jaguaris* |
| SBP00188 | Asian pear | *Rhizobium leguminosarum* |
| SBP00188 | Asian pear | *Rhizobium leguminosarum* |
| SBP00188 | Asian pear | *Rhizobium* sp. 11515TR |
| SBP00188 | Asian pear | *Rhizobium* sp. 11515TR |
| SBP00188 | Asian pear | *Rhizobium* sp. ACO-34A |
| SBP00188 | Asian pear | *Rhizobium* sp. ACO-34A |
| SBP00188 | Asian pear | *Rhizobium* sp. NT-26 |
| SBP00188 | Asian pear | *Rhizobium* sp. NT-26 |
| SBP00188 | Asian pear | *Rhodococcus erythropolis* |
| SBP00188 | Asian pear | *Rhodococcus erythropolis* |
| SBP00188 | Asian pear | *Rhodococcus fascians* |
| SBP00188 | Asian pear | *Rhodococcus fascians* |
| SBP00188 | Asian pear | *Rhodococcus jostii* |
| SBP00188 | Asian pear | *Rhodococcus jostii* |
| SBP00188 | Asian pear | *Rhodococcus* sp. PBTS 2 |
| SBP00188 | Asian pear | *Rhodococcus* sp. PBTS 2 |
| SBP00188 | Asian pear | *Rhodopirellula baltica* |
| SBP00188 | Asian pear | *Rhodopirellula baltica* |
| SBP00188 | Asian pear | *Rhodopseudomonas palustris* |
| SBP00188 | Asian pear | *Rhodopseudomonas palustris* |
| SBP00188 | Asian pear | *Rivularia* sp. PCC 7116 |
| SBP00188 | Asian pear | *Rivularia* sp. PCC 7116 |
| SBP00188 | Asian pear | *Roseomonas gilardii* |
| SBP00188 | Asian pear | *Roseomonas gilardii* |
| SBP00188 | Asian pear | *Rubrivivax gelatinosus* |
| SBP00188 | Asian pear | *Rubrivivax gelatinosus* |
| SBP00188 | Asian pear | *Salinivibrio kushneri* |
| SBP00188 | Asian pear | *Salinivibrio kushneri* |
| SBP00188 | Asian pear | *Salmonella enterica* |
| SBP00188 | Asian pear | *Salmonella enterica* |
| SBP00188 | Asian pear | *Serratia fonticola* |
| SBP00188 | Asian pear | *Serratia fonticola* |
| SBP00188 | Asian pear | *Serratia liquefaciens* |
| SBP00188 | Asian pear | *Serratia liquefaciens* |
| SBP00188 | Asian pear | *Serratia marcescens* |
| SBP00188 | Asian pear | *Serratia marcescens* |
| SBP00188 | Asian pear | *Serratia odorifera* |
| SBP00188 | Asian pear | *Serratia odorifera* |
| SBP00188 | Asian pear | *Serratia plymuthica* |
| SBP00188 | Asian pear | *Serratia plymuthica* |
| SBP00188 | Asian pear | *Serratia rubidaea* |
| SBP00188 | Asian pear | *Serratia rubidaea* |
| SBP00188 | Asian pear | *Shewanella* sp. ANA-3 |
| SBP00188 | Asian pear | *Shewanella* sp. ANA-3 |
| SBP00188 | Asian pear | *Sorangium cellulosum* |
| SBP00188 | Asian pear | *Sorangium cellulosum* |
| SBP00188 | Asian pear | *Sphingobacterium mizutaii* |
| SBP00188 | Asian pear | *Sphingobacterium mizutaii* |
| SBP00188 | Asian pear | *Sphingobacterium* sp. B29 |
| SBP00188 | Asian pear | *Sphingobacterium* sp. B29 |
| SBP00188 | Asian pear | *Sphingobacterium* sp. G1-14 |
| SBP00188 | Asian pear | *Sphingobacterium* sp. G1-14 |
| SBP00188 | Asian pear | *Sphingobacterium thalpophilum* |
| SBP00188 | Asian pear | *Sphingobacterium thalpophilum* |
| SBP00188 | Asian pear | *Sphingobium amiense* |
| SBP00188 | Asian pear | *Sphingobium amiense* |
| SBP00188 | Asian pear | *Sphingobium baderi* |
| SBP00188 | Asian pear | *Sphingobium baderi* |
| SBP00188 | Asian pear | *Sphingobium cloacae* |

TABLE 3-continued

List of species identified in each metagenomic sample of each SBP Sample

| SBP ID | SBP Host Common Name | Genus sp. |
|---|---|---|
| SBP00188 | Asian pear | *Sphingobium cloacae* |
| SBP00188 | Asian pear | *Sphingobium hydrophobicum* |
| SBP00188 | Asian pear | *Sphingobium hydrophobicum* |
| SBP00188 | Asian pear | *Sphingobium* sp. EP60837 |
| SBP00188 | Asian pear | *Sphingobium* sp. EP60837 |
| SBP00188 | Asian pear | *Sphingobium* sp. LF-16 |
| SBP00188 | Asian pear | *Sphingobium* sp. LF-16 |
| SBP00188 | Asian pear | *Sphingobium* sp. MI1205 |
| SBP00188 | Asian pear | *Sphingobium* sp. MI1205 |
| SBP00188 | Asian pear | *Sphingobium* sp. RAC03 |
| SBP00188 | Asian pear | *Sphingobium* sp. RAC03 |
| SBP00188 | Asian pear | *Sphingobium* sp. SYK-6 |
| SBP00188 | Asian pear | *Sphingobium* sp. SYK-6 |
| SBP00188 | Asian pear | *Sphingobium* sp. TK5 |
| SBP00188 | Asian pear | *Sphingobium* sp. TK5 |
| SBP00188 | Asian pear | *Sphingobium* sp. YG1 |
| SBP00188 | Asian pear | *Sphingobium* sp. YG1 |
| SBP00188 | Asian pear | *Sphingobium yanoikuyae* |
| SBP00188 | Asian pear | *Sphingobium yanoikuyae* |
| SBP00188 | Asian pear | *Sphingomonas koreensis* |
| SBP00188 | Asian pear | *Sphingomonas koreensis* |
| SBP00188 | Asian pear | *Sphingomonas melonis* |
| SBP00188 | Asian pear | *Sphingomonas melonis* |
| SBP00188 | Asian pear | *Sphingomonas panacis* |
| SBP00188 | Asian pear | *Sphingomonas panacis* |
| SBP00188 | Asian pear | *Sphingomonas paucimobilis* |
| SBP00188 | Asian pear | *Sphingomonas paucimobilis* |
| SBP00188 | Asian pear | *Sphingomonas sanxanigenens* |
| SBP00188 | Asian pear | *Sphingomonas sanxanigenens* |
| SBP00188 | Asian pear | *Sphingomonas* sp. AAP5 |
| SBP00188 | Asian pear | *Sphingomonas* sp. AAP5 |
| SBP00188 | Asian pear | *Sphingomonas* sp. Cra20 |
| SBP00188 | Asian pear | *Sphingomonas* sp. Cra20 |
| SBP00188 | Asian pear | *Sphingomonas* sp. FARSPH |
| SBP00188 | Asian pear | *Sphingomonas* sp. FARSPH |
| SBP00188 | Asian pear | *Sphingomonas* sp. LK11 |
| SBP00188 | Asian pear | *Sphingomonas* sp. LK11 |
| SBP00188 | Asian pear | *Sphingomonas* sp. LM7 |
| SBP00188 | Asian pear | *Sphingomonas* sp. LM7 |
| SBP00188 | Asian pear | *Sphingomonas* sp. MM-1 |
| SBP00188 | Asian pear | *Sphingomonas* sp. MM-1 |
| SBP00188 | Asian pear | *Sphingomonas* sp. NIC1 |
| SBP00188 | Asian pear | *Sphingomonas* sp. NIC1 |
| SBP00188 | Asian pear | *Sphingomonas taxi* |
| SBP00188 | Asian pear | *Sphingomonas taxi* |
| SBP00188 | Asian pear | *Sphingopyxis macrogoltabida* |
| SBP00188 | Asian pear | *Sphingopyxis macrogoltabida* |
| SBP00188 | Asian pear | *Sphingopyxis* sp. 113P3 |
| SBP00188 | Asian pear | *Sphingopyxis* sp. 113P3 |
| SBP00188 | Asian pear | *Sphingosinicella* sp. BN140058 |
| SBP00188 | Asian pear | *Sphingosinicella* sp. BN140058 |
| SBP00188 | Asian pear | *Staphylococcus aureus* |
| SBP00188 | Asian pear | *Staphylococcus aureus* |
| SBP00188 | Asian pear | *Stella humosa* |
| SBP00188 | Asian pear | *Stella humosa* |
| SBP00188 | Asian pear | *Stenotrophomonas acidaminiphila* |
| SBP00188 | Asian pear | *Stenotrophomonas acidaminiphila* |
| SBP00188 | Asian pear | *Stenotrophomonas maltophilia* |
| SBP00188 | Asian pear | *Stenotrophomonas maltophilia* |
| SBP00188 | Asian pear | *Stenotrophomonas rhizophila* |
| SBP00188 | Asian pear | *Stenotrophomonas rhizophila* |
| SBP00188 | Asian pear | *Stenotrophomonas* sp. |
| SBP00188 | Asian pear | *Stenotrophomonas* sp. |
| SBP00188 | Asian pear | *Stenotrophomonas* sp. ESTM1D_MKCIP4_1 |
| SBP00188 | Asian pear | *Stenotrophomonas* sp. ESTM1D_MKCIP4_1 |
| SBP00188 | Asian pear | *Stenotrophomonas* sp. G4 |
| SBP00188 | Asian pear | *Stenotrophomonas* sp. G4 |
| SBP00188 | Asian pear | *Stenotrophomonas* sp. LM091 |
| SBP00188 | Asian pear | *Stenotrophomonas* sp. LM091 |
| SBP00188 | Asian pear | *Stenotrophomonas* sp. MYb57 |
| SBP00188 | Asian pear | *Stenotrophomonas* sp. MYb57 |
| SBP00188 | Asian pear | *Stenotrophomonas* sp. Pemsol |
| SBP00188 | Asian pear | *Stenotrophomonas* sp. Pemsol |
| SBP00188 | Asian pear | *Stenotrophomonas* sp. SAU14A_NAIMI4_5 |
| SBP00188 | Asian pear | *Stenotrophomonas* sp. SAU14A_NAIMI4_5 |
| SBP00188 | Asian pear | *Stenotrophomonas* sp. SAU14A_NAIMI4_8 |

TABLE 3-continued

List of species identified in each metagenomic sample of each SBP Sample

| SBP ID | SBP Host Common Name | Genus sp. |
|---|---|---|
| SBP00188 | Asian pear | Stenotrophomonas sp. SAU14A_NAIMI4_8 |
| SBP00188 | Asian pear | Stenotrophomonas sp. WZN-1 |
| SBP00188 | Asian pear | Stenotrophomonas sp. WZN-1 |
| SBP00188 | Asian pear | Stenotrophomonas sp. YAU14A_MKIMI4_1 |
| SBP00188 | Asian pear | Stenotrophomonas sp. YAU14A_MKIMI4_1 |
| SBP00188 | Asian pear | Stenotrophomonas sp. YAU14D1_LEIMI4_1 |
| SBP00188 | Asian pear | Stenotrophomonas sp. YAU14D1_LEIMI4_1 |
| SBP00188 | Asian pear | Stenotrophomonas sp. ZAC14A_NAIMI4_1 |
| SBP00188 | Asian pear | Stenotrophomonas sp. ZAC14A_NAIMI4_1 |
| SBP00188 | Asian pear | Stenotrophomonas sp. ZAC14D2_NAIMI4_6 |
| SBP00188 | Asian pear | Stenotrophomonas sp. ZAC14D2_NAIMI4_6 |
| SBP00188 | Asian pear | Stenotrophomonas sp. ZAC14D2_NAIMI4_7 |
| SBP00188 | Asian pear | Stenotrophomonas sp. ZAC14D2_NAIMI4_7 |
| SBP00188 | Asian pear | Streptococcus gordonii |
| SBP00188 | Asian pear | Streptococcus gordonii |
| SBP00188 | Asian pear | Streptococcus pyogenes |
| SBP00188 | Asian pear | Streptococcus pyogenes |
| SBP00188 | Asian pear | Streptococcus sp. HSISS3 |
| SBP00188 | Asian pear | Streptococcus sp. HSISS3 |
| SBP00188 | Asian pear | Streptomyces albus |
| SBP00188 | Asian pear | Streptomyces albus |
| SBP00188 | Asian pear | Streptomyces anulatus |
| SBP00188 | Asian pear | Streptomyces anulatus |
| SBP00188 | Asian pear | Streptomyces griseoviridis |
| SBP00188 | Asian pear | Streptomyces griseoviridis |
| SBP00188 | Asian pear | Streptosporangium sp. 'caverna' |
| SBP00188 | Asian pear | Streptosporangium sp. 'caverna' |
| SBP00188 | Asian pear | Tatumella ptyseos |
| SBP00188 | Asian pear | Tatumella ptyseos |
| SBP00188 | Asian pear | Terriglobus roseus |
| SBP00188 | Asian pear | Terriglobus roseus |
| SBP00188 | Asian pear | Thermomicrobium roseum |
| SBP00188 | Asian pear | Thermomicrobium roseum |
| SBP00188 | Asian pear | Variovorax boronicumulans |
| SBP00188 | Asian pear | Variovorax boronicumulans |
| SBP00188 | Asian pear | Variovorax paradoxus |
| SBP00188 | Asian pear | Variovorax paradoxus |
| SBP00188 | Asian pear | Variovorax sp. PAMC 28711 |
| SBP00188 | Asian pear | Variovorax sp. PAMC 28711 |
| SBP00188 | Asian pear | Vibrio alginolyticus |
| SBP00188 | Asian pear | Vibrio alginolyticus |
| SBP00188 | Asian pear | Winogradskyella sp. J14-2 |
| SBP00188 | Asian pear | Winogradskyella sp. J14-2 |
| SBP00188 | Asian pear | Xanthomonas campestris |
| SBP00188 | Asian pear | Xanthomonas campestris |
| SBP00188 | Asian pear | Xanthomonas cassavae |
| SBP00188 | Asian pear | Xanthomonas cassavae |
| SBP00188 | Asian pear | Xanthomonas oryzae |
| SBP00188 | Asian pear | Xanthomonas oryzae |
| SBP00188 | Asian pear | Xanthomonas sacchari |
| SBP00188 | Asian pear | Xanthomonas sacchari |
| SBP00188 | Asian pear | Xanthomonas translucens |
| SBP00188 | Asian pear | Xanthomonas translucens |
| SBP00188 | Asian pear | Xanthomonas vesicatoria |
| SBP00188 | Asian pear | Xanthomonas vesicatoria |
| SBP00188 | Asian pear | Yersinia aleksiciae |
| SBP00188 | Asian pear | Yersinia aleksiciae |
| SBP00188 | Asian pear | Yersinia enterocolitica |
| SBP00188 | Asian pear | Yersinia enterocolitica |
| SBP00201 | Purple cauliflower | Acinetobacter johnsonii |
| SBP00201 | Purple cauliflower | Bacillus amyloliquefaciens |
| SBP00201 | Purple cauliflower | Bacillus sp. (in: Bacteria) |
| SBP00201 | Purple cauliflower | Bacillus subtilis |
| SBP00201 | Purple cauliflower | Bacillus velezensis |
| SBP00201 | Purple cauliflower | Bradyrhizobium sp. BTAi1 |
| SBP00201 | Purple cauliflower | Bradyrhizobium sp. SK17 |
| SBP00201 | Purple cauliflower | Cupriavidus metallidurans |
| SBP00201 | Purple cauliflower | Delftia tsuruhatensis |
| SBP00201 | Purple cauliflower | Enterobacter cloacae |
| SBP00201 | Purple cauliflower | Ereboglobus luteus |
| SBP00201 | Purple cauliflower | Fuerstia marisgermanicae |
| SBP00201 | Purple cauliflower | Janthinobacterium agaricidamnosum |
| SBP00201 | Purple cauliflower | Janthinobacterium sp. 1_2014MBL_MicDiv |
| SBP00201 | Purple cauliflower | Janthinobacterium svalbardensis |
| SBP00201 | Purple cauliflower | Leclercia adecarboxylata |
| SBP00201 | Purple cauliflower | Novibacillus thermophilus |

TABLE 3-continued

List of species identified in each metagenomic sample of each SBP Sample

| SBP ID | SBP Host Common Name | Genus sp. |
|---|---|---|
| SBP00201 | Purple cauliflower | *Pantoea agglomerans* |
| SBP00201 | Purple cauliflower | *Photobacterium damselae* |
| SBP00201 | Purple cauliflower | *Pseudomonas fluorescens* |
| SBP00201 | Purple cauliflower | *Pseudomonas granadensis* |
| SBP00201 | Purple cauliflower | *Pseudomonas koreensis* |
| SBP00201 | Purple cauliflower | *Pseudomonas libanensis* |
| SBP00201 | Purple cauliflower | *Pseudomonas* sp. |
| SBP00201 | Purple cauliflower | *Pseudomonas* sp. FDAARGOS_380 |
| SBP00201 | Purple cauliflower | *Pseudomonas* sp. 2003-0.4C(8344-21) |
| SBP00201 | Purple cauliflower | *Ralstonia insidiosa* |
| SBP00201 | Purple cauliflower | *Ralstonia mannitolilytica* |
| SBP00201 | Purple cauliflower | *Ralstonia pickettii* |
| SBP00201 | Purple cauliflower | *Serratia marcescens* |
| SBP00201 | Purple cauliflower | *Sphingobacteriaceae bacterium* GW460-11-11-14-LB5 |
| SBP00201 | Purple cauliflower | *Stenotrophomonas maltophilia* |
| SBP00202 | White cauliflower | *Acidovorax* sp. KKS102 |
| SBP00202 | White cauliflower | *Acinetobacter johnsonii* |
| SBP00202 | White cauliflower | *Amycolatopsis albispora* |
| SBP00202 | White cauliflower | *Bacillus amyloliquefaciens* |
| SBP00202 | White cauliflower | *Bacillus megaterium* |
| SBP00202 | White cauliflower | *Bacillus* sp. (in: Bacteria) |
| SBP00202 | White cauliflower | *Bacillus* sp. FJAT-45348 |
| SBP00202 | White cauliflower | *Bacillus subtilis* |
| SBP00202 | White cauliflower | *Bradyrhizobium* sp. BTAi1 |
| SBP00202 | White cauliflower | *Burkholderia contaminans* |
| SBP00202 | White cauliflower | *Cupriavidus metallidurans* |
| SBP00202 | White cauliflower | *Cupriavidus taiwanensis* |
| SBP00202 | White cauliflower | *Cutibacterium acnes* |
| SBP00202 | White cauliflower | *Cyanothece* sp. PCC 7424 |
| SBP00202 | White cauliflower | *Delftia* sp. |
| SBP00202 | White cauliflower | *Delftia tsuruhatensis* |
| SBP00202 | White cauliflower | *Enterobacter cloacae* |
| SBP00202 | White cauliflower | *Ereboglobus luteus* |
| SBP00202 | White cauliflower | *Erwinia amylovora* |
| SBP00202 | White cauliflower | *Erwinia* sp. |
| SBP00202 | White cauliflower | *Fuerstia marisgermanicae* |
| SBP00202 | White cauliflower | *Janthinobacterium agaricidamnosum* |
| SBP00202 | White cauliflower | *Janthinobacterium* sp. 1_2014MBL_MicDiv |
| SBP00202 | White cauliflower | *Janthinobacterium* sp. LM6 |
| SBP00202 | White cauliflower | *Janthinobacterium svalbardensis* |
| SBP00202 | White cauliflower | *Lachnospiraceae bacterium* GAM79 |
| SBP00202 | White cauliflower | *Leclercia adecarboxylata* |
| SBP00202 | White cauliflower | *Massilia albidiflava* |
| SBP00202 | White cauliflower | *Massilia lutea* |
| SBP00202 | White cauliflower | *Massilia oculi* |
| SBP00202 | White cauliflower | *Massilia* sp. NR 4-1 |
| SBP00202 | White cauliflower | *Massilia* sp. WG5 |
| SBP00202 | White cauliflower | *Massilia violaceinigra* |
| SBP00202 | White cauliflower | *Micromonas pusilla* virus 12T |
| SBP00202 | White cauliflower | *Pandoraea pnomenusa* |
| SBP00202 | White cauliflower | *Pantoea agglomerans* |
| SBP00202 | White cauliflower | *Paraburkholderia phymatum* |
| SBP00202 | White cauliflower | *Paracoccus* sp. Arc7-R13 |
| SBP00202 | White cauliflower | *Photobacterium damselae* |
| SBP00202 | White cauliflower | *Planococcus rifietoensis* |
| SBP00202 | White cauliflower | *Pseudoalteromonas* sp. SM9913 |
| SBP00202 | White cauliflower | *Pseudomonas azotoformans* |
| SBP00202 | White cauliflower | *Pseudomonas chlororaphis* |
| SBP00202 | White cauliflower | *Pseudomonas fluorescens* |
| SBP00202 | White cauliflower | *Pseudomonas granadensis* |
| SBP00202 | White cauliflower | *Pseudomonas koreensis* |
| SBP00202 | White cauliflower | *Pseudomonas libanensis* |
| SBP00202 | White cauliflower | *Pseudomonas moraviensis* |
| SBP00202 | White cauliflower | *Pseudomonas orientalis* |
| SBP00202 | White cauliflower | *Pseudomonas poae* |
| SBP00202 | White cauliflower | *Pseudomonas putida* |
| SBP00202 | White cauliflower | *Pseudomonas rhizosphaerae* |
| SBP00202 | White cauliflower | *Pseudomonas silesiensis* |
| SBP00202 | White cauliflower | *Pseudomonas* sp. |
| SBP00202 | White cauliflower | *Pseudomonas* sp. A214 |
| SBP00202 | White cauliflower | *Pseudomonas* sp. B10 |
| SBP00202 | White cauliflower | *Pseudomonas* sp. FDAARGOS_380 |
| SBP00202 | White cauliflower | *Pseudomonas* sp. R5-89-07 |
| SBP00202 | White cauliflower | *Pseudomonas stutzeri* |
| SBP00202 | White cauliflower | *Pseudomonas syringae* |
| SBP00202 | White cauliflower | *Pseudomonas viridiflava* |

TABLE 3-continued

List of species identified in each metagenomic sample of each SBP Sample

| SBP ID | SBP Host Common Name | Genus sp. |
|---|---|---|
| SBP00202 | White cauliflower | Ralstonia insidiosa |
| SBP00202 | White cauliflower | Ralstonia mannitolilytica |
| SBP00202 | White cauliflower | Ralstonia pickettii |
| SBP00202 | White cauliflower | Ralstonia solanacearum |
| SBP00202 | White cauliflower | Rhodopseudomonas palustris |
| SBP00202 | White cauliflower | Sandaracinus amylolyticus |
| SBP00202 | White cauliflower | Serratia marcescens |
| SBP00202 | White cauliflower | Sphingobacteriaceae bacterium GW460-11-11-14-LBS |
| SBP00202 | White cauliflower | Sphingomonas melonis |
| SBP00202 | White cauliflower | Sphingomonas sp. Cra20 |
| SBP00202 | White cauliflower | Sphingomonas sp. FARSPH |
| SBP00202 | White cauliflower | Sphingomonas sp. LK11 |
| SBP00202 | White cauliflower | Sphingomonas sp. NIC1 |
| SBP00202 | White cauliflower | Sphingomonas taxi |
| SBP00202 | White cauliflower | Staphylococcus aureus |
| SBP00202 | White cauliflower | Stenotrophomonas maltophilia |
| SBP00202 | White cauliflower | Stenotrophomonas sp. ZAC14A_NAIMI4_1 |
| SBP00202 | White cauliflower | Yersinia massiliensis |
| SBP00205 | Arugula | [Brevibacterium] frigoritolerans |
| SBP00205 | Arugula | [Clostridium] cellulosi |
| SBP00205 | Arugula | [Clostridium] saccharolyticum |
| SBP00205 | Arugula | [Clostridium] ultunense |
| SBP00205 | Arugula | [Polyangium] brachysporum |
| SBP00205 | Arugula | Acanthamoeba polyphaga moumouvirus |
| SBP00205 | Arugula | Acanthocystis turfacea chlorella virus 1 |
| SBP00205 | Arugula | Acholeplasma axanthum |
| SBP00205 | Arugula | Achromobacter insolitus |
| SBP00205 | Arugula | Achromobacter spanius |
| SBP00205 | Arugula | Achromobacter xylosoxidans |
| SBP00205 | Arugula | Acidianus brierleyi |
| SBP00205 | Arugula | Acidihalobacter ferrooxidans |
| SBP00205 | Arugula | Acidithiobacillus ferridurans |
| SBP00205 | Arugula | Acidovorax sp. KKS102 |
| SBP00205 | Arugula | Acinetobacter baumannii |
| SBP00205 | Arugula | Acinetobacter bereziniae |
| SBP00205 | Arugula | Acinetobacter calcoaceticus |
| SBP00205 | Arugula | Acinetobacter guillouiae |
| SBP00205 | Arugula | Acinetobacter johnsonii |
| SBP00205 | Arugula | Acinetobacter lwoffii |
| SBP00205 | Arugula | Acinetobacter sp. TTH0-4 |
| SBP00205 | Arugula | Acinetobacter ursingii |
| SBP00205 | Arugula | Actinobacteria bacterium IMCC26103 |
| SBP00205 | Arugula | Actinomyces howellii |
| SBP00205 | Arugula | Actinomyces pacaensis |
| SBP00205 | Arugula | Actinoplanes sp. ATCC 31351 |
| SBP00205 | Arugula | Actinoplanes sp. N902-109 |
| SBP00205 | Arugula | Actinoplanes sp. OR16 |
| SBP00205 | Arugula | Aeromonas hydrophila |
| SBP00205 | Arugula | Aeromonas media |
| SBP00205 | Arugula | Aeromonas rivipollensis |
| SBP00205 | Arugula | Aeromonas schubertii |
| SBP00205 | Arugula | Aeromonas sp. |
| SBP00205 | Arugula | Aeromonas veronii |
| SBP00205 | Arugula | Agarivorans gilvus |
| SBP00205 | Arugula | Agrobacterium fabrum |
| SBP00205 | Arugula | Agrobacterium larrymoorei |
| SBP00205 | Arugula | Agrobacterium sp. |
| SBP00205 | Arugula | Agrobacterium tumefaciens |
| SBP00205 | Arugula | Agrobacterium vitis |
| SBP00205 | Arugula | Algibacter alginicilyticus |
| SBP00205 | Arugula | Alkalitalea saponilacus |
| SBP00205 | Arugula | Alloactinosynnema sp. L-07 |
| SBP00205 | Arugula | Allokutzneria albata |
| SBP00205 | Arugula | Alteromonas mediterranea |
| SBP00205 | Arugula | Amycolatopsis japonica |
| SBP00205 | Arugula | Amycolatopsis keratiniphila |
| SBP00205 | Arugula | Amycolatopsis methanolica |
| SBP00205 | Arugula | Amycolatopsis orientalis |
| SBP00205 | Arugula | Aquiflexum balticum |
| SBP00205 | Arugula | Aquimarina sp. BL5 |
| SBP00205 | Arugula | Archangium gephyra |
| SBP00205 | Arugula | Arcobacter bivalviorum |
| SBP00205 | Arugula | Arcobacter butzleri |
| SBP00205 | Arugula | Arcobacter cryaerophilus |
| SBP00205 | Arugula | Arcobacter sp. L |
| SBP00205 | Arugula | Arthrobacter crystallopoietes |

TABLE 3-continued

List of species identified in each metagenomic sample of each SBP Sample

| SBP ID | SBP Host Common Name | Genus sp. |
|---|---|---|
| SBP00205 | Arugula | *Arthrobacter* sp. FB24 |
| SBP00205 | Arugula | *Arthrobacter* sp. PGP41 |
| SBP00205 | Arugula | *Arthrobacter* sp. QXT-31 |
| SBP00205 | Arugula | *Arthrobacter* sp. Rue61a |
| SBP00205 | Arugula | *Arthrobacter* sp. U41 |
| SBP00205 | Arugula | *Arthrobacter* sp. YC-RL1 |
| SBP00205 | Arugula | *Arthrobacter* sp. YN |
| SBP00205 | Arugula | *Azospirillum brasilense* |
| SBP00205 | Arugula | *Azospirillum lipoferum* |
| SBP00205 | Arugula | *Bacillus altitudinis* |
| SBP00205 | Arugula | *Bacillus amyloliquefaciens* |
| SBP00205 | Arugula | *Bacillus cereus* |
| SBP00205 | Arugula | *Bacillus ciccensis* |
| SBP00205 | Arugula | *Bacillus circulans* |
| SBP00205 | Arugula | *Bacillus flexus* |
| SBP00205 | Arugula | *Bacillus halotolerans* |
| SBP00205 | Arugula | *Bacillus horikoshii* |
| SBP00205 | Arugula | *Bacillus megaterium* |
| SBP00205 | Arugula | *Bacillus mesonae* |
| SBP00205 | Arugula | *Bacillus muralis* |
| SBP00205 | Arugula | *Bacillus mycoides* |
| SBP00205 | Arugula | *Bacillus pseudomycoides* |
| SBP00205 | Arugula | *Bacillus pumilus* |
| SBP00205 | Arugula | *Bacillus safensis* |
| SBP00205 | Arugula | *Bacillus* sp. (in: Bacteria) |
| SBP00205 | Arugula | *Bacillus subtilis* |
| SBP00205 | Arugula | *Bacillus thuringiensis* |
| SBP00205 | Arugula | *Bacillus velezensis* |
| SBP00205 | Arugula | *Bacteroides cellulosilyticus* |
| SBP00205 | Arugula | Bat associated circovirus 4 |
| SBP00205 | Arugula | *Bdellovibrio bacteriovorus* |
| SBP00205 | Arugula | *Bernardetia litoralis* |
| SBP00205 | Arugula | *Bifidobacterium longum* |
| SBP00205 | Arugula | blood disease bacterium A2-HR MARDI |
| SBP00205 | Arugula | *Bordetella* genomosp. 8 |
| SBP00205 | Arugula | *Bosea* sp. Tri-49 |
| SBP00205 | Arugula | *Bougainvillea* chlorotic vein banding virus |
| SBP00205 | Arugula | *Brachybacterium saurashtrense* |
| SBP00205 | Arugula | *Brachybacterium* sp. VR2415 |
| SBP00205 | Arugula | *Bradyrhizobiaceae* bacterium SG-6C |
| SBP00205 | Arugula | *Bradyrhizobium diazoefficiens* |
| SBP00205 | Arugula | *Bradyrhizobium erythrophlei* |
| SBP00205 | Arugula | *Bradyrhizobium oligotrophicum* |
| SBP00205 | Arugula | *Bradyrhizobium* sp. BTAi1 |
| SBP00205 | Arugula | *Bradyrhizobium* sp. ORS 278 |
| SBP00205 | Arugula | *Bradyrhizobium* sp. S23321 |
| SBP00205 | Arugula | *Bradyrhizobium* sp. SK17 |
| SBP00205 | Arugula | *Brevibacillus brevis* |
| SBP00205 | Arugula | *Brevibacillus formosus* |
| SBP00205 | Arugula | *Brevundimonas* sp. LM2 |
| SBP00205 | Arugula | *Buchnera aphidicola* |
| SBP00205 | Arugula | *Burkholderia ambifaria* |
| SBP00205 | Arugula | *Burkholderia cenocepacia* |
| SBP00205 | Arugula | *Burkholderia lata* |
| SBP00205 | Arugula | *Burkholderia plantarii* |
| SBP00205 | Arugula | *Burkholderia thailandensis* |
| SBP00205 | Arugula | *Burkholderia ubonensis* |
| SBP00205 | Arugula | *Burkholderiales* bacterium JOSHI_001 |
| SBP00205 | Arugula | *Caldicellulosiruptor obsidiansis* |
| SBP00205 | Arugula | *Caldilinea aerophila* |
| SBP00205 | Arugula | *Calothrix parasitica* |
| SBP00205 | Arugula | *Calothrix parietina* |
| SBP00205 | Arugula | *Calothrix* sp. 336/3 |
| SBP00205 | Arugula | *Calothrix* sp. NIES-2100 |
| SBP00205 | Arugula | *Calothrix* sp. PCC 7507 |
| SBP00205 | Arugula | *Campylobacter concisus* |
| SBP00205 | Arugula | *Campylobacter lari* |
| SBP00205 | Arugula | *Campylobacter pinnipediorum* |
| SBP00205 | Arugula | *Candidatus* Nitrosocosmicus franklandus |
| SBP00205 | Arugula | *Candidatus* Nucleicultrix amoebiphila |
| SBP00205 | Arugula | *Candidatus* Paracaedibacter acanthamoebae |
| SBP00205 | Arugula | *Candidatus* Promineofilum breve |
| SBP00205 | Arugula | *Candidatus* Protochlamydia naegleriophila |
| SBP00205 | Arugula | *Candidatus* Rhodoluna limnophila |
| SBP00205 | Arugula | *Candidatus* Thiodictyon syntrophicum |
| SBP00205 | Arugula | *Carboxydocella thermautotrophica* |

TABLE 3-continued

List of species identified in each metagenomic sample of each SBP Sample

| SBP ID | SBP Host Common Name | Genus sp. |
|---|---|---|
| SBP00205 | Arugula | *Carnobacterium divergens* |
| SBP00205 | Arugula | *Carnobacterium* sp. 17-4 |
| SBP00205 | Arugula | *Caulobacter phage* Percy |
| SBP00205 | Arugula | *Caulobacter* sp. FWC26 |
| SBP00205 | Arugula | *Caulobacter vibrioides* |
| SBP00205 | Arugula | *Cedecea neteri* |
| SBP00205 | Arugula | *Celeribacter ethanolicus* |
| SBP00205 | Arugula | *Cellulophaga baltica* |
| SBP00205 | Arugula | *Chondromyces crocatus* |
| SBP00205 | Arugula | *Chromobacterium* sp. ATCC 53434 |
| SBP00205 | Arugula | *Chryseobacterium arthrosphaerae* |
| SBP00205 | Arugula | *Chryseobacterium bernardetii* |
| SBP00205 | Arugula | *Chryseobacterium gleum* |
| SBP00205 | Arugula | *Chryseobacterium indoltheticum* |
| SBP00205 | Arugula | *Chryseobacterium shandongense* |
| SBP00205 | Arugula | *Chryseobacterium* sp. F5649 |
| SBP00205 | Arugula | *Chryseobacterium* sp. IHB 8 17019 |
| SBP00205 | Arugula | *Chryseobacterium* sp. StRB126 |
| SBP00205 | Arugula | *Chrysochromulina ericina* virus |
| SBP00205 | Arugula | *Citrobacter freundii* |
| SBP00205 | Arugula | *Citrobacter werkmanii* |
| SBP00205 | Arugula | *Clavibacter michiganensis* |
| SBP00205 | Arugula | *Clostridiaceae bacterium* 14S0207 |
| SBP00205 | Arugula | *Clostridioides difficile* |
| SBP00205 | Arugula | *Clostridium acetobutylicum* |
| SBP00205 | Arugula | *Clostridium baratii* |
| SBP00205 | Arugula | *Clostridium beijerinckii* |
| SBP00205 | Arugula | *Clostridium botulinum* |
| SBP00205 | Arugula | *Clostridium butyricum* |
| SBP00205 | Arugula | *Clostridium chauvoei* |
| SBP00205 | Arugula | *Clostridium novyi* |
| SBP00205 | Arugula | *Clostridium pasteurianum* |
| SBP00205 | Arugula | *Clostridium perfringens* |
| SBP00205 | Arugula | *Clostridium* sp. AWRP |
| SBP00205 | Arugula | *Clostridium* sp. CT4 |
| SBP00205 | Arugula | *Clostridium taeniosporum* |
| SBP00205 | Arugula | *Clostridium tetani* |
| SBP00205 | Arugula | *Clostridium tyrobutyricum* |
| SBP00205 | Arugula | *Collimonas fungivorans* |
| SBP00205 | Arugula | *Colwellia* sp. PAMC 20917 |
| SBP00205 | Arugula | *Comamonas testosteroni* |
| SBP00205 | Arugula | *Conexibacter woesei* |
| SBP00205 | Arugula | *Corynebacterium glutamicum* |
| SBP00205 | Arugula | *Corynebacterium variabile* |
| SBP00205 | Arugula | *Corynebacterium xerosis* |
| SBP00205 | Arugula | *Cryobacterium* sp. LW097 |
| SBP00205 | Arugula | *Cupriavidus metallidurans* |
| SBP00205 | Arugula | *Cupriavidus oxalaticus* |
| SBP00205 | Arugula | *Cupriavidus pinatubonensis* |
| SBP00205 | Arugula | *Cupriavidus taiwanensis* |
| SBP00205 | Arugula | *Curtobacterium* sp. BH-2-1-1 |
| SBP00205 | Arugula | *Cutibacterium acnes* |
| SBP00205 | Arugula | *Cyanobacterium aponinum* |
| SBP00205 | Arugula | *Cyclobacterium marinum* |
| SBP00205 | Arugula | *Cyprinid* herpesvirus 2 |
| SBP00205 | Arugula | *Deferribacter desulfuricans* |
| SBP00205 | Arugula | *Delftia* sp. |
| SBP00205 | Arugula | *Delftia tsuruhatensis* |
| SBP00205 | Arugula | *Desulfobacula toluolica* |
| SBP00205 | Arugula | *Desulfohalobium retbaense* |
| SBP00205 | Arugula | *Desulfotomaculum ruminis* |
| SBP00205 | Arugula | *Desulfuromonas soudanensis* |
| SBP00205 | Arugula | *Devosia* sp. I507 |
| SBP00205 | Arugula | *Dietzia* sp. JS16-p6b |
| SBP00205 | Arugula | *Dinoroseobacter shibae* |
| SBP00205 | Arugula | *Eikenella corrodens* |
| SBP00205 | Arugula | *Ensifer adhaerens* |
| SBP00205 | Arugula | *Enterobacter cloacae* |
| SBP00205 | Arugula | *Enterobacter hormaechei* |
| SBP00205 | Arugula | *Enterobacter ludwigii* |
| SBP00205 | Arugula | *Enterobacter* sp. N18-03635 |
| SBP00205 | Arugula | *Enterobacteriaceae bacterium* ENNIH1 |
| SBP00205 | Arugula | *Enterococcus faecalis* |
| SBP00205 | Arugula | *Enterococcus mundtii* |
| SBP00205 | Arugula | *Enterococcus wangshanyuanii* |
| SBP00205 | Arugula | *Ereboglobus luteus* |

TABLE 3-continued

List of species identified in each metagenomic sample of each SBP Sample

| SBP ID | SBP Host Common Name | Genus sp. |
| --- | --- | --- |
| SBP00205 | Arugula | *Erwinia amylovora* |
| SBP00205 | Arugula | *Erwinia gerundensis* |
| SBP00205 | Arugula | *Erwinia persicina* |
| SBP00205 | Arugula | *Erwinia* sp. |
| SBP00205 | Arugula | *Erysipelothrix rhusiopathiae* |
| SBP00205 | Arugula | *Erythrobacter atlanticus* |
| SBP00205 | Arugula | *Escherichia coli* |
| SBP00205 | Arugula | *Escherichia fergusonii* |
| SBP00205 | Arugula | *Ethanoligenens harbinense* |
| SBP00205 | Arugula | *Euzebya* sp. DY32-46 |
| SBP00205 | Arugula | *Exiguobacterium antarcticum* |
| SBP00205 | Arugula | *Exiguobacterium sibiricum* |
| SBP00205 | Arugula | *Exiguobacterium* sp. AT1b |
| SBP00205 | Arugula | *Exiguobacterium* sp. MH3 |
| SBP00205 | Arugula | *Exiguobacterium* sp. N4-1P |
| SBP00205 | Arugula | *Exiguobacterium* sp. U13-1 |
| SBP00205 | Arugula | *Exiguobacterium* sp. ZWU0009 |
| SBP00205 | Arugula | *Faecalibacterium prausnitzii* |
| SBP00205 | Arugula | *Ferroglobus placidus* |
| SBP00205 | Arugula | *Fibrella* sp. ES10-3-2-2 |
| SBP00205 | Arugula | *Filifactor alocis* |
| SBP00205 | Arugula | *Filimonas lacunae* |
| SBP00205 | Arugula | *Finegoldia magna* |
| SBP00205 | Arugula | *Fischerella* sp. NIES-4106 |
| SBP00205 | Arugula | *Flammeovirga* sp. L12M1 |
| SBP00205 | Arugula | *Flammeovirga* sp. MY04 |
| SBP00205 | Arugula | *Flavisolibacter* sp. 17J28-1 |
| SBP00205 | Arugula | *Flavobacteriaceae bacterium* MAR_2010_188 |
| SBP00205 | Arugula | *Flavobacteriaceae bacterium* UJ101 |
| SBP00205 | Arugula | *Flavobacterium columnare* |
| SBP00205 | Arugula | *Flavobacterium crocinum* |
| SBP00205 | Arugula | *Flavobacterium gilvum* |
| SBP00205 | Arugula | *Flavobacterium* sp. CJ74 |
| SBP00205 | Arugula | *Fluviicola taffensis* |
| SBP00205 | Arugula | *Formosa agariphila* |
| SBP00205 | Arugula | *Formosa* sp. Hel3_A1_48 |
| SBP00205 | Arugula | *Francisella hispaniensis* |
| SBP00205 | Arugula | *Francisella* sp. CA97-1460 |
| SBP00205 | Arugula | *Frankia* sp. QA3 |
| SBP00205 | Arugula | *Frondihabitans* sp. PAMC 28766 |
| SBP00205 | Arugula | *Fuerstia marisgermanicae* |
| SBP00205 | Arugula | *Fusobacterium mortiferum* |
| SBP00205 | Arugula | *Fusobacterium necrophorum* |
| SBP00205 | Arugula | *Fusobacterium nucleatum* |
| SBP00205 | Arugula | *Fusobacterium ulcerans* |
| SBP00205 | Arugula | *Fusobacterium varium* |
| SBP00205 | Arugula | *Gardnerella vaginalis* |
| SBP00205 | Arugula | *Gemmata obscuriglobus* |
| SBP00205 | Arugula | *Gemmatirosa kalamazoonesis* |
| SBP00205 | Arugula | *Geobacillus* sp. JS12 |
| SBP00205 | Arugula | *Glaciecola* sp. 4H-3-7 + YE-5 |
| SBP00205 | Arugula | *Glaesserella parasuis* |
| SBP00205 | Arugula | *Glutamicibacter arilaitensis* |
| SBP00205 | Arugula | *Glutamicibacter halophytocola* |
| SBP00205 | Arugula | *Glutamicibacter nicotianae* |
| SBP00205 | Arugula | *Gordonia iterans* |
| SBP00205 | Arugula | *Gordonia* sp. MMS17-SY073 |
| SBP00205 | Arugula | *Gramella forsetii* |
| SBP00205 | Arugula | *Gryllotalpicola* sp. 2DFW10M-5 |
| SBP00205 | Arugula | *Gynuella sunshinyii* |
| SBP00205 | Arugula | *Haemophilus influenzae* |
| SBP00205 | Arugula | *Halanaerobium praevalens* |
| SBP00205 | Arugula | *Haliscomenobacter hydrossis* |
| SBP00205 | Arugula | *Halobacillus litoralis* |
| SBP00205 | Arugula | *Halobacterium* sp. DL1 |
| SBP00205 | Arugula | *Halobellus limi* |
| SBP00205 | Arugula | *Halomonas huangheensis* |
| SBP00205 | Arugula | *Halorhodospira halochloris* |
| SBP00205 | Arugula | *Halostagnicola larsenii* |
| SBP00205 | Arugula | *Halothece* sp. PCC 7418 |
| SBP00205 | Arugula | *Helicobacter pylori* |
| SBP00205 | Arugula | *Herbaspirillum hiltneri* |
| SBP00205 | Arugula | *Herbaspirillum huttiense* |
| SBP00205 | Arugula | *Herbaspirillum robiniae* |
| SBP00205 | Arugula | *Herbaspirillum seropedicae* |
| SBP00205 | Arugula | *Hoeflea phototrophica* |

TABLE 3-continued

List of species identified in each metagenomic sample of each SBP Sample

| SBP ID | SBP Host Common Name | Genus sp. |
| --- | --- | --- |
| SBP00205 | Arugula | *Hoyosella subflava* |
| SBP00205 | Arugula | *Hungateiclostridium thermocellum* |
| SBP00205 | Arugula | *Hymenobacter* sp. DG25B |
| SBP00205 | Arugula | *Hymenobacter* sp. PAMC 26554 |
| SBP00205 | Arugula | *Hymenobacter* sp. sh-6 |
| SBP00205 | Arugula | *Hyphomicrobium denitrificans* |
| SBP00205 | Arugula | *Hyphomonas* sp. CACIAM 19H1 |
| SBP00205 | Arugula | *Ignicoccus islandicus* |
| SBP00205 | Arugula | *Ilyobacter polytropus* |
| SBP00205 | Arugula | *Indioceanicola profundi* |
| SBP00205 | Arugula | *Inhella inkyongensis* |
| SBP00205 | Arugula | *Isosphaera pallida* |
| SBP00205 | Arugula | *Janthinobacterium agaricidamnosum* |
| SBP00205 | Arugula | *Janthinobacterium* sp. 1_2014MBL_MicDiv |
| SBP00205 | Arugula | *Janthinobacterium* sp. 17J80-10 |
| SBP00205 | Arugula | *Janthinobacterium* sp. LM6 |
| SBP00205 | Arugula | *Janthinobacterium* sp. Marseille |
| SBP00205 | Arugula | *Janthinobacterium svalbardensis* |
| SBP00205 | Arugula | *Jeotgalibaca* sp. H21T32 |
| SBP00205 | Arugula | *Kitasatospora* sp. MMS16-BH015 |
| SBP00205 | Arugula | *Klebsiella aerogenes* |
| SBP00205 | Arugula | *Klebsiella michiganensis* |
| SBP00205 | Arugula | *Klebsiella pneumoniae* |
| SBP00205 | Arugula | *Kluyvera intermedia* |
| SBP00205 | Arugula | *Kocuria palustris* |
| SBP00205 | Arugula | *Kocuria rosea* |
| SBP00205 | Arugula | *Kocuria turfanensis* |
| SBP00205 | Arugula | *Komagataeibacter medellinensis* |
| SBP00205 | Arugula | *Komagataeibacter xylinus* |
| SBP00205 | Arugula | *Kosmotoga pacifica* |
| SBP00205 | Arugula | *Kribbella flavida* |
| SBP00205 | Arugula | *Labrenzia* sp. VG12 |
| SBP00205 | Arugula | *Lachnospiraceae bacterium* GAM79 |
| SBP00205 | Arugula | *Lacinutrix* sp. 5H-3-7-4 |
| SBP00205 | Arugula | *Lactobacillus crustorum* |
| SBP00205 | Arugula | *Lactobacillus delbrueckii* |
| SBP00205 | Arugula | *Lactobacillus paracasei* |
| SBP00205 | Arugula | *Lactobacillus paracollinoides* |
| SBP00205 | Arugula | *Lactobacillus plantarum* |
| SBP00205 | Arugula | *Lactobacillus reuteri* |
| SBP00205 | Arugula | *Lactobacillus salivarius* |
| SBP00205 | Arugula | *Latino* mammarenavirus |
| SBP00205 | Arugula | *Leclercia adecarboxylata* |
| SBP00205 | Arugula | *Legionella pneumophila* |
| SBP00205 | Arugula | *Leisingera aquaemixtae* |
| SBP00205 | Arugula | *Lelliottia amnigena* |
| SBP00205 | Arugula | *Lentzea guizhouensis* |
| SBP00205 | Arugula | *Leptolyngbya boryana* |
| SBP00205 | Arugula | *Leptospira interrogans* |
| SBP00205 | Arugula | *Leptospira santarosai* |
| SBP00205 | Arugula | *Leptotrichia buccalis* |
| SBP00205 | Arugula | *Leuconostoc carnosum* |
| SBP00205 | Arugula | *Limnochorda pilosa* |
| SBP00205 | Arugula | *Listeria ivanovii* |
| SBP00205 | Arugula | *Listeria monocytogenes* |
| SBP00205 | Arugula | *Luteipulveratus mongoliensis* |
| SBP00205 | Arugula | *Lysinibacillus* sp. Marseille-P5727 |
| SBP00205 | Arugula | *Lysinibacillus sphaericus* |
| SBP00205 | Arugula | *Macrococcus caseolyticus* |
| SBP00205 | Arugula | *Mannheimia varigena* |
| SBP00205 | Arugula | *Marinifilaceae bacterium* SPP2 |
| SBP00205 | Arugula | *Marinilactibacillus* sp. 15R |
| SBP00205 | Arugula | *Marinobacter salarius* |
| SBP00205 | Arugula | *Marinobacter* sp. LQ44 |
| SBP00205 | Arugula | *Marinobacter* sp. LV10R510-11A |
| SBP00205 | Arugula | *Marinobacterium aestuarii* |
| SBP00205 | Arugula | *Massilia albidiflava* |
| SBP00205 | Arugula | *Massilia armeniaca* |
| SBP00205 | Arugula | *Massilia lutea* |
| SBP00205 | Arugula | *Massilia oculi* |
| SBP00205 | Arugula | *Massilia plicata* |
| SBP00205 | Arugula | *Massilia putida* |
| SBP00205 | Arugula | *Massilia* sp. NR 4-1 |
| SBP00205 | Arugula | *Massilia* sp. WG5 |
| SBP00205 | Arugula | *Massilia* sp. YMA4 |
| SBP00205 | Arugula | *Massilia umbonata* |

TABLE 3-continued

List of species identified in each metagenomic sample of each SBP Sample

| SBP ID | SBP Host Common Name | Genus sp. |
| --- | --- | --- |
| SBP00205 | Arugula | *Massilia violaceinigra* |
| SBP00205 | Arugula | *Mesorhizobium ciceri* |
| SBP00205 | Arugula | *Mesorhizobium* sp. DCY119 |
| SBP00205 | Arugula | *Mesorhizobium* sp. M6A.T.Cr.TU.016.01.1.1 |
| SBP00205 | Arugula | *Mesorhizobium* sp. M9A.F.Ca.ET.002.03.1.2 |
| SBP00205 | Arugula | *Methanohalobium evestigatum* |
| SBP00205 | Arugula | *Methanosarcina barkeri* |
| SBP00205 | Arugula | *Methanosarcina mazei* |
| SBP00205 | Arugula | *Methanosarcina* sp. MTP4 |
| SBP00205 | Arugula | *Methylobacterium aquaticum* |
| SBP00205 | Arugula | *Methylobacterium brachiatum* |
| SBP00205 | Arugula | *Methylobacterium currus* |
| SBP00205 | Arugula | *Methylocystis rosea* |
| SBP00205 | Arugula | *Methylorubrum extorquens* |
| SBP00205 | Arugula | *Methylorubrum populi* |
| SBP00205 | Arugula | *Methylosinus trichosporium* |
| SBP00205 | Arugula | *Methylovulum psychrotolerans* |
| SBP00205 | Arugula | *Microbacterium foliorum* |
| SBP00205 | Arugula | *Micrabacterium pygmaeum* |
| SBP00205 | Arugula | *Microchaete diplosiphon* |
| SBP00205 | Arugula | *Micromonospora coxensis* |
| SBP00205 | Arugula | *Micromonospora* sp. B006 |
| SBP00205 | Arugula | *Micromonospora viridifaciens* |
| SBP00205 | Arugula | *Miniimonas* sp. S16 |
| SBP00205 | Arugula | *Mitsuaria* sp. 7 |
| SBP00205 | Arugula | *Mixta gaviniae* |
| SBP00205 | Arugula | *Monoglobus pectinilyticus* |
| SBP00205 | Arugula | *Moraxella osloensis* |
| SBP00205 | Arugula | *Mucilaginibacter gotjawali* |
| SBP00205 | Arugula | *Mycobacteroides abscessus* |
| SBP00205 | Arugula | *Mycolicibacterium aurum* |
| SBP00205 | Arugula | *Mycolicibacterium rhodesiae* |
| SBP00205 | Arugula | *Mycoplasma mycoides* |
| SBP00205 | Arugula | *Mycoplasma pullorum* |
| SBP00205 | Arugula | *Myroides odoratus* |
| SBP00205 | Arugula | *Myxococcus xanthus* |
| SBP00205 | Arugula | *Natrinema pellirubrum* |
| SBP00205 | Arugula | *Neisseria subflava* |
| SBP00205 | Arugula | *Neorhizobium galegae* |
| SBP00205 | Arugula | *Nitrosococcus halophilus* |
| SBP00205 | Arugula | *Nitrosococcus wardiae* |
| SBP00205 | Arugula | *Niveispirillum cyanobacteriorum* |
| SBP00205 | Arugula | *Nocardia cyriacigeorgica* |
| SBP00205 | Arugula | *Nocardia farcinica* |
| SBP00205 | Arugula | *Nocardia* sp. Y48 |
| SBP00205 | Arugula | *Nocardioides* sp. CF8 |
| SBP00205 | Arugula | *Nocardiopsis alba* |
| SBP00205 | Arugula | *Nocardiopsis gilva* |
| SBP00205 | Arugula | *Nonomuraea* sp. ATCC 55076 |
| SBP00205 | Arugula | *Nostoc linckia* |
| SBP00205 | Arugula | *Nostoc piscinale* |
| SBP00205 | Arugula | *Nostoc* sp. 'Peltigera membranacea cyanobiont' N6 |
| SBP00205 | Arugula | *Nostoc* sp. PCC 7524 |
| SBP00205 | Arugula | Noumeavirus |
| SBP00205 | Arugula | *Octadecabacter arcticus* |
| SBP00205 | Arugula | *Olsenella* sp. oral taxon 807 |
| SBP00205 | Arugula | Only Syngen Nebraska virus 5 |
| SBP00205 | Arugula | *Opitutus terrae* |
| SBP00205 | Arugula | *Oscillatoria nigro-viridis* |
| SBP00205 | Arugula | *Oscillibacter valericigenes* |
| SBP00205 | Arugula | *Ostreococcus mediterraneus* virus 1 |
| SBP00205 | Arugula | *Ottowia oryzae* |
| SBP00205 | Arugula | *Owenweeksia hongkongensis* |
| SBP00205 | Arugula | *Paenibacillus mucilaginosus* |
| SBP00205 | Arugula | *Paenibacillus* sp. 32O-W |
| SBP00205 | Arugula | *Paenibacillus* sp. MBL81234 |
| SBP00205 | Arugula | *Paludibacter propionicigenes* |
| SBP00205 | Arugula | *Pandoraea oxalativorans* |
| SBP00205 | Arugula | *Pandoraea sputorum* |
| SBP00205 | Arugula | *Pandoraea thiooxydans* |
| SBP00205 | Arugula | *Pantoea agglomerans* |
| SBP00205 | Arugula | *Pantoea vagans* |
| SBP00205 | Arugula | *Paraburkholderia fungorum* |
| SBP00205 | Arugula | *Paraburkholderia hospita* |
| SBP00205 | Arugula | *Paraburkholderia phymatum* |
| SBP00205 | Arugula | *Paraburkholderia xenovorans* |

TABLE 3-continued

List of species identified in each metagenomic sample of each SBP Sample

| SBP ID | SBP Host Common Name | Genus sp. |
| --- | --- | --- |
| SBP00205 | Arugula | *Paracoccus* sp. Arc7-R13 |
| SBP00205 | Arugula | *Paraliobacillus* sp. X-1125 |
| SBP00205 | Arugula | *Pasteurella multocida* |
| SBP00205 | Arugula | *Pediococcus claussenii* |
| SBP00205 | Arugula | *Pelobacter propionicus* |
| SBP00205 | Arugula | *Pelodictyon phaeoclathratiforme* |
| SBP00205 | Arugula | *Petrotoga mobilis* |
| SBP00205 | Arugula | *Phaeobacter piscinae* |
| SBP00205 | Arugula | *Photobacterium damselae* |
| SBP00205 | Arugula | *Photorhabdus laumondii* |
| SBP00205 | Arugula | *Phyllobacterium zundukense* |
| SBP00205 | Arugula | *Picrophilus torridus* |
| SBP00205 | Arugula | *Planococcus halocryophilus* |
| SBP00205 | Arugula | *Planococcus plakortidis* |
| SBP00205 | Arugula | *Planococcus rifietoensis* |
| SBP00205 | Arugula | *Planococcus* sp. MB-3u-03 |
| SBP00205 | Arugula | *Plautia stali* |
| SBP00205 | Arugula | *Pleomorphomonas* sp. SM30 |
| SBP00205 | Arugula | *Polaribacter* sp. ALD11 |
| SBP00205 | Arugula | *Polaromonas* sp. JS666 |
| SBP00205 | Arugula | *Polynucleobacter necessarius* |
| SBP00205 | Arugula | *Porphyrobacter* sp. CACIAM 03H1 |
| SBP00205 | Arugula | *Porphyromonas crevioricanis* |
| SBP00205 | Arugula | *Pragia fontium* |
| SBP00205 | Arugula | *Prochlorococcus marinus* |
| SBP00205 | Arugula | *Providencia heimbachae* |
| SBP00205 | Arugula | *Providencia sneebia* |
| SBP00205 | Arugula | *Providencia stuartii* |
| SBP00205 | Arugula | *Pseudanabaena* sp. ABRG5-3 |
| SBP00205 | Arugula | *Pseudanabaena* sp. PCC 7367 |
| SBP00205 | Arugula | *Pseudarcicella* sp. HME7025 |
| SBP00205 | Arugula | *Pseudarthrobacter chlorophenolicus* |
| SBP00205 | Arugula | *Pseudarthrobacter equi* |
| SBP00205 | Arugula | *Pseudarthrobacter phenanthrenivorans* |
| SBP00205 | Arugula | *Pseudarthrobacter sulfonivorans* |
| SBP00205 | Arugula | *Pseudoalteromonas luteoviolacea* |
| SBP00205 | Arugula | *Pseudoalteromonas piratica* |
| SBP00205 | Arugula | *Pseudoalteromonas spongiae* |
| SBP00205 | Arugula | *Pseudodesulfovibrio profundus* |
| SBP00205 | Arugula | *Pseudomonas aeruginosa* |
| SBP00205 | Arugula | *Pseudomonas agarici* |
| SBP00205 | Arugula | *Pseudomonas alcaligenes* |
| SBP00205 | Arugula | *Pseudomonas alkylphenolica* |
| SBP00205 | Arugula | *Pseudomonas amygdali* |
| SBP00205 | Arugula | *Pseudomonas antarctica* |
| SBP00205 | Arugula | *Pseudomonas arsenicoxydans* |
| SBP00205 | Arugula | *Pseudomonas azotoformans* |
| SBP00205 | Arugula | *Pseudomonas balearica* |
| SBP00205 | Arugula | *Pseudomonas brassicacearum* |
| SBP00205 | Arugula | *Pseudomonas brenneri* |
| SBP00205 | Arugula | *Pseudomonas cedrina* |
| SBP00205 | Arugula | *Pseudomonas chlororaphis* |
| SBP00205 | Arugula | *Pseudomonas cichorii* |
| SBP00205 | Arugula | *Pseudomonas citronellolis* |
| SBP00205 | Arugula | *Pseudomonas corrugata* |
| SBP00205 | Arugula | *Pseudomonas cremoricolorata* |
| SBP00205 | Arugula | *Pseudomonas entomophila* |
| SBP00205 | Arugula | *Pseudomonas extremaustralis* |
| SBP00205 | Arugula | *Pseudomonas extremorientalis* |
| SBP00205 | Arugula | *Pseudomonas fluorescens* |
| SBP00205 | Arugula | *Pseudomonas fragi* |
| SBP00205 | Arugula | *Pseudomonas frederiksbergensis* |
| SBP00205 | Arugula | *Pseudomonas fulva* |
| SBP00205 | Arugula | *Pseudomonas furukawaii* |
| SBP00205 | Arugula | *Pseudomonas granadensis* |
| SBP00205 | Arugula | *Pseudomonas koreensis* |
| SBP00205 | Arugula | *Pseudomonas kribbensis* |
| SBP00205 | Arugula | *Pseudomonas libanensis* |
| SBP00205 | Arugula | *Pseudomonas lini* |
| SBP00205 | Arugula | *Pseudomonas mandelii* |
| SBP00205 | Arugula | *Pseudomonas mediterranea* |
| SBP00205 | Arugula | *Pseudomonas mendocina* |
| SBP00205 | Arugula | *Pseudomonas monteilii* |
| SBP00205 | Arugula | *Pseudomonas moraviensis* |
| SBP00205 | Arugula | *Pseudomonas mucidolens* |
| SBP00205 | Arugula | *Pseudomonas orientalis* |

TABLE 3-continued

List of species identified in each metagenomic sample of each SBP Sample

| SBP ID | SBP Host Common Name | Genus sp. |
|---|---|---|
| SBP00205 | Arugula | Pseudomonas oryzihabitans |
| SBP00205 | Arugula | Pseudomonas palieroniana |
| SBP00205 | Arugula | Pseudomonas parafulva |
| SBP00205 | Arugula | Pseudomonas plecoglossicida |
| SBP00205 | Arugula | Pseudomonas poae |
| SBP00205 | Arugula | Pseudomonas pohangensis |
| SBP00205 | Arugula | Pseudomonas prosekii |
| SBP00205 | Arugula | Pseudomonas protegens |
| SBP00205 | Arugula | Pseudomonas psychrophila |
| SBP00205 | Arugula | Pseudomonas psychrotolerans |
| SBP00205 | Arugula | Pseudomonas putida |
| SBP00205 | Arugula | Pseudomonas reinekei |
| SBP00205 | Arugula | Pseudomonas rhizosphaerae |
| SBP00205 | Arugula | Pseudomonas rhodesiae |
| SBP00205 | Arugula | Pseudomonas saudiphocaensis |
| SBP00205 | Arugula | Pseudomonas silesiensis |
| SBP00205 | Arugula | Pseudomonas sp. |
| SBP00205 | Arugula | Pseudomonas sp. 02C 26 |
| SBP00205 | Arugula | Pseudomonas sp. 31-12 |
| SBP00205 | Arugula | Pseudomonas sp. 7SR1 |
| SBP00205 | Arugula | Pseudomonas sp. A214 |
| SBP00205 | Arugula | Pseudomonas sp. ATCC 13867 |
| SBP00205 | Arugula | Pseudomonas sp. B10 |
| SBP00205 | Arugula | Pseudomonas sp. CC6-YY-74 |
| SBP00205 | Arugula | Pseudomonas sp. CCOS 191 |
| SBP00205 | Arugula | Pseudomonas sp. CMR12a |
| SBP00205 | Arugula | Pseudomonas sp. CMR5c |
| SBP00205 | Arugula | Pseudomonas sp. DR 5-09 |
| SBP00205 | Arugula | Pseudomonas sp. DY-1 |
| SBP00205 | Arugula | Pseudomonas sp. FDAARGOS_380 |
| SBP00205 | Arugula | Pseudomonas sp. GR 6-02 |
| SBP00205 | Arugula | Pseudomonas sp. HLS-6 |
| SBP00205 | Arugula | Pseudomonas sp. K2W31S-8 |
| SBP00205 | Arugula | Pseudomonas sp. LAB-08 |
| SBP00205 | Arugula | Pseudomonas sp. LBUM920 |
| SBP00205 | Arugula | Pseudomonas sp. Leaf58 |
| SBP00205 | Arugula | Pseudomonas sp. LG1D9 |
| SBP00205 | Arugula | Pseudomonas sp. LG1E9 |
| SBP00205 | Arugula | Pseudomonas sp. Lz4W |
| SBP00205 | Arugula | Pseudomonas sp. M30-35 |
| SBP00205 | Arugula | Pseudomonas sp. MYb193 |
| SBP00205 | Arugula | Pseudomonas sp. NS1(2017) |
| SBP00205 | Arugula | Pseudomonas sp. R5-89-07 |
| SBP00205 | Arugula | Pseudomonas sp. RU47 |
| SBP00205 | Arugula | Pseudomonas sp. S09G 359 |
| SBP00205 | Arugula | Pseudomonas sp. s211(2017) |
| SBP00205 | Arugula | Pseudomonas sp. StFLB209 |
| SBP00205 | Arugula | Pseudomonas sp. TCU-HL1 |
| SBP00205 | Arugula | Pseudomonas sp. TKP |
| SBP00205 | Arugula | Pseudomonas sp. TMW 2.1634 |
| SBP00205 | Arugula | Pseudomonas sp. URMO17WK12:I11 |
| SBP00205 | Arugula | Pseudomonas sp. UW4 |
| SBP00205 | Arugula | Pseudomonas sp. Z003-0.4C(8344-21) |
| SBP00205 | Arugula | Pseudomonas stutzeri |
| SBP00205 | Arugula | Pseudomonas synxantha |
| SBP00205 | Arugula | Pseudomonas syringae |
| SBP00205 | Arugula | Pseudomonas taetrolens |
| SBP00205 | Arugula | Pseudomonas thivervalensis |
| SBP00205 | Arugula | Pseudomonas tolaasii |
| SBP00205 | Arugula | Pseudomonas trivialis |
| SBP00205 | Arugula | Pseudomonas umsongensis |
| SBP00205 | Arugula | Pseudomonas vancouverensis |
| SBP00205 | Arugula | Pseudomonas veronii |
| SBP00205 | Arugula | Pseudomonas versuta |
| SBP00205 | Arugula | Pseudomonas viridiflava |
| SBP00205 | Arugula | Pseudomonas yamanorum |
| SBP00205 | Arugula | Pseudonocardia autotrophica |
| SBP00205 | Arugula | Pseudopropionibacterium propionicum |
| SBP00205 | Arugula | Psychrobacter alimentarius |
| SBP00205 | Arugula | Psychrobacter sp. AntiMn-1 |
| SBP00205 | Arugula | Psychrobacter sp. DAB_AL438 |
| SBP00205 | Arugula | Rahnella aquatilis |
| SBP00205 | Arugula | Ralstonia insidiosa |
| SBP00205 | Arugula | Ralstonia mannitolilytica |
| SBP00205 | Arugula | Ralstonia pickettii |
| SBP00205 | Arugula | Ralstonia solanacearum |

TABLE 3-continued

List of species identified in each metagenomic sample of each SBP Sample

| SBP ID | SBP Host Common Name | Genus sp. |
|---|---|---|
| SBP00205 | Arugula | *Raoultella ornithinolytica* |
| SBP00205 | Arugula | *Raoultella planticola* |
| SBP00205 | Arugula | *Rathayibacter festucae* |
| SBP00205 | Arugula | *Reinekea forsetii* |
| SBP00205 | Arugula | *Rhizobium jaguaris* |
| SBP00205 | Arugula | *Rhizobium leguminosarum* |
| SBP00205 | Arugula | *Rhizobium sp. CIAT894* |
| SBP00205 | Arugula | *Rhodobaca barguzinensis* |
| SBP00205 | Arugula | *Rhodobacter sphaeroides* |
| SBP00205 | Arugula | *Rhodococcus fascians* |
| SBP00205 | Arugula | *Rhodococcus opacus* |
| SBP00205 | Arugula | *Rhodococcus sp. P1Y* |
| SBP00205 | Arugula | *Rhodopirellula baltica* |
| SBP00205 | Arugula | *Rhodopseudomonas palustris* |
| SBP00205 | Arugula | *Rhodothermus marinus* |
| SBP00205 | Arugula | *Rivularia sp. PCC 7116* |
| SBP00205 | Arugula | *Roseobacter denitrificans* |
| SBP00205 | Arugula | *Ruegeria sp. TM1040* |
| SBP00205 | Arugula | *Rufibacter sp. DG31D* |
| SBP00205 | Arugula | *Ruminiclostridium cellulolyticum* |
| SBP00205 | Arugula | *Saccharopolyspora erythraea* |
| SBP00205 | Arugula | *Salinisphaera sp. LB1* |
| SBP00205 | Arugula | *Salmonella enterica* |
| SBP00205 | Arugula | *Scardovia inopinata* |
| SBP00205 | Arugula | *Scytonema sp. NIES-4073* |
| SBP00205 | Arugula | *Sebaldella termitidis* |
| SBP00205 | Arugula | *Sediminicola sp. YIK13* |
| SBP00205 | Arugula | *Sediminispirochaeta smaragdinae* |
| SBP00205 | Arugula | *Selenomonas sp. oral taxon 126* |
| SBP00205 | Arugula | *Serratia fonticola* |
| SBP00205 | Arugula | *Serratia liquefaciens* |
| SBP00205 | Arugula | *Serratia marcescens* |
| SBP00205 | Arugula | *Serratia plymuthica* |
| SBP00205 | Arugula | *Serratia rubidaea* |
| SBP00205 | Arugula | *Shewanella algae* |
| SBP00205 | Arugula | *Shewanella baltica* |
| SBP00205 | Arugula | *Shewanella loihica* |
| SBP00205 | Arugula | *Shewanella putrefaciens* |
| SBP00205 | Arugula | *Shewanella sp. Pdp11* |
| SBP00205 | Arugula | *Shewanella sp. WE21* |
| SBP00205 | Arugula | *Shewanella woodyi* |
| SBP00205 | Arugula | *Shigella boydii* |
| SBP00205 | Arugula | *Simonsiella muelleri* |
| SBP00205 | Arugula | *Sinorhizobium americanum* |
| SBP00205 | Arugula | *Sinorhizobium meliloti* |
| SBP00205 | Arugula | *Slackia heliotrinireducens* |
| SBP00205 | Arugula | *Solibacillus silvestris* |
| SBP00205 | Arugula | *Sorangium cellulosum* |
| SBP00205 | Arugula | *Sphingobacterium sp. 21* |
| SBP00205 | Arugula | *Sphingobium sp. TKS* |
| SBP00205 | Arugula | *Sphingomonas sp. C8-2* |
| SBP00205 | Arugula | *Sphingomonas sp. FARSPH* |
| SBP00205 | Arugula | *Sphingomonas sp. LK11* |
| SBP00205 | Arugula | *Sphingomonas sp. MM-1* |
| SBP00205 | Arugula | *Sphingopyxis sp. FD7* |
| SBP00205 | Arugula | *Spiroplasma culicicola* |
| SBP00205 | Arugula | *Spirosoma radiotolerans* |
| SBP00205 | Arugula | *Sporosarcina ureae* |
| SBP00205 | Arugula | *Staphylococcus aureus* |
| SBP00205 | Arugula | *Staphylococcus delphini* |
| SBP00205 | Arugula | *Staphylococcus haemolyticus* |
| SBP00205 | Arugula | *Staphylococcus pettenkoferi* |
| SBP00205 | Arugula | *Staphylococcus saprophyticus* |
| SBP00205 | Arugula | *Staphylococcus stepanovicii* |
| SBP00205 | Arugula | *Stenotrophomonas maltophilia* |
| SBP00205 | Arugula | *Stenotrophomonas rhizophila* |
| SBP00205 | Arugula | *Stenotrophomonas sp.* |
| SBP00205 | Arugula | *Stenotrophomonas sp. ZAC14A_NAIMI4_1* |
| SBP00205 | Arugula | *Stigmatella aurantiaca* |
| SBP00205 | Arugula | *Streptococcus pasteurianus* |
| SBP00205 | Arugula | *Streptococcus pneumoniae* |
| SBP00205 | Arugula | *Streptococcus porcinus* |
| SBP00205 | Arugula | *Streptococcus pyogenes* |
| SBP00205 | Arugula | *Streptococcus sanguinis* |
| SBP00205 | Arugula | *Streptococcus suis* |
| SBP00205 | Arugula | *Streptomyces albulus* |

TABLE 3-continued

List of species identified in each metagenomic sample of each SBP Sample

| SBP ID | SBP Host Common Name | Genus sp. |
| --- | --- | --- |
| SBP00205 | Arugula | *Streptomyces anulatus* |
| SBP00205 | Arugula | *Streptomyces bingchenggensis* |
| SBP00205 | Arugula | *Streptomyces collinus* |
| SBP00205 | Arugula | *Streptomyces gilvosporeus* |
| SBP00205 | Arugula | *Streptomyces griseochromogenes* |
| SBP00205 | Arugula | *Streptomyces hygroscopicus* |
| SBP00205 | Arugula | *Streptomyces luteoverticillatus* |
| SBP00205 | Arugula | *Streptomyces lydicus* |
| SBP00205 | Arugula | *Streptomyces nigra* |
| SBP00205 | Arugula | *Streptomyces nodosus* |
| SBP00205 | Arugula | *Streptomyces pactum* |
| SBP00205 | Arugula | *Streptomyces pristinaespiralis* |
| SBP00205 | Arugula | *Streptomyces puniciscabiei* |
| SBP00205 | Arugula | *Streptomyces seoulensis* |
| SBP00205 | Arugula | *Streptomyces sp. 3214.6* |
| SBP00205 | Arugula | *Streptomyces sp. KPB2* |
| SBP00205 | Arugula | *Streptomyces sp. MK45* |
| SBP00205 | Arugula | *Streptomyces sp. P3* |
| SBP00205 | Arugula | *Streptomyces sp. PVA 94-07* |
| SBP00205 | Arugula | *Streptomyces sp. SirexAA-E* |
| SBP00205 | Arugula | *Streptomyces sp. SM18* |
| SBP00205 | Arugula | *Streptomyces sp. TLI_053* |
| SBP00205 | Arugula | *Streptomyces sp. W1SF4* |
| SBP00205 | Arugula | *Streptomyces xiamenensis* |
| SBP00205 | Arugula | *Streptomyces xinghaiensis* |
| SBP00205 | Arugula | *Streptosporangium roseum* |
| SBP00205 | Arugula | *Sulfitobacter sp. AM1-D1* |
| SBP00205 | Arugula | *Sulfurospirillum cavolei* |
| SBP00205 | Arugula | *Tamlana sp. UJ94* |
| SBP00205 | Arugula | *Tatumella citrea* |
| SBP00205 | Arugula | *Taylorella equigenitalis* |
| SBP00205 | Arugula | *Terribacillus goriensis* |
| SBP00205 | Arugula | *Thalassolituus oleivorans* |
| SBP00205 | Arugula | *Thalassospira xiamenensis* |
| SBP00205 | Arugula | *Thermococcus barophilus* |
| SBP00205 | Arugula | *Thermococcus profundus* |
| SBP00205 | Arugula | *Thermodesulfatator indicus* |
| SBP00205 | Arugula | *Thermomonospora curvata* |
| SBP00205 | Arugula | *Thermosipho melanesiensis* |
| SBP00205 | Arugula | *Thermotoga profunda* |
| SBP00205 | Arugula | *Thioalkalivibrlo paradoxus* |
| SBP00205 | Arugula | *Thioploca ingrica* |
| SBP00205 | Arugula | *Tolumonas auensis* |
| SBP00205 | Arugula | *Treponema denticola* |
| SBP00205 | Arugula | *Treponema succinifaciens* |
| SBP00205 | Arugula | *Tsukamurella paurometabola* |
| SBP00205 | Arugula | *Vagococcus penaei* |
| SBP00205 | Arugula | *Variovorax paradoxus* |
| SBP00205 | Arugula | *Verminephrobacter eiseniae* |
| SBP00205 | Arugula | *Verrucosispora maris* |
| SBP00205 | Arugula | *Vibrio aphrogenes* |
| SBP00205 | Arugula | *Vibrio breoganii* |
| SBP00205 | Arugula | *Vibrio campbellii* |
| SBP00205 | Arugula | *Vibrio coralliilyticus* |
| SBP00205 | Arugula | *Vibrio gazogenes* |
| SBP00205 | Arugula | *Vibrio vulnificus* |
| SBP00205 | Arugula | *Virgibacillus sp. Bac332* |
| SBP00205 | Arugula | *Weissella cibaria* |
| SBP00205 | Arugula | *Wigglesworthia glossinidia* |
| SBP00205 | Arugula | *Xanthomonas campestris* |
| SBP00205 | Arugula | *Xanthomonas citri* |
| SBP00205 | Arugula | *Xanthomonas sacchari* |
| SBP00205 | Arugula | *Yersinia massiliensis* |
| SBP00205 | Arugula | *Yersinia ruckeri* |
| SBP00206 | Broccolini | *Acinetobacter johnsonii* |
| SBP00206 | Broccolini | *Anaerotignum propionicum* |
| SBP00206 | Broccolini | *Bacillus amyloliquefaciens* |
| SBP00206 | Broccolini | *Bacillus paralicheniformis* |
| SBP00206 | Broccolini | *Bacillus sp. (in: Bacteria)* |
| SBP00206 | Broccolini | *Bacillus subtilis* |
| SBP00206 | Broccolini | *Bradyrhizobium sp. BTAi1* |
| SBP00206 | Broccolini | *Delftia tsuruhatensis* |
| SBP00206 | Broccolini | *Enterobacter cloacae* |
| SBP00206 | Broccolini | *Ereboglobus luteus* |
| SBP00206 | Broccolini | *Fuerstia marisgermanicae* |
| SBP00206 | Broccolini | *Janthinobacterium agaricidamnosum* |

TABLE 3-continued

List of species identified in each metagenomic sample of each SBP Sample

| SBP ID | SBP Host Common Name | Genus sp. |
|---|---|---|
| SBP00206 | Broccolini | *Janthinobacterium svalbardensis* |
| SBP00206 | Broccolini | *Leclercia adecarboxylata* |
| SBP00206 | Broccolini | *Massilia oculi* |
| SBP00206 | Broccolini | *Massilia* sp. NR 4-1 |
| SBP00206 | Broccolini | *Massilia violaceinigra* |
| SBP00206 | Broccolini | *Pantoea agglomerans* |
| SBP00206 | Broccolini | *Paracoccus* sp. Arc7-R13 |
| SBP00206 | Broccolini | *Photobacterium damselae* |
| SBP00206 | Broccolini | *Pseudoalteromonas* sp. SM9913 |
| SBP00206 | Broccolini | *Pseudomonas fluorescens* |
| SBP00206 | Broccolini | *Pseudomonas koreensis* |
| SBP00206 | Broccolini | *Pseudomonas moraviensis* |
| SBP00206 | Broccolini | *Pseudomonas* sp. |
| SBP00206 | Broccolini | *Pseudomonas* sp. FDAARGOS_380 |
| SBP00206 | Broccolini | *Ralstonia insidiosa* |
| SBP00206 | Broccolini | *Ralstonia mannitolilytica* |
| SBP00206 | Broccolini | *Ralstonia pickettii* |
| SBP00206 | Broccolini | *Ralstonia solanacearum* |
| SBP00206 | Broccolini | *Rhodococcus fascians* |
| SBP00206 | Broccolini | *Sandaracinus amylolyticus* |
| SBP00206 | Broccolini | *Serratia marcescens* |
| SBP00206 | Broccolini | *Sphingobacteriaceae bacterium* GW460-11-11-14-LBS |
| SBP00206 | Broccolini | *Stenotrophomonas maltophilia* |
| SBP00209 | American ginseng_1 | [*Arcobacter*] *porcinus* |
| SBP00209 | American ginseng_1 | [*Arcobacter*] *porcinus* |
| SBP00209 | American ginseng_1 | [*Bacillus*] *selenitireducens* |
| SBP00209 | American ginseng_1 | [*Bacillus*] *selenitireducens* |
| SBP00209 | American ginseng_1 | [*Brevibacterium*] *frigoritolerans* |
| SBP00209 | American ginseng_1 | [*Brevibacterium*] *frigoritolerans* |
| SBP00209 | American ginseng_1 | [*Clostridium*] *bolteae* |
| SBP00209 | American ginseng_1 | [*Clostridium*] *bolteae* |
| SBP00209 | American ginseng_1 | [*Clostridium*] *cellulosi* |
| SBP00209 | American ginseng_1 | [*Clostridium*] *cellulosi* |
| SBP00209 | American ginseng_1 | [*Enterobacter*] *lignolyticus* |
| SBP00209 | American ginseng_1 | [*Enterobacter*] *lignolyticus* |
| SBP00209 | American ginseng_1 | [*Eubacterium*] *cellulosolvens* |
| SBP00209 | American ginseng_1 | [*Eubacterium*] *cellulosolvens* |
| SBP00209 | American ginseng_1 | [*Eubacterium*] *minutum* |
| SBP00209 | American ginseng_1 | [*Eubacterium*] *minutum* |
| SBP00209 | American ginseng_1 | [*Eubacterium*] *rectale* |
| SBP00209 | American ginseng_1 | [*Eubacterium*] *rectale* |
| SBP00209 | American ginseng_1 | [*Haemophilus*] *ducreyi* |
| SBP00209 | American ginseng_1 | [*Haemophilus*] *ducreyi* |
| SBP00209 | American ginseng_1 | [*Mycobacterium*] *stephanolepidis* |
| SBP00209 | American ginseng_1 | [*Mycobacterium*] *stephanolepidis* |
| SBP00209 | American ginseng_1 | [*Pasteurella*] *aerogenes* |
| SBP00209 | American ginseng_1 | [*Pasteurella*] *aerogenes* |
| SBP00209 | American ginseng_1 | [*Polyangium*] *brachysporum* |
| SBP00209 | American ginseng_1 | [*Polyangium*] *brachysporum* |
| SBP00209 | American ginseng_1 | [*Pseudomonas*] *mesoacidophila* |
| SBP00209 | American ginseng_1 | [*Pseudomonas*] *mesoacidophila* |
| SBP00209 | American ginseng_1 | *Acetoanaerobium sticklandii* |
| SBP00209 | American ginseng_1 | *Acetoanaerobium sticklandii* |
| SBP00209 | American ginseng_1 | *Acetobacter aceti* |
| SBP00209 | American ginseng_1 | *Acetobacter aceti* |
| SBP00209 | American ginseng_1 | *Acetobacter ghanensis* |
| SBP00209 | American ginseng_1 | *Acetobacter ghanensis* |
| SBP00209 | American ginseng_1 | *Acetobacteraceae bacterium* |
| SBP00209 | American ginseng_1 | *Acetobacteraceae bacterium* |
| SBP00209 | American ginseng_1 | *Acetobacterium woodii* |
| SBP00209 | American ginseng_1 | *Acetobacterium woodii* |
| SBP00209 | American ginseng_1 | *Acetohalobium arabaticum* |
| SBP00209 | American ginseng_1 | *Acetohalobium arabaticum* |
| SBP00209 | American ginseng_1 | *Acholeplasma hippikon* |
| SBP00209 | American ginseng_1 | *Acholeplasma hippikon* |
| SBP00209 | American ginseng_1 | *Achromobacter denitrificans* |
| SBP00209 | American ginseng_1 | *Achromobacter denitrificans* |
| SBP00209 | American ginseng_1 | *Achromobacter insolitus* |
| SBP00209 | American ginseng_1 | *Achromobacter insolitus* |
| SBP00209 | American ginseng_1 | *Achromobacter* sp. AONIH1 |
| SBP00209 | American ginseng_1 | *Achromobacter* sp. AONIH1 |
| SBP00209 | American ginseng_1 | *Achromobacter* sp. B7 |
| SBP00209 | American ginseng_1 | *Achromobacter* sp. B7 |
| SBP00209 | American ginseng_1 | *Achromobacter* sp. MFA1 R4 |
| SBP00209 | American ginseng_1 | *Achromobacter* sp. MFA1 R4 |
| SBP00209 | American ginseng_1 | *Achromobacter spanius* |

TABLE 3-continued

List of species identified in each metagenomic sample of each SBP Sample

| SBP ID | SBP Host Common Name | Genus sp. |
|---|---|---|
| SBP00209 | American ginseng_1 | *Achromobacter spanius* |
| SBP00209 | American ginseng_1 | *Achromobacter xylosoxidans* |
| SBP00209 | American ginseng_1 | *Achromobacter xylosoxidans* |
| SBP00209 | American ginseng_1 | *Acidaminococcus fermentans* |
| SBP00209 | American ginseng_1 | *Acidaminococcus fermentans* |
| SBP00209 | American ginseng_1 | *Acidianus brierleyi* |
| SBP00209 | American ginseng_1 | *Acidianus brierleyi* |
| SBP00209 | American ginseng_1 | *Acidiferrobacter* sp. SPIII_3 |
| SBP00209 | American ginseng_1 | *Acidiferrobacter* sp. SPIII_3 |
| SBP00209 | American ginseng_1 | *Acidihalobacter prosperus* |
| SBP00209 | American ginseng_1 | *Acidihalobacter prosperus* |
| SBP00209 | American ginseng_1 | *Acidimicrobium ferrooxidans* |
| SBP00209 | American ginseng_1 | *Acidimicrobium ferrooxidans* |
| SBP00209 | American ginseng_1 | *Acidiphilium multivorum* |
| SBP00209 | American ginseng_1 | *Acidiphilium multivorum* |
| SBP00209 | American ginseng_1 | *Acidipropionibacterium acidipropionici* |
| SBP00209 | American ginseng_1 | *Acidipropionibacterium acidipropionici* |
| SBP00209 | American ginseng_1 | *Acidipropionibacterium jensenii* |
| SBP00209 | American ginseng_1 | *Acidipropionibacterium jensenii* |
| SBP00209 | American ginseng_1 | *Acidipropionibacterium virtanenii* |
| SBP00209 | American ginseng_1 | *Acidipropionibacterium virtanenii* |
| SBP00209 | American ginseng_1 | *Acidisphaera* sp. G45-3 |
| SBP00209 | American ginseng_1 | *Acidisphaera* sp. G45-3 |
| SBP00209 | American ginseng_1 | *Acidithiobacillus ferrivorans* |
| SBP00209 | American ginseng_1 | *Acidithiobacillus ferrivorans* |
| SBP00209 | American ginseng_1 | *Acidobacteriaceae bacterium* SBC82 |
| SBP00209 | American ginseng_1 | *Acidobacteriaceae bacterium* SBC82 |
| SBP00209 | American ginseng_1 | *Acidobacterium capsulatum* |
| SBP00209 | American ginseng_1 | *Acidobacterium capsulatum* |
| SBP00209 | American ginseng_1 | *Acidothermus cellulolyticus* |
| SBP00209 | American ginseng_1 | *Acidothermus cellulolyticus* |
| SBP00209 | American ginseng_1 | *Acidovorax avenae* |
| SBP00209 | American ginseng_1 | *Acidovorax avenae* |
| SBP00209 | American ginseng_1 | *Acidavorax carolinensis* |
| SBP00209 | American ginseng_1 | *Acidovorax carolinensis* |
| SBP00209 | American ginseng_1 | *Acidovorax cattleyae* |
| SBP00209 | American ginseng_1 | *Acidovorax cattleyae* |
| SBP00209 | American ginseng_1 | *Acidovorax citrulli* |
| SBP00209 | American ginseng_1 | *Acidovorax citrulli* |
| SBP00209 | American ginseng_1 | *Acidovorax ebreus* |
| SBP00209 | American ginseng_1 | *Acidovorax ebreus* |
| SBP00209 | American ginseng_1 | *Acidovorax* sp. 1608163 |
| SBP00209 | American ginseng_1 | *Acidovorax* sp. 1608163 |
| SBP00209 | American ginseng_1 | *Acidovorax* sp. JS42 |
| SBP00209 | American ginseng_1 | *Acidovorax* sp. JS42 |
| SBP00209 | American ginseng_1 | *Acidovorax* sp. KKS102 |
| SBP00209 | American ginseng_1 | *Acidovorax* sp. KKS102 |
| SBP00209 | American ginseng_1 | *Acidovorax* sp. RAC01 |
| SBP00209 | American ginseng_1 | *Acidovorax* sp. RAC01 |
| SBP00209 | American ginseng_1 | *Acidovorax* sp. T1 |
| SBP00209 | American ginseng_1 | *Acidovorax* sp. T1 |
| SBP00209 | American ginseng_1 | *Aciduliprofundum boonei* |
| SBP00209 | American ginseng_1 | *Aciduliprofundum boonei* |
| SBP00209 | American ginseng_1 | *Acinetobacter baumannii* |
| SBP00209 | American ginseng_1 | *Acinetobacter baumannii* |
| SBP00209 | American ginseng_1 | *Acinetobacter bereziniae* |
| SBP00209 | American ginseng_1 | *Acinetobacter bereziniae* |
| SBP00209 | American ginseng_1 | *Acinetobacter calcoaceticus* |
| SBP00209 | American ginseng_1 | *Acinetobacter calcoaceticus* |
| SBP00209 | American ginseng_1 | *Acinetobacter defluvii* |
| SBP00209 | American ginseng_1 | *Acinetobacter defluvii* |
| SBP00209 | American ginseng_1 | *Acinetobacter equi* |
| SBP00209 | American ginseng_1 | *Acinetobacter equi* |
| SBP00209 | American ginseng_1 | *Acinetobacter guillouiae* |
| SBP00209 | American ginseng_1 | *Acinetobacter guillouiae* |
| SBP00209 | American ginseng_1 | *Acinetobacter indicus* |
| SBP00209 | American ginseng_1 | *Acinetobacter indicus* |
| SBP00209 | American ginseng_1 | *Acinetobacter johnsonii* |
| SBP00209 | American ginseng_1 | *Acinetobacter johnsonii* |
| SBP00209 | American ginseng_1 | *Acinetobacter larvae* |
| SBP00209 | American ginseng_1 | *Acinetobacter larvae* |
| SBP00209 | American ginseng_1 | *Acinetobacter lwoffii* |
| SBP00209 | American ginseng_1 | *Acinetobacter lwoffii* |
| SBP00209 | American ginseng_1 | *Acinetobacter nosocomialis* |
| SBP00209 | American ginseng_1 | *Acinetobacter nosocomialis* |
| SBP00209 | American ginseng_1 | *Acinetobacter pittii* |

TABLE 3-continued

List of species identified in each metagenomic sample of each SBP Sample

| SBP ID | SBP Host Common Name | Genus sp. |
|---|---|---|
| SBP00209 | American ginseng_1 | *Acinetobacter pittii* |
| SBP00209 | American ginseng_1 | *Acinetobacter radioresistens* |
| SBP00209 | American ginseng_1 | *Acinetobacter radioresistens* |
| SBP00209 | American ginseng_1 | *Acinetobacter soli* |
| SBP00209 | American ginseng_1 | *Acinetobacter soli* |
| SBP00209 | American ginseng_1 | *Acinetobacter* sp. WCHAc010034 |
| SBP00209 | American ginseng_1 | *Acinetobacter* sp. WCHAc010034 |
| SBP00209 | American ginseng_1 | *Acinetobacter* sp. WCHAc010052 |
| SBP00209 | American ginseng_1 | *Acinetobacter* sp. WCHAc010052 |
| SBP00209 | American ginseng_1 | *Acinetobacter ursingii* |
| SBP00209 | American ginseng_1 | *Acinetobacter ursingii* |
| SBP00209 | American ginseng_1 | *Acinetobacter venetianus* |
| SBP00209 | American ginseng_1 | *Acinetobacter venetianus* |
| SBP00209 | American ginseng_1 | *Acinetobacter wuhouensis* |
| SBP00209 | American ginseng_1 | *Acinetobacter wuhouensis* |
| SBP00209 | American ginseng_1 | *Actinoalloteichus hoggarensis* |
| SBP00209 | American ginseng_1 | *Actinoalloteichus hoggarensis* |
| SBP00209 | American ginseng_1 | *Actinoalloteichus hymeniacidonis* |
| SBP00209 | American ginseng_1 | *Actinoalloteichus hymeniacidonis* |
| SBP00209 | American ginseng_1 | *Actinoalloteichus* sp. AHMU CJ021 |
| SBP00209 | American ginseng_1 | *Actinoalloteichus* sp. AHMU CJ021 |
| SBP00209 | American ginseng_1 | *Actinobacillus delphinicola* |
| SBP00209 | American ginseng_1 | *Actinobacillus delphinicola* |
| SBP00209 | American ginseng_1 | *Actinobacillus suis* |
| SBP00209 | American ginseng_1 | *Actinobacillus suis* |
| SBP00209 | American ginseng_1 | *Actinobacteria bacterium* IMCC26256 |
| SBP00209 | American ginseng_1 | *Actinobacteria bacterium* IMCC26256 |
| SBP00209 | American ginseng_1 | *Actinobacteria bacterium* YIM 96077 |
| SBP00209 | American ginseng_1 | *Actinobacteria bacterium* YIM 96077 |
| SBP00209 | American ginseng_1 | *Actinomadura amylolytica* |
| SBP00209 | American ginseng_1 | *Actinomadura amylolytica* |
| SBP00209 | American ginseng_1 | *Actinomyces cardiffensis* |
| SBP00209 | American ginseng_1 | *Actinomyces cardiffensis* |
| SBP00209 | American ginseng_1 | *Actinomyces howellii* |
| SBP00209 | American ginseng_1 | *Actinomyces howellii* |
| SBP00209 | American ginseng_1 | *Actinomyces radicidentis* |
| SBP00209 | American ginseng_1 | *Actinomyces radicidentis* |
| SBP00209 | American ginseng_1 | *Actinomyces radingae* |
| SBP00209 | American ginseng_1 | *Actinomyces radingae* |
| SBP00209 | American ginseng_1 | *Actinomyces slackii* |
| SBP00209 | American ginseng_1 | *Actinomyces slackii* |
| SBP00209 | American ginseng_1 | *Actinomyces* sp. 2129 |
| SBP00209 | American ginseng_1 | *Actinomyces* sp. 2129 |
| SBP00209 | American ginseng_1 | *Actinomyces* sp. Chiba101 |
| SBP00209 | American ginseng_1 | *Actinomyces* sp. Chiba101 |
| SBP00209 | American ginseng_1 | *Actinomyces* sp. oral taxon 171 |
| SBP00209 | American ginseng_1 | *Actinomyces* sp. oral taxon 171 |
| SBP00209 | American ginseng_1 | *Actinomyces* sp. oral taxon 414 |
| SBP00209 | American ginseng_1 | *Actinomyces* sp. oral taxon 414 |
| SBP00209 | American ginseng_1 | *Actinomyces* sp. oral taxon 848 |
| SBP00209 | American ginseng_1 | *Actinomyces* sp. oral taxon 848 |
| SBP00209 | American ginseng_1 | *Actinomyces* sp. oral taxon 897 |
| SBP00209 | American ginseng_1 | *Actinomyces* sp. oral taxon 897 |
| SBP00209 | American ginseng_1 | *Actinomyces* sp. Z16 |
| SBP00209 | American ginseng_1 | *Actinomyces* sp. Z16 |
| SBP00209 | American ginseng_1 | *Actinomyces viscosus* |
| SBP00209 | American ginseng_1 | *Actinomyces viscosus* |
| SBP00209 | American ginseng_1 | *Actinoplanes derwentensis* |
| SBP00209 | American ginseng_1 | *Actinoplanes derwentensis* |
| SBP00209 | American ginseng_1 | *Actinoplanes friuliensis* |
| SBP00209 | American ginseng_1 | *Actinoplanes friuliensis* |
| SBP00209 | American ginseng_1 | *Actinoplanes missouriensis* |
| SBP00209 | American ginseng_1 | *Actinoplanes missouriensis* |
| SBP00209 | American ginseng_1 | *Actinoplanes* sp. ATCC 31351 |
| SBP00209 | American ginseng_1 | *Actinoplanes* sp. ATCC 31351 |
| SBP00209 | American ginseng_1 | *Actinoplanes* sp. N902-109 |
| SBP00209 | American ginseng_1 | *Actinoplanes* sp. N902-109 |
| SBP00209 | American ginseng_1 | *Actinoplanes* sp. OR16 |
| SBP00209 | American ginseng_1 | *Actinoplanes* sp. OR16 |
| SBP00209 | American ginseng_1 | *Actinoplanes teichomyceticus* |
| SBP00209 | American ginseng_1 | *Actinoplanes teichomyceticus* |
| SBP00209 | American ginseng_1 | *Actinopolymorpha singaporensis* |
| SBP00209 | American ginseng_1 | *Actinopolymorpha singaporensis* |
| SBP00209 | American ginseng_1 | *Actinopolyspora erythraea* |
| SBP00209 | American ginseng_1 | *Actinopolyspora erythraea* |
| SBP00209 | American ginseng_1 | *Actinosynnema pretiosum* |

TABLE 3-continued

List of species identified in each metagenomic sample of each SBP Sample

| SBP ID | SBP Host Common Name | Genus sp. |
|---|---|---|
| SBP00209 | American ginseng_1 | *Actinosynnema pretiosum* |
| SBP00209 | American ginseng_1 | *Adoxophyes orana nucleopolyhedrovirus* |
| SBP00209 | American ginseng_1 | *Adoxophyes orana nucleopolyhedrovirus* |
| SBP00209 | American ginseng_1 | *Aequorivita* sp. H23M31 |
| SBP00209 | American ginseng_1 | *Aequorivita* sp. H23M31 |
| SBP00209 | American ginseng_1 | *Aeribacillus pallidus* |
| SBP00209 | American ginseng_1 | *Aeribacillus pallidus* |
| SBP00209 | American ginseng_1 | *Aeromicrobium choanae* |
| SBP00209 | American ginseng_1 | *Aeromicrobium choanae* |
| SBP00209 | American ginseng_1 | *Aeromicrobium erythreum* |
| SBP00209 | American ginseng_1 | *Aeromicrobium erythreum* |
| SBP00209 | American ginseng_1 | *Aeromicrobium marinum* |
| SBP00209 | American ginseng_1 | *Aeromicrobium marinum* |
| SBP00209 | American ginseng_1 | *Aeromicrobium* sp. 592 |
| SBP00209 | American ginseng_1 | *Aeromicrobium* sp. 592 |
| SBP00209 | American ginseng_1 | *Aeromicrobium* sp. A1-2 |
| SBP00209 | American ginseng_1 | *Aeromicrobium* sp. A1-2 |
| SBP00209 | American ginseng_1 | *Aeromonas caviae* |
| SBP00209 | American ginseng_1 | *Aeromonas caviae* |
| SBP00209 | American ginseng_1 | *Aeromonas dhakensis* |
| SBP00209 | American ginseng_1 | *Aeromonas dhakensis* |
| SBP00209 | American ginseng_1 | *Aeromonas encheleia* |
| SBP00209 | American ginseng_1 | *Aeromonas encheleia* |
| SBP00209 | American ginseng_1 | *Aeromonas hydrophila* |
| SBP00209 | American ginseng_1 | *Aeromonas hydrophila* |
| SBP00209 | American ginseng_1 | *Aeromonas media* |
| SBP00209 | American ginseng_1 | *Aeromonas media* |
| SBP00209 | American ginseng_1 | *Aeromonas salmonicida* |
| SBP00209 | American ginseng_1 | *Aeromonas salmonicida* |
| SBP00209 | American ginseng_1 | *Aeromonas schubertii* |
| SBP00209 | American ginseng_1 | *Aeromonas schubertii* |
| SBP00209 | American ginseng_1 | *Aeromonas* sp. |
| SBP00209 | American ginseng_1 | *Aeromonas* sp. |
| SBP00209 | American ginseng_1 | *Aeromonas* sp. ASNIH1 |
| SBP00209 | American ginseng_1 | *Aeromonas* sp. ASNIH1 |
| SBP00209 | American ginseng_1 | *Aeromonas* sp. CA23 |
| SBP00209 | American ginseng_1 | *Aeromonas* sp. CA23 |
| SBP00209 | American ginseng_1 | *Aeromonas veronii* |
| SBP00209 | American ginseng_1 | *Aeromonas veronii* |
| SBP00209 | American ginseng_1 | *Afipia* sp. GAS231 |
| SBP00209 | American ginseng_1 | *Afipia* sp. GAS231 |
| SBP00209 | American ginseng_1 | *Agarilytica rhodophyticola* |
| SBP00209 | American ginseng_1 | *Agarilytica rhodophyticola* |
| SBP00209 | American ginseng_1 | *Agarivorans gilvus* |
| SBP00209 | American ginseng_1 | *Agarivorans gilvus* |
| SBP00209 | American ginseng_1 | *Aggregatibacter segnis* |
| SBP00209 | American ginseng_1 | *Aggregatibacter segnis* |
| SBP00209 | American ginseng_1 | *Agrobacterium fabrum* |
| SBP00209 | American ginseng_1 | *Agrobacterium fabrum* |
| SBP00209 | American ginseng_1 | *Agrobacterium larrymoorei* |
| SBP00209 | American ginseng_1 | *Agrobacterium larrymoorei* |
| SBP00209 | American ginseng_1 | *Agrobacterium rhizogenes* |
| SBP00209 | American ginseng_1 | *Agrobacterium rhizogenes* |
| SBP00209 | American ginseng_1 | *Agrobacterium* sp. |
| SBP00209 | American ginseng_1 | *Agrobacterium* sp. |
| SBP00209 | American ginseng_1 | *Agrobacterium* sp. H13-3 |
| SBP00209 | American ginseng_1 | *Agrobacterium* sp. H13-3 |
| SBP00209 | American ginseng_1 | *Agrobacterium* sp. RAC06 |
| SBP00209 | American ginseng_1 | *Agrobacterium* sp. RAC06 |
| SBP00209 | American ginseng_1 | *Agrobacterium tumefaciens* |
| SBP00209 | American ginseng_1 | *Agrobacterium tumefaciens* |
| SBP00209 | American ginseng_1 | *Agrobacterium vitis* |
| SBP00209 | American ginseng_1 | *Agrobacterium vitis* |
| SBP00209 | American ginseng_1 | *Agrococcus carbonis* |
| SBP00209 | American ginseng_1 | *Agrococcus carbonis* |
| SBP00209 | American ginseng_1 | *Agrococcus jejuensis* |
| SBP00209 | American ginseng_1 | *Agrococcus jejuensis* |
| SBP00209 | American ginseng_1 | *Agrococcus* sp. SGAir0287 |
| SBP00209 | American ginseng_1 | *Agrococcus* sp. SGAir0287 |
| SBP00209 | American ginseng_1 | *Agromyces aureus* |
| SBP00209 | American ginseng_1 | *Agromyces aureus* |
| SBP00209 | American ginseng_1 | *Agromyces flavus* |
| SBP00209 | American ginseng_1 | *Agromyces flavus* |
| SBP00209 | American ginseng_1 | *Agromyces* sp. 30A |
| SBP00209 | American ginseng_1 | *Agromyces* sp. 30A |
| SBP00209 | American ginseng_1 | *Agromyces* sp. LHK192 |

TABLE 3-continued

List of species identified in each metagenomic sample of each SBP Sample

| SBP ID | SBP Host Common Name | Genus sp. |
|---|---|---|
| SBP00209 | American ginseng_1 | *Agromyces* sp. LHK192 |
| SBP00209 | American ginseng_1 | *Ahniella affigens* |
| SBP00209 | American ginseng_1 | *Ahniella affigens* |
| SBP00209 | American ginseng_1 | *Alcaligenes faecalis* |
| SBP00209 | American ginseng_1 | *Alcaligenes faecalis* |
| SBP00209 | American ginseng_1 | *Alcanivorax dieselolei* |
| SBP00209 | American ginseng_1 | *Alcanivorax dieselolei* |
| SBP00209 | American ginseng_1 | *Alcanivorax pacificus* |
| SBP00209 | American ginseng_1 | *Alcanivorax pacificus* |
| SBP00209 | American ginseng_1 | *Alcanivorax* sp. N3-2A |
| SBP00209 | American ginseng_1 | *Alcanivorax* sp. N3-2A |
| SBP00209 | American ginseng_1 | *Alcanivorax xenomutans* |
| SBP00209 | American ginseng_1 | *Alcanivorax xenomutans* |
| SBP00209 | American ginseng_1 | *Algibacter alginicilyticus* |
| SBP00209 | American ginseng_1 | *Algibacter alginicilyticus* |
| SBP00209 | American ginseng_1 | *Algoriphagus machipongonensis* |
| SBP00209 | American ginseng_1 | *Algoriphagus machipongonensis* |
| SBP00209 | American ginseng_1 | *Alicycliphilus denitrificans* |
| SBP00209 | American ginseng_1 | *Alicycliphilus denitrificans* |
| SBP00209 | American ginseng_1 | *Alicyclobacillus acidocaldarius* |
| SBP00209 | American ginseng_1 | *Alicyclobacillus acidocaldarius* |
| SBP00209 | American ginseng_1 | *Aliivibrio fischeri* |
| SBP00209 | American ginseng_1 | *Aliivibrio fischeri* |
| SBP00209 | American ginseng_1 | *Aliivibrio wodanis* |
| SBP00209 | American ginseng_1 | *Aliivibrio wodanis* |
| SBP00209 | American ginseng_1 | *Alistipes shahii* |
| SBP00209 | American ginseng_1 | *Alistipes shahii* |
| SBP00209 | American ginseng_1 | *Alistipes* sp. Marseille-P5997 |
| SBP00209 | American ginseng_1 | *Alistipes* sp. Marseille-P5997 |
| SBP00209 | American ginseng_1 | *Alkalilimnicola ehrlichii* |
| SBP00209 | American ginseng_1 | *Alkalilimnicola ehrlichii* |
| SBP00209 | American ginseng_1 | *Alkaliphilus metalliredigens* |
| SBP00209 | American ginseng_1 | *Alkaliphilus metalliredigens* |
| SBP00209 | American ginseng_1 | *Alkaliphilus oremlandii* |
| SBP00209 | American ginseng_1 | *Alkaliphilus oremlandii* |
| SBP00209 | American ginseng_1 | *Alkalitalea saponilacus* |
| SBP00209 | American ginseng_1 | *Alkalitalea saponilacus* |
| SBP00209 | American ginseng_1 | *Alloactinosynnema* sp. L-07 |
| SBP00209 | American ginseng_1 | *Alloactinosynnema* sp. 1-07 |
| SBP00209 | American ginseng_1 | *Allochromatium vinosum* |
| SBP00209 | American ginseng_1 | *Allochromatium vinosum* |
| SBP00209 | American ginseng_1 | *Allokutzneria albata* |
| SBP00209 | American ginseng_1 | *Allokutzneria albata* |
| SBP00209 | American ginseng_1 | *Alphaproteobacteria bacterium* WS11 |
| SBP00209 | American ginseng_1 | *Alphaproteobacteria bacterium* WS11 |
| SBP00209 | American ginseng_1 | *Altererythrobacter atlanticus* |
| SBP00209 | American ginseng_1 | *Altererythrobacter atlanticus* |
| SBP00209 | American ginseng_1 | *Altererythrobacter dongtanensis* |
| SBP00209 | American ginseng_1 | *Altererythrobacter dongtanensis* |
| SBP00209 | American ginseng_1 | *Altererythrobacter epoxidivorans* |
| SBP00209 | American ginseng_1 | *Altererythrobacter epoxidivorans* |
| SBP00209 | American ginseng_1 | *Altererythrobacter ishigakiensis* |
| SBP00209 | American ginseng_1 | *Altererythrobacter ishigakiensis* |
| SBP00209 | American ginseng_1 | *Altererythrobacter mangrovi* |
| SBP00209 | American ginseng_1 | *Altererythrobacter mangrovi* |
| SBP00209 | American ginseng_1 | *Altererythrobacter marensis* |
| SBP00209 | American ginseng_1 | *Altererythrobacter marensis* |
| SBP00209 | American ginseng_1 | *Altererythrobacter namhicola* |
| SBP00209 | American ginseng_1 | *Altererythrobacter namhicola* |
| SBP00209 | American ginseng_1 | *Altererythrobacter* sp. B11 |
| SBP00209 | American ginseng_1 | *Altererythrobacter* sp. B11 |
| SBP00209 | American ginseng_1 | *Altererythrobacter* sp. NS1 |
| SBP00209 | American ginseng_1 | *Altererythrobacter* sp. NS1 |
| SBP00209 | American ginseng_1 | *Altererythrobacter* sp. ZODW24 |
| SBP00209 | American ginseng_1 | *Altererythrobacter* sp. ZODW24 |
| SBP00209 | American ginseng_1 | *Alteromonas australica* |
| SBP00209 | American ginseng_1 | *Alteromonas australica* |
| SBP00209 | American ginseng_1 | *Alteromonas macleodii* |
| SBP00209 | American ginseng_1 | *Alteromonas macleodii* |
| SBP00209 | American ginseng_1 | *Alteromonas mediterranea* |
| SBP00209 | American ginseng_1 | *Alteromonas mediterranea* |
| SBP00209 | American ginseng_1 | *Alteromonas* sp. BL110 |
| SBP00209 | American ginseng_1 | *Alteromonas* sp. BL110 |
| SBP00209 | American ginseng_1 | Amazon lily mosaic virus |
| SBP00209 | American ginseng_1 | Amazon lily mosaic virus |
| SBP00209 | American ginseng_1 | *Aminobacter aminovorans* |

TABLE 3-continued

List of species identified in each metagenomic sample of each SBP Sample

| SBP ID | SBP Host Common Name | Genus sp. |
|---|---|---|
| SBP00209 | American ginseng_1 | *Aminobacter aminovorans* |
| SBP00209 | American ginseng_1 | *Aminobacter* sp. MSH1 |
| SBP00209 | American ginseng_1 | *Aminobacter* sp. MSH1 |
| SBP00209 | American ginseng_1 | *Aminomonas paucivorans* |
| SBP00209 | American ginseng_1 | *Aminomonas paucivorans* |
| SBP00209 | American ginseng_1 | *Amphibacillus xylanus* |
| SBP00209 | American ginseng_1 | *Amphibacillus xylanus* |
| SBP00209 | American ginseng_1 | *Amycolatopsis albispora* |
| SBP00209 | American ginseng_1 | *Amycolatopsis albispora* |
| SBP00209 | American ginseng_1 | *Amycolatopsis japonica* |
| SBP00209 | American ginseng_1 | *Amycolatopsis japonica* |
| SBP00209 | American ginseng_1 | *Amycolatopsis keratiniphila* |
| SBP00209 | American ginseng_1 | *Amycolatopsis keratiniphila* |
| SBP00209 | American ginseng_1 | *Amycolatopsis mediterranei* |
| SBP00209 | American ginseng_1 | *Amycolatopsis mediterranei* |
| SBP00209 | American ginseng_1 | *Amycolatopsis methanolica* |
| SBP00209 | American ginseng_1 | *Amycolatopsis methanolica* |
| SBP00209 | American ginseng_1 | *Amycolatopsis orientalis* |
| SBP00209 | American ginseng_1 | *Amycolatopsis orientalis* |
| SBP00209 | American ginseng_1 | *Amycolatopsis* sp. AA4 |
| SBP00209 | American ginseng_1 | *Amycolatopsis* sp. AA4 |
| SBP00209 | American ginseng_1 | *Amycolatopsis* sp. BJA-103 |
| SBP00209 | American ginseng_1 | *Amycolatopsis* sp. BJA-103 |
| SBP00209 | American ginseng_1 | *Anabaena cylindrica* |
| SBP00209 | American ginseng_1 | *Anabaena cylindrica* |
| SBP00209 | American ginseng_1 | *Anabaena* sp. 90 |
| SBP00209 | American ginseng_1 | *Anabaena* sp. 90 |
| SBP00209 | American ginseng_1 | *Anabaenopsis circularis* |
| SBP00209 | American ginseng_1 | *Anabaenopsis circularis* |
| SBP00209 | American ginseng_1 | *Anaerococcus mediterraneensis* |
| SBP00209 | American ginseng_1 | *Anaerococcus mediterraneensis* |
| SBP00209 | American ginseng_1 | *Anaerolinea thermophila* |
| SBP00209 | American ginseng_1 | *Anaerolinea thermophila* |
| SBP00209 | American ginseng_1 | *Anaeromyxobacter dehalogenans* |
| SBP00209 | American ginseng_1 | *Anaeromyxobacter dehalogenans* |
| SBP00209 | American ginseng_1 | *Anaeromyxobacter* sp. Fw109-5 |
| SBP00209 | American ginseng_1 | *Anaeromyxobacter* sp. Fw109-5 |
| SBP00209 | American ginseng_1 | *Anaerostipes hadrus* |
| SBP00209 | American ginseng_1 | *Anaerostipes hadrus* |
| SBP00209 | American ginseng_1 | *Anaerostipes rhamnosivorans* |
| SBP00209 | American ginseng_1 | *Anaerostipes rhamnosivorans* |
| SBP00209 | American ginseng_1 | *Anderseniella* sp. Alg231-50 |
| SBP00209 | American ginseng_1 | *Anderseniella* sp. Alg231-50 |
| SBP00209 | American ginseng_1 | *Aneurinibacillus* sp. XH2 |
| SBP00209 | American ginseng_1 | *Aneurinibacillus* sp. XH2 |
| SBP00209 | American ginseng_1 | *Anoxybacillus amylolyticus* |
| SBP00209 | American ginseng_1 | *Anoxybacillus amylolyticus* |
| SBP00209 | American ginseng_1 | *Anoxybacter fermentans* |
| SBP00209 | American ginseng_1 | *Anoxybacter fermentans* |
| SBP00209 | American ginseng_1 | *Antarcticibacterium flavum* |
| SBP00209 | American ginseng_1 | *Antarcticibacterium flavum* |
| SBP00209 | American ginseng_1 | *Antarctobacter heliothermus* |
| SBP00209 | American ginseng_1 | *Antarctobacter heliothermus* |
| SBP00209 | American ginseng_1 | *Apibacter* sp. HY041 |
| SBP00209 | American ginseng_1 | *Apibacter* sp. HY041 |
| SBP00209 | American ginseng_1 | *Aquabacterium olei* |
| SBP00209 | American ginseng_1 | *Aquabacterium olei* |
| SBP00209 | American ginseng_1 | *Aquaspirillum* sp. LM1 |
| SBP00209 | American ginseng_1 | *Aquaspirillum* sp. LM1 |
| SBP00209 | American ginseng_1 | *Aquiflexum balticum* |
| SBP00209 | American ginseng_1 | *Aquiflexum balticum* |
| SBP00209 | American ginseng_1 | *Aquimarina* sp. AD1 |
| SBP00209 | American ginseng_1 | *Aquimarina* sp. AD1 |
| SBP00209 | American ginseng_1 | *Aquimarina* sp. AD10 |
| SBP00209 | American ginseng_1 | *Aquimarina* sp. AD10 |
| SBP00209 | American ginseng_1 | *Aquimarina* sp. BL5 |
| SBP00209 | American ginseng_1 | *Aquimarina* sp. BL5 |
| SBP00209 | American ginseng_1 | *Aquitalea magnusonii* |
| SBP00209 | American ginseng_1 | *Aquitalea magnusonii* |
| SBP00209 | American ginseng_1 | *Aquitalea* sp. THG-DN7.12 |
| SBP00209 | American ginseng_1 | *Aquitalea* sp. THG-DN7.12 |
| SBP00209 | American ginseng_1 | *Aquitalea* sp. USM4 |
| SBP00209 | American ginseng_1 | *Aquitalea* sp. USM4 |
| SBP00209 | American ginseng_1 | *Arachidicoccus* sp. BS20 |
| SBP00209 | American ginseng_1 | *Arachidicoccus* sp. BS20 |
| SBP00209 | American ginseng_1 | *Arachidicoccus* sp. KIS59-12 |

TABLE 3-continued

List of species identified in each metagenomic sample of each SBP Sample

| SBP ID | SBP Host Common Name | Genus sp. |
|---|---|---|
| SBP00209 | American ginseng_1 | *Arachidicoccus* sp. KIS59-12 |
| SBP00209 | American ginseng_1 | *Archaeoglobus profundus* |
| SBP00209 | American ginseng_1 | *Archaeoglobus profundus* |
| SBP00209 | American ginseng_1 | archaeon AArc-SI |
| SBP00209 | American ginseng_1 | archaeon AArc-SI |
| SBP00209 | American ginseng_1 | *Archangium gephyra* |
| SBP00209 | American ginseng_1 | *Archangium gephyra* |
| SBP00209 | American ginseng_1 | *Arcobacter anaerophilus* |
| SBP00209 | American ginseng_1 | *Arcobacter anaerophilus* |
| SBP00209 | American ginseng_1 | *Arcobacter bivalviorum* |
| SBP00209 | American ginseng_1 | *Arcobacter bivalviorum* |
| SBP00209 | American ginseng_1 | *Arcobacter butzleri* |
| SBP00209 | American ginseng_1 | *Arcobacter butzleri* |
| SBP00209 | American ginseng_1 | *Arcobacter cryaerophilus* |
| SBP00209 | American ginseng_1 | *Arcobacter cryaerophilus* |
| SBP00209 | American ginseng_1 | *Arcobacter ellisii* |
| SBP00209 | American ginseng_1 | *Arcobacter ellisii* |
| SBP00209 | American ginseng_1 | *Arcobacter halophilus* |
| SBP00209 | American ginseng_1 | *Arcobacter halophilus* |
| SBP00209 | American ginseng_1 | *Arcobacter marinus* |
| SBP00209 | American ginseng_1 | *Arcobacter marinus* |
| SBP00209 | American ginseng_1 | *Arcobacter molluscorum* |
| SBP00209 | American ginseng_1 | *Arcobacter molluscorum* |
| SBP00209 | American ginseng_1 | *Arcobacter mytili* |
| SBP00209 | American ginseng_1 | *Arcobacter mytili* |
| SBP00209 | American ginseng_1 | *Arcobacter nitrofigilis* |
| SBP00209 | American ginseng_1 | *Arcobacter nitrofigilis* |
| SBP00209 | American ginseng_1 | *Arcobacter pacificus* |
| SBP00209 | American ginseng_1 | *Arcobacter pacificus* |
| SBP00209 | American ginseng_1 | *Arcobacter skirrowii* |
| SBP00209 | American ginseng_1 | *Arcobacter skirrowii* |
| SBP00209 | American ginseng_1 | *Arcobacter* sp. PSE-93 |
| SBP00209 | American ginseng_1 | *Arcobacter* sp. PSE-93 |
| SBP00209 | American ginseng_1 | *Arcobacter suis* |
| SBP00209 | American ginseng_1 | *Arcobacter suis* |
| SBP00209 | American ginseng_1 | *Arcobacter trophiarum* |
| SBP00209 | American ginseng_1 | *Arcobacter trophiarum* |
| SBP00209 | American ginseng_1 | *Arcticibacterium luteifluviistationis* |
| SBP00209 | American ginseng_1 | *Arcticibacterium luteifluviistationis* |
| SBP00209 | American ginseng_1 | *Arenibacter algicola* |
| SBP00209 | American ginseng_1 | *Arenibacter algicola* |
| SBP00209 | American ginseng_1 | *Aromatoleum aromaticum* |
| SBP00209 | American ginseng_1 | *Aromatoleum aromaticum* |
| SBP00209 | American ginseng_1 | *Arsenicicoccus* sp. oral taxon 190 |
| SBP00209 | American ginseng_1 | *Arsenicicoccus* sp. oral taxon 190 |
| SBP00209 | American ginseng_1 | *Arsenophonus nasoniae* |
| SBP00209 | American ginseng_1 | *Arsenophonus nasoniae* |
| SBP00209 | American ginseng_1 | *Arthrobacter alpinus* |
| SBP00209 | American ginseng_1 | *Arthrobacter alpinus* |
| SBP00209 | American ginseng_1 | *Arthrobacter crystallopoietes* |
| SBP00209 | American ginseng_1 | *Arthrobacter crystallopoietes* |
| SBP00209 | American ginseng_1 | *Arthrobacter* sp. DCT-5 |
| SBP00209 | American ginseng_1 | *Arthrobacter* sp. DCT-5 |
| SBP00209 | American ginseng_1 | *Arthrobacter* sp. ERGS1:01 |
| SBP00209 | American ginseng_1 | *Arthrobacter* sp. ERGS1:01 |
| SBP00209 | American ginseng_1 | *Arthrobacter* sp. FB24 |
| SBP00209 | American ginseng_1 | *Arthrobacter* sp. FB24 |
| SBP00209 | American ginseng_1 | *Arthrobacter* sp. PAMC 25486 |
| SBP00209 | American ginseng_1 | *Arthrobacter* sp. PAMC 25486 |
| SBP00209 | American ginseng_1 | *Arthrobacter* sp. PGP41 |
| SBP00209 | American ginseng_1 | *Arthrobacter* sp. PGP41 |
| SBP00209 | American ginseng_1 | *Arthrobacter* sp. QXT-31 |
| SBP00209 | American ginseng_1 | *Arthrobacter* sp. QXT-31 |
| SBP00209 | American ginseng_1 | *Arthrobacter* sp. U41 |
| SBP00209 | American ginseng_1 | *Arthrobacter* sp. U41 |
| SBP00209 | American ginseng_1 | *Arthrobacter* sp. YC-RL1 |
| SBP00209 | American ginseng_1 | *Arthrobacter* sp. YC-RL1 |
| SBP00209 | American ginseng_1 | *Arthrobacter* sp. YN |
| SBP00209 | American ginseng_1 | *Arthrobacter* sp. YN |
| SBP00209 | American ginseng_1 | *Arthrospira platensis* |
| SBP00209 | American ginseng_1 | *Arthrospira platensis* |
| SBP00209 | American ginseng_1 | *Arthrospira* sp. TJSD092 |
| SBP00209 | American ginseng_1 | *Arthrospira* sp. TJSD092 |
| SBP00209 | American ginseng_1 | *Asticcacaulis excentricus* |
| SBP00209 | American ginseng_1 | *Asticcacaulis excentricus* |
| SBP00209 | American ginseng_1 | *Atlantibacter hermannii* |

TABLE 3-continued

List of species identified in each metagenomic sample of each SBP Sample

| SBP ID | SBP Host Common Name | Genus sp. |
|---|---|---|
| SBP00209 | American ginseng_1 | *Atlantibacter hermannii* |
| SBP00209 | American ginseng_1 | *Auraticoccus monumenti* |
| SBP00209 | American ginseng_1 | *Auraticoccus monumenti* |
| SBP00209 | American ginseng_1 | *Aureimonas* sp. AU20 |
| SBP00209 | American ginseng_1 | *Aureimonas* sp. AU20 |
| SBP00209 | American ginseng_1 | *Aureitalea* sp. RR4-38 |
| SBP00209 | American ginseng_1 | *Aureitalea* sp. RR4-38 |
| SBP00209 | American ginseng_1 | *Aureococcus anophagefferens* virus |
| SBP00209 | American ginseng_1 | *Aureococcus anophagefferens* virus |
| SBP00209 | American ginseng_1 | *Auricoccus indicus* |
| SBP00209 | American ginseng_1 | *Auricoccus indicus* |
| SBP00209 | American ginseng_1 | *Austwickia chelonae* |
| SBP00209 | American ginseng_1 | *Austwickia chelonae* |
| SBP00209 | American ginseng_1 | *Azoarcus communis* |
| SBP00209 | American ginseng_1 | *Azoarcus communis* |
| SBP00209 | American ginseng_1 | *Azoarcus* sp. CIB |
| SBP00209 | American ginseng_1 | *Azoarcus* sp. CIB |
| SBP00209 | American ginseng_1 | *Azoarcus* sp. DN11 |
| SBP00209 | American ginseng_1 | *Azoarcus* sp. DN11 |
| SBP00209 | American ginseng_1 | *Azoarcus* sp. KH32C |
| SBP00209 | American ginseng_1 | *Azoarcus* sp. KH32C |
| SBP00209 | American ginseng_1 | *Azoarcus* sp. SY39 |
| SBP00209 | American ginseng_1 | *Azoarcus* sp. SY39 |
| SBP00209 | American ginseng_1 | *Azorhizobium caulinodans* |
| SBP00209 | American ginseng_1 | *Azorhizobium caulinodans* |
| SBP00209 | American ginseng_1 | *Azospira oryzae* |
| SBP00209 | American ginseng_1 | *Azospira oryzae* |
| SBP00209 | American ginseng_1 | *Azospirillum brasilense* |
| SBP00209 | American ginseng_1 | *Azospirillum brasilense* |
| SBP00209 | American ginseng_1 | *Azospirillum humicireducens* |
| SBP00209 | American ginseng_1 | *Azospirillum humicireducens* |
| SBP00209 | American ginseng_1 | *Azospirillum lipoferum* |
| SBP00209 | American ginseng_1 | *Azospirillum lipoferum* |
| SBP00209 | American ginseng_1 | *Azospirillum* sp. CFH 70021 |
| SBP00209 | American ginseng_1 | *Azospirillum* sp. CFH 70021 |
| SBP00209 | American ginseng_1 | *Azospirillum* sp. M2T2B2 |
| SBP00209 | American ginseng_1 | *Azospirillum* sp. M2T2B2 |
| SBP00209 | American ginseng_1 | *Azospirillum* sp. TSA2s |
| SBP00209 | American ginseng_1 | *Azospirillum* sp. TSA2s |
| SBP00209 | American ginseng_1 | *Azospirillum* sp. TSH100 |
| SBP00209 | American ginseng_1 | *Azospirillum* sp. TSH100 |
| SBP00209 | American ginseng_1 | *Azospirillum* sp. TSH58 |
| SBP00209 | American ginseng_1 | *Azospirillum* sp. TSH58 |
| SBP00209 | American ginseng_1 | *Azospirillum thiophilum* |
| SBP00209 | American ginseng_1 | *Azospirillum thiophilum* |
| SBP00209 | American ginseng_1 | *Azotobacter chroococcum* |
| SBP00209 | American ginseng_1 | *Azotobacter chroococcum* |
| SBP00209 | American ginseng_1 | *Azotobacter vinelandii* |
| SBP00209 | American ginseng_1 | *Azotobacter vinelandii* |
| SBP00209 | American ginseng_1 | *Bacillus altitudinis* |
| SBP00209 | American ginseng_1 | *Bacillus altitudinis* |
| SBP00209 | American ginseng_1 | *Bacillus amyloliquefaciens* |
| SBP00209 | American ginseng_1 | *Bacillus amyloliquefaciens* |
| SBP00209 | American ginseng_1 | *Bacillus anthracis* |
| SBP00209 | American ginseng_1 | *Bacillus anthracis* |
| SBP00209 | American ginseng_1 | *Bacillus asahii* |
| SBP00209 | American ginseng_1 | *Bacillus asahii* |
| SBP00209 | American ginseng_1 | *Bacillus atrophaeus* |
| SBP00209 | American ginseng_1 | *Bacillus atrophaeus* |
| SBP00209 | American ginseng_1 | *Bacillus beveridgei* |
| SBP00209 | American ginseng_1 | *Bacillus beveridgei* |
| SBP00209 | American ginseng_1 | *Bacillus bombysepticus* |
| SBP00209 | American ginseng_1 | *Bacillus bombysepticus* |
| SBP00209 | American ginseng_1 | *Bacillus butanolivorans* |
| SBP00209 | American ginseng_1 | *Bacillus butanolivorans* |
| SBP00209 | American ginseng_1 | *Bacillus cellulosilyticus* |
| SBP00209 | American ginseng_1 | *Bacillus cellulosilyticus* |
| SBP00209 | American ginseng_1 | *Bacillus cereus* |
| SBP00209 | American ginseng_1 | *Bacillus cereus* |
| SBP00209 | American ginseng_1 | *Bacillus ciccensis* |
| SBP00209 | American ginseng_1 | *Bacillus ciccensis* |
| SBP00209 | American ginseng_1 | *Bacillus clausii* |
| SBP00209 | American ginseng_1 | *Bacillus clausii* |
| SBP00209 | American ginseng_1 | *Bacillus coagulans* |
| SBP00209 | American ginseng_1 | *Bacillus coagulans* |
| SBP00209 | American ginseng_1 | *Bacillus cohnii* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Bacillus cohnii* |
| SBP00209 | American ginseng_1 | *Bacillus cytotoxicus* |
| SBP00209 | American ginseng_1 | *Bacillus cytotoxicus* |
| SBP00209 | American ginseng_1 | *Bacillus flexus* |
| SBP00209 | American ginseng_1 | *Bacillus flexus* |
| SBP00209 | American ginseng_1 | *Bacillus foraminis* |
| SBP00209 | American ginseng_1 | *Bacillus foraminis* |
| SBP00209 | American ginseng_1 | *Bacillus freudenreichii* |
| SBP00209 | American ginseng_1 | *Bacillus freudenreichii* |
| SBP00209 | American ginseng_1 | *Bacillus glycinifermentans* |
| SBP00209 | American ginseng_1 | *Bacillus glycinifermentans* |
| SBP00209 | American ginseng_1 | *Bacillus gobiensis* |
| SBP00209 | American ginseng_1 | *Bacillus gobiensis* |
| SBP00209 | American ginseng_1 | *Bacillus halodurans* |
| SBP00209 | American ginseng_1 | *Bacillus halodurans* |
| SBP00209 | American ginseng_1 | *Bacillus halotolerans* |
| SBP00209 | American ginseng_1 | *Bacillus halotolerans* |
| SBP00209 | American ginseng_1 | *Bacillus horikoshii* |
| SBP00209 | American ginseng_1 | *Bacillus horikoshii* |
| SBP00209 | American ginseng_1 | *Bacillus infantis* |
| SBP00209 | American ginseng_1 | *Bacillus infantis* |
| SBP00209 | American ginseng_1 | *Bacillus krulwichiae* |
| SBP00209 | American ginseng_1 | *Bacillus krulwichiae* |
| SBP00209 | American ginseng_1 | *Bacillus lehensis* |
| SBP00209 | American ginseng_1 | *Bacillus lehensis* |
| SBP00209 | American ginseng_1 | *Bacillus litoralis* |
| SBP00209 | American ginseng_1 | *Bacillus litoralis* |
| SBP00209 | American ginseng_1 | *Bacillus megaterium* |
| SBP00209 | American ginseng_1 | *Bacillus megaterium* |
| SBP00209 | American ginseng_1 | *Bacillus muralis* |
| SBP00209 | American ginseng_1 | *Bacillus muralis* |
| SBP00209 | American ginseng_1 | *Bacillus mycoides* |
| SBP00209 | American ginseng_1 | *Bacillus mycoides* |
| SBP00209 | American ginseng_1 | *Bacillus oceanisediminis* |
| SBP00209 | American ginseng_1 | *Bacillus oceanisediminis* |
| SBP00209 | American ginseng_1 | *Bacillus phage Eldridge* |
| SBP00209 | American ginseng_1 | *Bacillus phage Eldridge* |
| SBP00209 | American ginseng_1 | *Bacillus phage Mater* |
| SBP00209 | American ginseng_1 | *Bacillus phage Mater* |
| SBP00209 | American ginseng_1 | *Bacillus pseudofirmus* |
| SBP00209 | American ginseng_1 | *Bacillus pseudofirmus* |
| SBP00209 | American ginseng_1 | *Bacillus pseudomycoides* |
| SBP00209 | American ginseng_1 | *Bacillus pseudomycoides* |
| SBP00209 | American ginseng_1 | *Bacillus pumilus* |
| SBP00209 | American ginseng_1 | *Bacillus pumilus* |
| SBP00209 | American ginseng_1 | *Bacillus safensis* |
| SBP00209 | American ginseng_1 | *Bacillus safensis* |
| SBP00209 | American ginseng_1 | *Bacillus simplex* |
| SBP00209 | American ginseng_1 | *Bacillus simplex* |
| SBP00209 | American ginseng_1 | *Bacillus sp.* (in: Bacteria) |
| SBP00209 | American ginseng_1 | *Bacillus sp.* (in: Bacteria) |
| SBP00209 | American ginseng_1 | *Bacillus sp.* ABP14 |
| SBP00209 | American ginseng_1 | *Bacillus sp.* ABP14 |
| SBP00209 | American ginseng_1 | *Bacillus sp.* FJAT-18017 |
| SBP00209 | American ginseng_1 | *Bacillus sp.* FJAT-18017 |
| SBP00209 | American ginseng_1 | *Bacillus sp.* FJAT-22090 |
| SBP00209 | American ginseng_1 | *Bacillus sp.* FJAT-22090 |
| SBP00209 | American ginseng_1 | *Bacillus sp.* FJAT-42376 |
| SBP00209 | American ginseng_1 | *Bacillus sp.* FJAT-42376 |
| SBP00209 | American ginseng_1 | *Bacillus sp.* FJAT-45348 |
| SBP00209 | American ginseng_1 | *Bacillus sp.* FJAT-45348 |
| SBP00209 | American ginseng_1 | *Bacillus sp.* OxB-1 |
| SBP00209 | American ginseng_1 | *Bacillus sp.* OxB-1 |
| SBP00209 | American ginseng_1 | *Bacillus sp.* Y-01 |
| SBP00209 | American ginseng_1 | *Bacillus sp.* Y-01 |
| SBP00209 | American ginseng_1 | *Bacillus sp.* Y1 |
| SBP00209 | American ginseng_1 | *Bacillus sp.* Y1 |
| SBP00209 | American ginseng_1 | *Bacillus subtilis* |
| SBP00209 | American ginseng_1 | *Bacillus subtilis* |
| SBP00209 | American ginseng_1 | *Bacillus thuringiensis* |
| SBP00209 | American ginseng_1 | *Bacillus thuringiensis* |
| SBP00209 | American ginseng_1 | *Bacillus vallismortis* |
| SBP00209 | American ginseng_1 | *Bacillus vallismortis* |
| SBP00209 | American ginseng_1 | *Bacillus velezensis* |
| SBP00209 | American ginseng_1 | *Bacillus velezensis* |
| SBP00209 | American ginseng_1 | *Bacillus* virus G |

TABLE 3-continued

List of species identified in each metagenomic sample of each SBP Sample

| SBP ID | SBP Host Common Name | Genus sp. |
|---|---|---|
| SBP00209 | American ginseng_1 | *Bacillus* virus G |
| SBP00209 | American ginseng_1 | *Bacterioplanes sanyensis* |
| SBP00209 | American ginseng_1 | *Bacterioplanes sanyensis* |
| SBP00209 | American ginseng_1 | *Bacteriovorax stolpii* |
| SBP00209 | American ginseng_1 | *Bacteriovorax stolpii* |
| SBP00209 | American ginseng_1 | *Bacteroidales bacterium* CF |
| SBP00209 | American ginseng_1 | *Bacteroidales bacterium* CF |
| SBP00209 | American ginseng_1 | *Bacteroides caccae* |
| SBP00209 | American ginseng_1 | *Bacteroides caccae* |
| SBP00209 | American ginseng_1 | *Bacteroides cellulosilyticus* |
| SBP00209 | American ginseng_1 | *Bacteroides cellulosilyticus* |
| SBP00209 | American ginseng_1 | *Bacteroides dorei* |
| SBP00209 | American ginseng_1 | *Bacteroides dorei* |
| SBP00209 | American ginseng_1 | *Bacteroides fragilis* |
| SBP00209 | American ginseng_1 | *Bacteroides fragilis* |
| SBP00209 | American ginseng_1 | *Bacteroides heparinolyticus* |
| SBP00209 | American ginseng_1 | *Bacteroides heparinolyticus* |
| SBP00209 | American ginseng_1 | *Bacteroides satanitronis* |
| SBP00209 | American ginseng_1 | *Bacteroides satanitronis* |
| SBP00209 | American ginseng_1 | *Bacteroides thetaiotaomicron* |
| SBP00209 | American ginseng_1 | *Bacteroides thetaiotaomicron* |
| SBP00209 | American ginseng_1 | *Bacteroides uniformis* |
| SBP00209 | American ginseng_1 | *Bacteroides uniformis* |
| SBP00209 | American ginseng_1 | *Bacteroides vulgatus* |
| SBP00209 | American ginseng_1 | *Bacteroides vulgatus* |
| SBP00209 | American ginseng_1 | *Bartonella australis* |
| SBP00209 | American ginseng_1 | *Bartonella australis* |
| SBP00209 | American ginseng_1 | *Bartonella birtlesii* |
| SBP00209 | American ginseng_1 | *Bartonella birtlesii* |
| SBP00209 | American ginseng_1 | *Bartonella* sp. OE 1-1 |
| SBP00209 | American ginseng_1 | *Bartonella* sp. OE 1-1 |
| SBP00209 | American ginseng_1 | *Bartonella tribocorum* |
| SBP00209 | American ginseng_1 | *Bartonella tribocorum* |
| SBP00209 | American ginseng_1 | Bat associated circovirus 4 |
| SBP00209 | American ginseng_1 | Bat associated circovirus 4 |
| SBP00209 | American ginseng_1 | *Bathymodiolus thermophilus thioautotrophic gill* symbiont |
| SBP00209 | American ginseng_1 | *Bathymodiolus thermophilus thioautotrophic gill* symbiont |
| SBP00209 | American ginseng_1 | *Bdellovibrio bacteriovorus* |
| SBP00209 | American ginseng_1 | *Bdellovibrio bacteriovorus* |
| SBP00209 | American ginseng_1 | *Beijerinckia indica* |
| SBP00209 | American ginseng_1 | *Beijerinckia indica* |
| SBP00209 | American ginseng_1 | *Beijerinckiaceae bacterium* |
| SBP00209 | American ginseng_1 | *Beijerinckiaceae bacterium* |
| SBP00209 | American ginseng_1 | *Belliella baltica* |
| SBP00209 | American ginseng_1 | *Belliella baltica* |
| SBP00209 | American ginseng_1 | *Bernardetia litoralis* |
| SBP00209 | American ginseng_1 | *Bernardetia litoralis* |
| SBP00209 | American ginseng_1 | *Betaproteobacteria bacterium* GR16-43 |
| SBP00209 | American ginseng_1 | *Betaproteobacteria bacterium* GR16-43 |
| SBP00209 | American ginseng_1 | *Beutenbergia cavernae* |
| SBP00209 | American ginseng_1 | *Beutenbergia cavernae* |
| SBP00209 | American ginseng_1 | *Bibersteinia trehalosi* |
| SBP00209 | American ginseng_1 | *Bibersteinia trehalosi* |
| SBP00209 | American ginseng_1 | *Bifidobacterium animalis* |
| SBP00209 | American ginseng_1 | *Bifidobacterium animalis* |
| SBP00209 | American ginseng_1 | *Bifidobacterium bifidum* |
| SBP00209 | American ginseng_1 | *Bifidobacterium bifidum* |
| SBP00209 | American ginseng_1 | *Bifidobacterium breve* |
| SBP00209 | American ginseng_1 | *Bifidobacterium breve* |
| SBP00209 | American ginseng_1 | *Bifidobacterium kashiwanohense* |
| SBP00209 | American ginseng_1 | *Bifidobacterium kashiwanohense* |
| SBP00209 | American ginseng_1 | *Bifidobacterium pseudolongum* |
| SBP00209 | American ginseng_1 | *Bifidobacterium pseudolongum* |
| SBP00209 | American ginseng_1 | *Bifidobacterium scardovii* |
| SBP00209 | American ginseng_1 | *Bifidobacterium scardovii* |
| SBP00209 | American ginseng_1 | *Blastochloris* sp. GI |
| SBP00209 | American ginseng_1 | *Blastochloris* sp. GI |
| SBP00209 | American ginseng_1 | *Blastochloris viridis* |
| SBP00209 | American ginseng_1 | *Blastochloris viridis* |
| SBP00209 | American ginseng_1 | *Blastococcus saxobsidens* |
| SBP00209 | American ginseng_1 | *Blastococcus saxobsidens* |
| SBP00209 | American ginseng_1 | *Blastomonas fulva* |
| SBP00209 | American ginseng_1 | *Blastomonas fulva* |
| SBP00209 | American ginseng_1 | *Blastomonas* sp. RAC04 |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Blastomonas* sp. RAC04 |
| SBP00209 | American ginseng_1 | *Blautia producta* |
| SBP00209 | American ginseng_1 | *Blautia producta* |
| SBP00209 | American ginseng_1 | blood disease bacterium AZ-HR MARDI |
| SBP00209 | American ginseng_1 | blood disease bacterium AZ-HR MARDI |
| SBP00209 | American ginseng_1 | Blueberry latent spherical virus |
| SBP00209 | American ginseng_1 | Blueberry latent spherical virus |
| SBP00209 | American ginseng_1 | *Bordetella bronchialis* |
| SBP00209 | American ginseng_1 | *Bordetella bronchialis* |
| SBP00209 | American ginseng_1 | *Bordetella bronchiseptica* |
| SBP00209 | American ginseng_1 | *Bordetella bronchiseptica* |
| SBP00209 | American ginseng_1 | *Bordetella flabilis* |
| SBP00209 | American ginseng_1 | *Bordetella flabilis* |
| SBP00209 | American ginseng_1 | *Bordetella* genomosp. 13 |
| SBP00209 | American ginseng_1 | *Bordetella* genomosp. 13 |
| SBP00209 | American ginseng_1 | *Bordetella* genomosp. 8 |
| SBP00209 | American ginseng_1 | *Bordetella* genomosp. 8 |
| SBP00209 | American ginseng_1 | *Bordetella* genomosp. 9 |
| SBP00209 | American ginseng_1 | *Bordetella* genomosp. 9 |
| SBP00209 | American ginseng_1 | *Bordetella hinzii* |
| SBP00209 | American ginseng_1 | *Bordetella hinzii* |
| SBP00209 | American ginseng_1 | *Bordetella holmesii* |
| SBP00209 | American ginseng_1 | *Bordetella holmesii* |
| SBP00209 | American ginseng_1 | *Bordetella petrii* |
| SBP00209 | American ginseng_1 | *Bordetella petrii* |
| SBP00209 | American ginseng_1 | *Bordetella pseudohinzii* |
| SBP00209 | American ginseng_1 | *Bordetella pseudohinzii* |
| SBP00209 | American ginseng_1 | *Bordetella* sp. H567 |
| SBP00209 | American ginseng_1 | *Bordetella* sp. H567 |
| SBP00209 | American ginseng_1 | *Bordetella* sp. N |
| SBP00209 | American ginseng_1 | *Bordetella* sp. N |
| SBP00209 | American ginseng_1 | *Bordetella trematum* |
| SBP00209 | American ginseng_1 | *Bordetella trematum* |
| SBP00209 | American ginseng_1 | *Borrelia crocidurae* |
| SBP00209 | American ginseng_1 | *Borrelia crocidurae* |
| SBP00209 | American ginseng_1 | *Borrelia hermsii* |
| SBP00209 | American ginseng_1 | *Borrelia hermsii* |
| SBP00209 | American ginseng_1 | *Bosea* sp. AS-1 |
| SBP00209 | American ginseng_1 | *Bosea* sp. AS-1 |
| SBP00209 | American ginseng_1 | *Bosea* sp. PAMC 26642 |
| SBP00209 | American ginseng_1 | *Bosea* sp. PAMC 26642 |
| SBP00209 | American ginseng_1 | *Bosea* sp. RAC05 |
| SBP00209 | American ginseng_1 | *Bosea* sp. RAC05 |
| SBP00209 | American ginseng_1 | *Bosea* sp. Tri-49 |
| SBP00209 | American ginseng_1 | *Bosea* sp. Tri-49 |
| SBP00209 | American ginseng_1 | *Bosea vaviloviae* |
| SBP00209 | American ginseng_1 | *Bosea vaviloviae* |
| SBP00209 | American ginseng_1 | *Brachybacterium faecium* |
| SBP00209 | American ginseng_1 | *Brachybacterium faecium* |
| SBP00209 | American ginseng_1 | *Brachybacterium ginsengisoli* |
| SBP00209 | American ginseng_1 | *Brachybacterium ginsengisoli* |
| SBP00209 | American ginseng_1 | *Brachybacterium saurashtrense* |
| SBP00209 | American ginseng_1 | *Brachybacterium saurashtrense* |
| SBP00209 | American ginseng_1 | *Brachybacterium* sp. P6-10-X1 |
| SBP00209 | American ginseng_1 | *Brachybacterium* sp. P6-10-X1 |
| SBP00209 | American ginseng_1 | *Brachybacterium* sp. VM2412 |
| SBP00209 | American ginseng_1 | *Brachybacterium* sp. VM2412 |
| SBP00209 | American ginseng_1 | *Brachybacterium* sp. VR2415 |
| SBP00209 | American ginseng_1 | *Brachybacterium* sp. VR2415 |
| SBP00209 | American ginseng_1 | *Brachyspira hampsonii* |
| SBP00209 | American ginseng_1 | *Brachyspira hampsonii* |
| SBP00209 | American ginseng_1 | *Brachyspira hyodysenteriae* |
| SBP00209 | American ginseng_1 | *Brachyspira hyodysenteriae* |
| SBP00209 | American ginseng_1 | *Brachyspira intermedia* |
| SBP00209 | American ginseng_1 | *Brachyspira intermedia* |
| SBP00209 | American ginseng_1 | *Brachyspira pilosicoli* |
| SBP00209 | American ginseng_1 | *Brachyspira pilosicoli* |
| SBP00209 | American ginseng_1 | *Bradymonas sediminis* |
| SBP00209 | American ginseng_1 | *Bradymonas sediminis* |
| SBP00209 | American ginseng_1 | *Bradyrhizobiaceae* bacterium SG-6C |
| SBP00209 | American ginseng_1 | *Bradyrhizobiaceae* bacterium SG-6C |
| SBP00209 | American ginseng_1 | *Bradyrhizobium diazoefficiens* |
| SBP00209 | American ginseng_1 | *Bradyrhizobium diazoefficiens* |
| SBP00209 | American ginseng_1 | *Bradyrhizobium erythrophlei* |
| SBP00209 | American ginseng_1 | *Bradyrhizobium erythrophlei* |
| SBP00209 | American ginseng_1 | *Bradyrhizobium guangdongense* |

TABLE 3-continued

List of species identified in each metagenomic sample of each SBP Sample

| SBP ID | SBP Host Common Name | Genus sp. |
|---|---|---|
| SBP00209 | American ginseng_1 | Bradyrhizobium guangdongense |
| SBP00209 | American ginseng_1 | Bradyrhizobium guangxiense |
| SBP00209 | American ginseng_1 | Bradyrhizobium guangxiense |
| SBP00209 | American ginseng_1 | Bradyrhizobium icense |
| SBP00209 | American ginseng_1 | Bradyrhizobium icense |
| SBP00209 | American ginseng_1 | Bradyrhizobium japonicum |
| SBP00209 | American ginseng_1 | Bradyrhizobium japonicum |
| SBP00209 | American ginseng_1 | Bradyrhizobium lablabi |
| SBP00209 | American ginseng_1 | Bradyrhizobium lablabi |
| SBP00209 | American ginseng_1 | Bradyrhizobium oligotrophicum |
| SBP00209 | American ginseng_1 | Bradyrhizobium oligotrophicum |
| SBP00209 | American ginseng_1 | Bradyrhizobium ottawaense |
| SBP00209 | American ginseng_1 | Bradyrhizobium ottawaense |
| SBP00209 | American ginseng_1 | Bradyrhizobium sp. |
| SBP00209 | American ginseng_1 | Bradyrhizobium sp. |
| SBP00209 | American ginseng_1 | Bradyrhizobium sp. 2 39S1MB |
| SBP00209 | American ginseng_1 | Bradyrhizobium sp. 2 3951MB |
| SBP00209 | American ginseng_1 | Bradyrhizobium sp. 3 |
| SBP00209 | American ginseng_1 | Bradyrhizobium sp. 3 |
| SBP00209 | American ginseng_1 | Bradyrhizobium sp. 3 8551MB |
| SBP00209 | American ginseng_1 | Bradyrhizobium sp. 3 8551MB |
| SBP00209 | American ginseng_1 | Bradyrhizobium sp. BTAi1 |
| SBP00209 | American ginseng_1 | Bradyrhizobium sp. BTAi1 |
| SBP00209 | American ginseng_1 | Bradyrhizobium sp. CCBAU 51670 |
| SBP00209 | American ginseng_1 | Bradyrhizobium sp. CCBAU 51670 |
| SBP00209 | American ginseng_1 | Bradyrhizobium sp. CCBAU 51778 |
| SBP00209 | American ginseng_1 | Bradyrhizobium sp. CCBAU 51778 |
| SBP00209 | American ginseng_1 | Bradyrhizobium sp. CCGE-LA001 |
| SBP00209 | American ginseng_1 | Bradyrhizobium sp. CCGE-LA001 |
| SBP00209 | American ginseng_1 | Bradyrhizobium sp. ORS 278 |
| SBP00209 | American ginseng_1 | Bradyrhizobium sp. ORS 278 |
| SBP00209 | American ginseng_1 | Bradyrhizobium sp. ORS 285 |
| SBP00209 | American ginseng_1 | Bradyrhizobium sp. ORS 285 |
| SBP00209 | American ginseng_1 | Bradyrhizobium sp. ORS 3257 |
| SBP00209 | American ginseng_1 | Bradyrhizobium sp. ORS 3257 |
| SBP00209 | American ginseng_1 | Bradyrhizobium sp. S23321 |
| SBP00209 | American ginseng_1 | Bradyrhizobium sp. S23321 |
| SBP00209 | American ginseng_1 | Bradyrhizobium sp. SK17 |
| SBP00209 | American ginseng_1 | Bradyrhizobium sp. SK17 |
| SBP00209 | American ginseng_1 | Bradyrhizobium sp. WSM471 |
| SBP00209 | American ginseng_1 | Bradyrhizobium sp. WSM471 |
| SBP00209 | American ginseng_1 | Brenneria rubrifaciens |
| SBP00209 | American ginseng_1 | Brenneria rubrifaciens |
| SBP00209 | American ginseng_1 | Breoghania sp. L-A4 |
| SBP00209 | American ginseng_1 | Breoghania sp. L-A4 |
| SBP00209 | American ginseng_1 | Brevibacillus agri |
| SBP00209 | American ginseng_1 | Brevibacillus agri |
| SBP00209 | American ginseng_1 | Brevibacillus brevis |
| SBP00209 | American ginseng_1 | Brevibacillus brevis |
| SBP00209 | American ginseng_1 | Brevibacillus formosus |
| SBP00209 | American ginseng_1 | Brevibacillus formosus |
| SBP00209 | American ginseng_1 | Brevibacillus laterosporus |
| SBP00209 | American ginseng_1 | Brevibacillus laterosporus |
| SBP00209 | American ginseng_1 | Brevibacterium aurantiacum |
| SBP00209 | American ginseng_1 | Brevibacterium aurantiacum |
| SBP00209 | American ginseng_1 | Brevibacterium linens |
| SBP00209 | American ginseng_1 | Brevibacterium linens |
| SBP00209 | American ginseng_1 | Brevibacterium sandarakinum |
| SBP00209 | American ginseng_1 | Brevibacterium sandarakinum |
| SBP00209 | American ginseng_1 | Brevibacterium siliguriense |
| SBP00209 | American ginseng_1 | Brevibacterium siliguriense |
| SBP00209 | American ginseng_1 | Brevirhabdus pacifica |
| SBP00209 | American ginseng_1 | Brevirhabdus pacifica |
| SBP00209 | American ginseng_1 | Brevundimonas diminuta |
| SBP00209 | American ginseng_1 | Brevundimonas diminuta |
| SBP00209 | American ginseng_1 | Brevundimonas naejangsanensis |
| SBP00209 | American ginseng_1 | Brevundimonas naejangsanensis |
| SBP00209 | American ginseng_1 | Brevundimonas sp. DS20 |
| SBP00209 | American ginseng_1 | Brevundimonas sp. DS20 |
| SBP00209 | American ginseng_1 | Brevundimonas sp. GW460-12-10-14-LB2 |
| SBP00209 | American ginseng_1 | Brevundimonas sp. GW460-12-10-14-LB2 |
| SBP00209 | American ginseng_1 | Brevundimonas sp. LM2 |
| SBP00209 | American ginseng_1 | Brevundimonas sp. LM2 |
| SBP00209 | American ginseng_1 | Brevundimonas subvibrioides |
| SBP00209 | American ginseng_1 | Brevundimonas subvibrioides |
| SBP00209 | American ginseng_1 | Brevundimonas vancanneytii |

TABLE 3-continued

List of species identified in each metagenomic sample of each SBP Sample

| SBP ID | SBP Host Common Name | Genus sp. |
|---|---|---|
| SBP00209 | American ginseng_1 | Brevundimonas vancanneytii |
| SBP00209 | American ginseng_1 | Brevundimonas vesicularis |
| SBP00209 | American ginseng_1 | Brevundimonas vesicularis |
| SBP00209 | American ginseng_1 | Brucella suis |
| SBP00209 | American ginseng_1 | Brucella suis |
| SBP00209 | American ginseng_1 | Buchnera aphidicola |
| SBP00209 | American ginseng_1 | Buchnera aphidicola |
| SBP00209 | American ginseng_1 | Burkholderia ambifaria |
| SBP00209 | American ginseng_1 | Burkholderia ambifaria |
| SBP00209 | American ginseng_1 | Burkholderia anthina |
| SBP00209 | American ginseng_1 | Burkholderia anthina |
| SBP00209 | American ginseng_1 | Burkholderia cenocepacia |
| SBP00209 | American ginseng_1 | Burkholderia cenocepacia |
| SBP00209 | American ginseng_1 | Burkholderia cepacia |
| SBP00209 | American ginseng_1 | Burkholderia cepacia |
| SBP00209 | American ginseng_1 | Burkholderia contaminans |
| SBP00209 | American ginseng_1 | Burkholderia contaminans |
| SBP00209 | American ginseng_1 | Burkholderia diffusa |
| SBP00209 | American ginseng_1 | Burkholderia diffusa |
| SBP00209 | American ginseng_1 | Burkholderia dolosa |
| SBP00209 | American ginseng_1 | Burkholderia dolosa |
| SBP00209 | American ginseng_1 | Burkholderia gladioli |
| SBP00209 | American ginseng_1 | Burkholderia gladioli |
| SBP00209 | American ginseng_1 | Burkholderia glumae |
| SBP00209 | American ginseng_1 | Burkholderia glumae |
| SBP00209 | American ginseng_1 | Burkholderia insecticola |
| SBP00209 | American ginseng_1 | Burkholderia insecticola |
| SBP00209 | American ginseng_1 | Burkholderia lata |
| SBP00209 | American ginseng_1 | Burkholderia lata |
| SBP00209 | American ginseng_1 | Burkholderia latens |
| SBP00209 | American ginseng_1 | Burkholderia latens |
| SBP00209 | American ginseng_1 | Burkholderia metallica |
| SBP00209 | American ginseng_1 | Burkholderia metallica |
| SBP00209 | American ginseng_1 | Burkholderia multivorans |
| SBP00209 | American ginseng_1 | Burkholderia multivorans |
| SBP00209 | American ginseng_1 | Burkholderia oklahomensis |
| SBP00209 | American ginseng_1 | Burkholderia oklahomensis |
| SBP00209 | American ginseng_1 | Burkholderia plantarii |
| SBP00209 | American ginseng_1 | Burkholderia plantarii |
| SBP00209 | American ginseng_1 | Burkholderia pseudomallei |
| SBP00209 | American ginseng_1 | Burkholderia pseudomallei |
| SBP00209 | American ginseng_1 | Burkholderia pyrrocinia |
| SBP00209 | American ginseng_1 | Burkholderia pyrrocinia |
| SBP00209 | American ginseng_1 | Burkholderia seminalis |
| SBP00209 | American ginseng_1 | Burkholderia seminalis |
| SBP00209 | American ginseng_1 | Burkholderia sp. AD24 |
| SBP00209 | American ginseng_1 | Burkholderia sp. AD24 |
| SBP00209 | American ginseng_1 | Burkholderia sp. BDU6 |
| SBP00209 | American ginseng_1 | Burkholderia sp. BDU6 |
| SBP00209 | American ginseng_1 | Burkholderia sp. BDU8 |
| SBP00209 | American ginseng_1 | Burkholderia sp. BDU8 |
| SBP00209 | American ginseng_1 | Burkholderia sp. Bp7605 |
| SBP00209 | American ginseng_1 | Burkholderia sp. Bp7605 |
| SBP00209 | American ginseng_1 | Burkholderia sp. CCGE1001 |
| SBP00209 | American ginseng_1 | Burkholderia sp. CCGE1001 |
| SBP00209 | American ginseng_1 | Burkholderia sp. CCGE1002 |
| SBP00209 | American ginseng_1 | Burkholderia sp. CCGE1002 |
| SBP00209 | American ginseng_1 | Burkholderia sp. CCGE1003 |
| SBP00209 | American ginseng_1 | Burkholderia sp. CCGE1003 |
| SBP00209 | American ginseng_1 | Burkholderia sp. HB1 |
| SBP00209 | American ginseng_1 | Burkholderia sp. HB1 |
| SBP00209 | American ginseng_1 | Burkholderia sp. IDO3 |
| SBP00209 | American ginseng_1 | Burkholderia sp. IDO3 |
| SBP00209 | American ginseng_1 | Burkholderia sp. JP2-270 |
| SBP00209 | American ginseng_1 | Burkholderia sp. JP2-270 |
| SBP00209 | American ginseng_1 | Burkholderia sp. KK1 |
| SBP00209 | American ginseng_1 | Burkholderia sp. KK1 |
| SBP00209 | American ginseng_1 | Burkholderia sp. MSMB0856 |
| SBP00209 | American ginseng_1 | Burkholderia sp. MSMB0856 |
| SBP00209 | American ginseng_1 | Burkholderia sp. NRF60-BP8 |
| SBP00209 | American ginseng_1 | Burkholderia sp. NRF60-BP8 |
| SBP00209 | American ginseng_1 | Burkholderia sp. OLGA172 |
| SBP00209 | American ginseng_1 | Burkholderia sp. OLGA172 |
| SBP00209 | American ginseng_1 | Burkholderia sp. PAMC 26561 |
| SBP00209 | American ginseng_1 | Burkholderia sp. PAMC 26561 |
| SBP00209 | American ginseng_1 | Burkholderia sp. RPE67 |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Burkholderia* sp. RPE67 |
| SBP00209 | American ginseng_1 | *Burkholderia* sp. YI23 |
| SBP00209 | American ginseng_1 | *Burkholderia* sp. YI23 |
| SBP00209 | American ginseng_1 | *Burkholderia stabilis* |
| SBP00209 | American ginseng_1 | *Burkholderia stabilis* |
| SBP00209 | American ginseng_1 | *Burkholderia stagnalis* |
| SBP00209 | American ginseng_1 | *Burkholderia stagnalis* |
| SBP00209 | American ginseng_1 | *Burkholderia territorii* |
| SBP00209 | American ginseng_1 | *Burkholderia territorii* |
| SBP00209 | American ginseng_1 | *Burkholderia thailandensis* |
| SBP00209 | American ginseng_1 | *Burkholderia thailandensis* |
| SBP00209 | American ginseng_1 | *Burkholderia ubonensis* |
| SBP00209 | American ginseng_1 | *Burkholderia ubonensis* |
| SBP00209 | American ginseng_1 | *Burkholderia vietnamiensis* |
| SBP00209 | American ginseng_1 | *Burkholderia vietnamiensis* |
| SBP00209 | American ginseng_1 | *Burkholderiales bacterium* GJ-E10 |
| SBP00209 | American ginseng_1 | *Burkholderiales bacterium* GJ-E10 |
| SBP00209 | American ginseng_1 | *Burkholderiales bacterium* JOSHI_001 |
| SBP00209 | American ginseng_1 | *Burkholderiales bacterium* JOSHI_001 |
| SBP00209 | American ginseng_1 | *Burkholderiales bacterium* YL45 |
| SBP00209 | American ginseng_1 | *Burkholderiales bacterium* YL45 |
| SBP00209 | American ginseng_1 | *Buttiauxella* sp. 3AFRM03 |
| SBP00209 | American ginseng_1 | *Buttiauxella* sp. 3AFRM03 |
| SBP00209 | American ginseng_1 | *Butyricimonas* sp. H184 |
| SBP00209 | American ginseng_1 | *Butyricimonas* sp. H184 |
| SBP00209 | American ginseng_1 | *Butyrivibrio fibrisolvens* |
| SBP00209 | American ginseng_1 | *Butyrivibrio fibrisolvens* |
| SBP00209 | American ginseng_1 | *Butyrivibrio hungatei* |
| SBP00209 | American ginseng_1 | *Butyrivibrio hungatei* |
| SBP00209 | American ginseng_1 | *Butyrivibrio proteoclasticus* |
| SBP00209 | American ginseng_1 | *Butyrivibrio proteoclasticus* |
| SBP00209 | American ginseng_1 | *Cafeteria roenbergensis* virus |
| SBP00209 | American ginseng_1 | *Cafeteria roenbergensis* virus |
| SBP00209 | American ginseng_1 | *Caldicellulosiruptor changbaiensis* |
| SBP00209 | American ginseng_1 | *Caldicellulosiruptor changbaiensis* |
| SBP00209 | American ginseng_1 | *Caldicellulosiruptor saccharolyticus* |
| SBP00209 | American ginseng_1 | *Caldicellulosiruptor saccharolyticus* |
| SBP00209 | American ginseng_1 | *Caldilinea aerophila* |
| SBP00209 | American ginseng_1 | *Caldilinea aerophila* |
| SBP00209 | American ginseng_1 | *Caldisericum exile* |
| SBP00209 | American ginseng_1 | *Caldisericum exile* |
| SBP00209 | American ginseng_1 | *Calditerrivibrio nitroreducens* |
| SBP00209 | American ginseng_1 | *Calditerrivibrio nitroreducens* |
| SBP00209 | American ginseng_1 | *Calothrix brevissima* |
| SBP00209 | American ginseng_1 | *Calothrix brevissima* |
| SBP00209 | American ginseng_1 | *Calothrix parasitica* |
| SBP00209 | American ginseng_1 | *Calothrix parasitica* |
| SBP00209 | American ginseng_1 | *Calothrix parietina* |
| SBP00209 | American ginseng_1 | *Calothrix parietina* |
| SBP00209 | American ginseng_1 | *Calothrix* sp. NIES-2098 |
| SBP00209 | American ginseng_1 | *Calothrix* sp. NIES-2098 |
| SBP00209 | American ginseng_1 | *Calothrix* sp. NIES-2100 |
| SBP00209 | American ginseng_1 | *Calothrix* sp. NIES-2100 |
| SBP00209 | American ginseng_1 | *Calothrix* sp. NIES-3974 |
| SBP00209 | American ginseng_1 | *Calothrix* sp. NIES-3974 |
| SBP00209 | American ginseng_1 | *Calothrix* sp. PCC 7507 |
| SBP00209 | American ginseng_1 | *Calothrix* sp. PCC 7507 |
| SBP00209 | American ginseng_1 | *Calyptogena okutanii thioautotrophic gill* symbiont |
| SBP00209 | American ginseng_1 | *Calyptogena okutanii thioautotrophic gill* symbiont |
| SBP00209 | American ginseng_1 | *Caminibacter mediatlanticus* |
| SBP00209 | American ginseng_1 | *Caminibacter mediatlanticus* |
| SBP00209 | American ginseng_1 | *Campylobacter avium* |
| SBP00209 | American ginseng_1 | *Campylobacter avium* |
| SBP00209 | American ginseng_1 | *Campylobacter coli* |
| SBP00209 | American ginseng_1 | *Campylobacter coli* |
| SBP00209 | American ginseng_1 | *Campylobacter concisus* |
| SBP00209 | American ginseng_1 | *Campylobacter concisus* |
| SBP00209 | American ginseng_1 | *Campylobacter cuniculorum* |
| SBP00209 | American ginseng_1 | *Campylobacter cuniculorum* |
| SBP00209 | American ginseng_1 | *Campylobacter fetus* |
| SBP00209 | American ginseng_1 | *Campylobacter fetus* |
| SBP00209 | American ginseng_1 | *Campylobacter hyointestinalis* |
| SBP00209 | American ginseng_1 | *Campylobacter hyointestinalis* |
| SBP00209 | American ginseng_1 | *Campylobacter insulaenigrae* |
| SBP00209 | American ginseng_1 | *Campylobacter insulaenigrae* |
| SBP00209 | American ginseng_1 | *Campylobacter jejuni* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Campylobacter jejuni* |
| SBP00209 | American ginseng_1 | *Campylobacter lari* |
| SBP00209 | American ginseng_1 | *Campylobacter lari* |
| SBP00209 | American ginseng_1 | *Campylobacter pinnipediorum* |
| SBP00209 | American ginseng_1 | *Campylobacter pinnipediorum* |
| SBP00209 | American ginseng_1 | *Campylobacter* sp. RM12175 |
| SBP00209 | American ginseng_1 | *Campylobacter* sp. RM12175 |
| SBP00209 | American ginseng_1 | *Campylobacter* sp. RM6137 |
| SBP00209 | American ginseng_1 | *Campylobacter* sp. RM6137 |
| SBP00209 | American ginseng_1 | *Campylobacter sputorum* |
| SBP00209 | American ginseng_1 | *Campylobacter sputorum* |
| SBP00209 | American ginseng_1 | *Campylobacter ureolyticus* |
| SBP00209 | American ginseng_1 | *Campylobacter ureolyticus* |
| SBP00209 | American ginseng_1 | Candidatus *Accumulibacter phosphatis* |
| SBP00209 | American ginseng_1 | Candidatus *Accumulibacter phosphatis* |
| SBP00209 | American ginseng_1 | Candidatus *Aquiluna* sp. UB-MaderosW2red |
| SBP00209 | American ginseng_1 | Candidatus *Aquiluna* sp. UB-MaderosW2red |
| SBP00209 | American ginseng_1 | Candidatus *Atelocyanobacterium thalassa* |
| SBP00209 | American ginseng_1 | Candidatus *Atelocyanobacterium thalassa* |
| SBP00209 | American ginseng_1 | Candidatus *Babela massiliensis* |
| SBP00209 | American ginseng_1 | Candidatus *Babela massiliensis* |
| SBP00209 | American ginseng_1 | Candidatus *Cardinium hertigii* |
| SBP00209 | American ginseng_1 | Candidatus *Cardinium hertigii* |
| SBP00209 | American ginseng_1 | Candidatus *Cloacimonas acidaminovorans* |
| SBP00209 | American ginseng_1 | Candidatus *Cloacimonas acidaminovorans* |
| SBP00209 | American ginseng_1 | Candidatus *Coxiella mudrowiae* |
| SBP00209 | American ginseng_1 | Candidatus *Coxiella mudrowiae* |
| SBP00209 | American ginseng_1 | Candidatus *Dependentiae bacterium* (ex *Spumella elongata* CCAP 955/1) |
| SBP00209 | American ginseng_1 | Candidatus *Dependentiae bacterium* (ex *Spumella elongata* CCAP 955/1) |
| SBP00209 | American ginseng_1 | Candidatus *Endolissoclinum faulkneri* |
| SBP00209 | American ginseng_1 | Candidatus *Endolissoclinum faulkneri* |
| SBP00209 | American ginseng_1 | Candidatus *Filomicrobium marinum* |
| SBP00209 | American ginseng_1 | Candidatus *Filomicrobium marinum* |
| SBP00209 | American ginseng_1 | Candidatus *Fokinia solitaria* |
| SBP00209 | American ginseng_1 | Candidatus *Fokinia solitaria* |
| SBP00209 | American ginseng_1 | Candidatus *Fonsibacter ubiquis* |
| SBP00209 | American ginseng_1 | Candidatus *Fonsibacter ubiquis* |
| SBP00209 | American ginseng_1 | Candidatus *Hamiltonella defensa* |
| SBP00209 | American ginseng_1 | Candidatus *Hamiltonella defensa* |
| SBP00209 | American ginseng_1 | Candidatus *Kinetoplastibacterium crithidii* |
| SBP00209 | American ginseng_1 | Candidatus *Kinetoplastibacterium crithidii* |
| SBP00209 | American ginseng_1 | Candidatus *Koribacter versatilis* |
| SBP00209 | American ginseng_1 | Candidatus *Koribacter versatilis* |
| SBP00209 | American ginseng_1 | Candidatus *Kuenenia stuttgartiensis* |
| SBP00209 | American ginseng_1 | Candidatus *Kuenenia stuttgartiensis* |
| SBP00209 | American ginseng_1 | Candidatus *Methanomassiliicoccus intestinalis* |
| SBP00209 | American ginseng_1 | Candidatus *Methanomassiliicoccus intestinalis* |
| SBP00209 | American ginseng_1 | Candidatus *Methylopumilus planktonicus* |
| SBP00209 | American ginseng_1 | Candidatus *Methylopumilus planktonicus* |
| SBP00209 | American ginseng_1 | Candidatus *Nitrosocaldus islandicus* |
| SBP00209 | American ginseng_1 | Candidatus *Nitrosocaldus islandicus* |
| SBP00209 | American ginseng_1 | Candidatus *Nitrosomarinus catalina* |
| SBP00209 | American ginseng_1 | Candidatus *Nitrosomarinus catalina* |
| SBP00209 | American ginseng_1 | Candidatus *Nitrosopelagicus brevis* |
| SBP00209 | American ginseng_1 | Candidatus *Nitrosopelagicus brevis* |
| SBP00209 | American ginseng_1 | Candidatus *Nitrosopumilus adriaticus* |
| SBP00209 | American ginseng_1 | Candidatus *Nitrosopumilus adriaticus* |
| SBP00209 | American ginseng_1 | Candidatus *Nitrosotenuis aquarius* |
| SBP00209 | American ginseng_1 | Candidatus Nitrosotenuis aquarius |
| SBP00209 | American ginseng_1 | Candidatus *Nitrosotenuis cloacae* |
| SBP00209 | American ginseng_1 | Candidatus *Nitrosotenuis cloacae* |
| SBP00209 | American ginseng_1 | Candidatus *Pantoea carbekii* |
| SBP00209 | American ginseng_1 | Candidatus *Pantoea carbekii* |
| SBP00209 | American ginseng_1 | Candidatus *Pelagibacter* sp. IMCC9063 |
| SBP00209 | American ginseng_1 | Candidatus *Pelagibacter* sp. IMCC9063 |
| SBP00209 | American ginseng_1 | Candidatus *Pelagibacter* sp. RS40 |
| SBP00209 | American ginseng_1 | Candidatus *Pelagibacter* sp. RS40 |
| SBP00209 | American ginseng_1 | Candidatus *Phaeomarinobacter ectocarpi* |
| SBP00209 | American ginseng_1 | Candidatus *Phaeomarinobacter ectocarpi* |
| SBP00209 | American ginseng_1 | Candidatus *Phycorickettsia trachydisci* |
| SBP00209 | American ginseng_1 | Candidatus *Phycorickettsia trachydisci* |
| SBP00209 | American ginseng_1 | Candidatus *Phytoplasma australiense* |
| SBP00209 | American ginseng_1 | Candidatus *Phytoplasma australiense* |
| SBP00209 | American ginseng_1 | Candidatus *Portiera aleyrodidarum* |

TABLE 3-continued

List of species identified in each metagenomic sample of each SBP Sample

| SBP ID | SBP Host Common Name | Genus sp. |
|---|---|---|
| SBP00209 | American ginseng_1 | *Candidatus Portiera aleyrodidarum* |
| SBP00209 | American ginseng_1 | *Candidatus Promineofilum breve* |
| SBP00209 | American ginseng_1 | *Candidatus Promineofilum breve* |
| SBP00209 | American ginseng_1 | *Candidatus Protochlamydia amoebophila* |
| SBP00209 | American ginseng_1 | *Candidatus Protochlamydia amoebophila* |
| SBP00209 | American ginseng_1 | *Candidatus Rhodoluna limnophila* |
| SBP00209 | American ginseng_1 | *Candidatus Rhodoluna limnophila* |
| SBP00209 | American ginseng_1 | *Candidatus Ruthia magnifica* |
| SBP00209 | American ginseng_1 | *Candidatus Ruthia magnifica* |
| SBP00209 | American ginseng_1 | *Candidatus Solibacter usitatus* |
| SBP00209 | American ginseng_1 | *Candidatus Solibacter usitatus* |
| SBP00209 | American ginseng_1 | *Candidatus Sulcia muelleri* |
| SBP00209 | American ginseng_1 | *Candidatus Sulcia muelleri* |
| SBP00209 | American ginseng_1 | *Candidatus Symbiobacter mobilis* |
| SBP00209 | American ginseng_1 | *Candidatus Symbiobacter mobilis* |
| SBP00209 | American ginseng_1 | *Candidatus Thiodictyon syntrophicum* |
| SBP00209 | American ginseng_1 | *Candidatus Thiodictyon syntrophicum* |
| SBP00209 | American ginseng_1 | *Candidatus Thioglobus singularis* |
| SBP00209 | American ginseng_1 | *Candidatus Thioglobus singularis* |
| SBP00209 | American ginseng_1 | *Capnocytophaga canimorsus* |
| SBP00209 | American ginseng_1 | *Capnocytophaga canimorsus* |
| SBP00209 | American ginseng_1 | *Capnocytophaga sputigena* |
| SBP00209 | American ginseng_1 | *Capnocytophaga sputigena* |
| SBP00209 | American ginseng_1 | *Capnocytophaga stomatis* |
| SBP00209 | American ginseng_1 | *Capnocytophaga stomatis* |
| SBP00209 | American ginseng_1 | *Carboxydothermus hydrogenoformans* |
| SBP00209 | American ginseng_1 | *Carboxydothermus hydrogenoformans* |
| SBP00209 | American ginseng_1 | *Carnobacterium divergens* |
| SBP00209 | American ginseng_1 | *Carnobacterium divergens* |
| SBP00209 | American ginseng_1 | *Carnobacterium maltaromaticum* |
| SBP00209 | American ginseng_1 | *Carnobacterium maltaromaticum* |
| SBP00209 | American ginseng_1 | *Castellaniella defragrans* |
| SBP00209 | American ginseng_1 | *Castellaniella defragrans* |
| SBP00209 | American ginseng_1 | *Catenulispora acidiphila* |
| SBP00209 | American ginseng_1 | *Catenulispora acidiphila* |
| SBP00209 | American ginseng_1 | *Caulobacter flavus* |
| SBP00209 | American ginseng_1 | *Caulobacter flavus* |
| SBP00209 | American ginseng_1 | *Caulobacter henricii* |
| SBP00209 | American ginseng_1 | *Caulobacter henricii* |
| SBP00209 | American ginseng_1 | *Caulobacter mirabilis* |
| SBP00209 | American ginseng_1 | *Caulobacter mirabilis* |
| SBP00209 | American ginseng_1 | *Caulobacter segnis* |
| SBP00209 | American ginseng_1 | *Caulobacter segnis* |
| SBP00209 | American ginseng_1 | *Caulobacter* sp. FWC26 |
| SBP00209 | American ginseng_1 | *Caulobacter* sp. FWC26 |
| SBP00209 | American ginseng_1 | *Caulobacter* sp. K31 |
| SBP00209 | American ginseng_1 | *Caulobacter* sp. K31 |
| SBP00209 | American ginseng_1 | *Caulobacter vibrioides* |
| SBP00209 | American ginseng_1 | *Caulobacter vibrioides* |
| SBP00209 | American ginseng_1 | *Caulobacteraceae bacterium* OTSz_A_272 |
| SBP00209 | American ginseng_1 | *Caulobacteraceae bacterium* OTSz_A_272 |
| SBP00209 | American ginseng_1 | *Cedecea lapagei* |
| SBP00209 | American ginseng_1 | *Cedecea lapagei* |
| SBP00209 | American ginseng_1 | *Cedecea neteri* |
| SBP00209 | American ginseng_1 | *Cedecea neteri* |
| SBP00209 | American ginseng_1 | *Celeribacter ethanolicus* |
| SBP00209 | American ginseng_1 | *Celeribacter ethanolicus* |
| SBP00209 | American ginseng_1 | *Celeribacter indicus* |
| SBP00209 | American ginseng_1 | *Celeribacter indicus* |
| SBP00209 | American ginseng_1 | *Celeribacter manganoxidans* |
| SBP00209 | American ginseng_1 | *Celeribacter manganoxidans* |
| SBP00209 | American ginseng_1 | *Cellulomonas fimi* |
| SBP00209 | American ginseng_1 | *Cellulomonas fimi* |
| SBP00209 | American ginseng_1 | *Cellulomonas flavigena* |
| SBP00209 | American ginseng_1 | *Cellulomonas flavigena* |
| SBP00209 | American ginseng_1 | *Cellulomonas gilvus* |
| SBP00209 | American ginseng_1 | *Cellulomonas gilvus* |
| SBP00209 | American ginseng_1 | *Cellulomonas* sp. PSBB021 |
| SBP00209 | American ginseng_1 | *Cellulomonas* sp. PSBB021 |
| SBP00209 | American ginseng_1 | *Cellulophaga algicola* |
| SBP00209 | American ginseng_1 | *Cellulophaga algicola* |
| SBP00209 | American ginseng_1 | *Cellulophaga lytica* |
| SBP00209 | American ginseng_1 | *Cellulophaga lytica* |
| SBP00209 | American ginseng_1 | *Cellulosimicrobium cellulans* |
| SBP00209 | American ginseng_1 | *Cellulosimicrobium cellulans* |
| SBP00209 | American ginseng_1 | *Cellulosimicrobium* sp. TH-20 |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Cellulosimicrobium* sp. TH-20 |
| SBP00209 | American ginseng_1 | *Cercopithecine* alphaherpesvirus 2 |
| SBP00209 | American ginseng_1 | *Cercopithecine* alphaherpesvirus 2 |
| SBP00209 | American ginseng_1 | *Chamaesiphon minutus* |
| SBP00209 | American ginseng_1 | *Chamaesiphon minutus* |
| SBP00209 | American ginseng_1 | *Chania multitudinisentens* |
| SBP00209 | American ginseng_1 | *Chania multitudinisentens* |
| SBP00209 | American ginseng_1 | *Chelativorans* sp. BNC1 |
| SBP00209 | American ginseng_1 | *Chelativorans* sp. BNC1 |
| SBP00209 | American ginseng_1 | *Chelatococcus daeguensis* |
| SBP00209 | American ginseng_1 | *Chelatococcus daeguensis* |
| SBP00209 | American ginseng_1 | *Chelatococcus* sp. CO-6 |
| SBP00209 | American ginseng_1 | *Chelatococcus* sp. CO-6 |
| SBP00209 | American ginseng_1 | *Chitinophaga pinensis* |
| SBP00209 | American ginseng_1 | *Chitinophaga pinensis* |
| SBP00209 | American ginseng_1 | *Chitinophaga* sp. MD30 |
| SBP00209 | American ginseng_1 | *Chitinophaga* sp. MD30 |
| SBP00209 | American ginseng_1 | *Chlamydia abortus* |
| SBP00209 | American ginseng_1 | *Chlamydia abortus* |
| SBP00209 | American ginseng_1 | *Chlamydia psittaci* |
| SBP00209 | American ginseng_1 | *Chlamydia psittaci* |
| SBP00209 | American ginseng_1 | *Chloracidobacterium thermophilum* |
| SBP00209 | American ginseng_1 | *Chloracidobacterium thermophilum* |
| SBP00209 | American ginseng_1 | *Chlorobaculum limnaeum* |
| SBP00209 | American ginseng_1 | *Chlorobaculum limnaeum* |
| SBP00209 | American ginseng_1 | *Chlorobium limicola* |
| SBP00209 | American ginseng_1 | *Chlorobium limicola* |
| SBP00209 | American ginseng_1 | *Chondrocystis* sp. NIES-4102 |
| SBP00209 | American ginseng_1 | *Chondrocystis* sp. NIES-4102 |
| SBP00209 | American ginseng_1 | *Chondromyces crocatus* |
| SBP00209 | American ginseng_1 | *Chondromyces crocatus* |
| SBP00209 | American ginseng_1 | *Christensenella massiliensis* |
| SBP00209 | American ginseng_1 | *Christensenella massiliensis* |
| SBP00209 | American ginseng_1 | *Christensenella* sp. Marseille-P3954 |
| SBP00209 | American ginseng_1 | *Christensenella* sp. Marseille-P3954 |
| SBP00209 | American ginseng_1 | *Chromatiaceae bacterium* 2141T.STBD.0c.01a |
| SBP00209 | American ginseng_1 | *Chromatiaceae bacterium* 2141T.STBD.0c.01a |
| SBP00209 | American ginseng_1 | *Chromobacterium rhizoryzae* |
| SBP00209 | American ginseng_1 | *Chromobacterium rhizoryzae* |
| SBP00209 | American ginseng_1 | *Chromobacterium* sp. ATCC 53434 |
| SBP00209 | American ginseng_1 | *Chromobacterium* sp. ATCC 53434 |
| SBP00209 | American ginseng_1 | *Chromobacterium vaccinii* |
| SBP00209 | American ginseng_1 | *Chromobacterium vaccinii* |
| SBP00209 | American ginseng_1 | *Chromobacterium violaceum* |
| SBP00209 | American ginseng_1 | *Chromobacterium violaceum* |
| SBP00209 | American ginseng_1 | *Chromohalobacter salexigens* |
| SBP00209 | American ginseng_1 | *Chromohalobacter salexigens* |
| SBP00209 | American ginseng_1 | *Chroococcidiopsis thermalis* |
| SBP00209 | American ginseng_1 | *Chroococcidiopsis thermalis* |
| SBP00209 | American ginseng_1 | *Chryseobacterium antarcticum* |
| SBP00209 | American ginseng_1 | *Chryseobacterium antarcticum* |
| SBP00209 | American ginseng_1 | *Chryseobacterium arthrosphaerae* |
| SBP00209 | American ginseng_1 | *Chryseobacterium arthrosphaerae* |
| SBP00209 | American ginseng_1 | *Chryseobacterium balustinum* |
| SBP00209 | American ginseng_1 | *Chryseobacterium balustinum* |
| SBP00209 | American ginseng_1 | *Chryseobacterium carnipullorum* |
| SBP00209 | American ginseng_1 | *Chryseobacterium carnipullorum* |
| SBP00209 | American ginseng_1 | *Chryseobacterium glaciei* |
| SBP00209 | American ginseng_1 | *Chryseobacterium glaciei* |
| SBP00209 | American ginseng_1 | *Chryseobacterium gleum* |
| SBP00209 | American ginseng_1 | *Chryseobacterium gleum* |
| SBP00209 | American ginseng_1 | *Chryseobacterium haifense* |
| SBP00209 | American ginseng_1 | *Chryseobacterium haifense* |
| SBP00209 | American ginseng_1 | *Chryseobacterium indologenes* |
| SBP00209 | American ginseng_1 | *Chryseobacterium indologenes* |
| SBP00209 | American ginseng_1 | *Chryseobacterium indoltheticum* |
| SBP00209 | American ginseng_1 | *Chryseobacterium indoltheticum* |
| SBP00209 | American ginseng_1 | *Chryseobacterium jeonii* |
| SBP00209 | American ginseng_1 | *Chryseobacterium jeonii* |
| SBP00209 | American ginseng_1 | *Chryseobacterium joostei* |
| SBP00209 | American ginseng_1 | *Chryseobacterium joostei* |
| SBP00209 | American ginseng_1 | *Chryseobacterium lactis* |
| SBP00209 | American ginseng_1 | *Chryseobacterium lactis* |
| SBP00209 | American ginseng_1 | *Chryseobacterium nakagawai* |
| SBP00209 | American ginseng_1 | *Chryseobacterium nakagawai* |
| SBP00209 | American ginseng_1 | *Chryseobacterium piperi* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Chryseobacterium piperi* |
| SBP00209 | American ginseng_1 | *Chryseobacterium shandongense* |
| SBP00209 | American ginseng_1 | *Chryseobacterium shandongense* |
| SBP00209 | American ginseng_1 | *Chryseobacterium* sp. 17S1E7 |
| SBP00209 | American ginseng_1 | *Chryseobacterium* sp. 17S1E7 |
| SBP00209 | American ginseng_1 | *Chryseobacterium* sp. 3008163 |
| SBP00209 | American ginseng_1 | *Chryseobacterium* sp. 3008163 |
| SBP00209 | American ginseng_1 | *Chryseobacterium* sp. G0162 |
| SBP00209 | American ginseng_1 | *Chryseobacterium* sp. G0162 |
| SBP00209 | American ginseng_1 | *Chryseobacterium* sp. G0186 |
| SBP00209 | American ginseng_1 | *Chryseobacterium* sp. G0186 |
| SBP00209 | American ginseng_1 | *Chryseobacterium* sp. G0201 |
| SBP00209 | American ginseng_1 | *Chryseobacterium* sp. G0201 |
| SBP00209 | American ginseng_1 | *Chryseobacterium* sp. H3001 |
| SBP00209 | American ginseng_1 | *Chryseobacterium* sp. H3001 |
| SBP00209 | American ginseng_1 | *Chryseobacterium* sp. IHB B 17019 |
| SBP00209 | American ginseng_1 | *Chryseobacterium* sp. IHB B 17019 |
| SBP00209 | American ginseng_1 | *Chryseobacterium* sp. StRB126 |
| SBP00209 | American ginseng_1 | *Chryseobacterium* sp. StRB126 |
| SBP00209 | American ginseng_1 | *Chryseobacterium taklimakanense* |
| SBP00209 | American ginseng_1 | *Chryseobacterium taklimakanense* |
| SBP00209 | American ginseng_1 | *Chryseolinea* sp. KIS68-18 |
| SBP00209 | American ginseng_1 | *Chryseolinea* sp. KIS68-18 |
| SBP00209 | American ginseng_1 | *Chthonomonas calidirosea* |
| SBP00209 | American ginseng_1 | *Chthonomonas calidirosea* |
| SBP00209 | American ginseng_1 | *Citrobacter amalonaticus* |
| SBP00209 | American ginseng_1 | *Citrobacter amalonaticus* |
| SBP00209 | American ginseng_1 | *Citrobacter braakii* |
| SBP00209 | American ginseng_1 | *Citrobacter braakii* |
| SBP00209 | American ginseng_1 | *Citrobacter farmeri* |
| SBP00209 | American ginseng_1 | *Citrobacter farmeri* |
| SBP00209 | American ginseng_1 | *Citrobacter freundii* |
| SBP00209 | American ginseng_1 | *Citrobacter freundii* |
| SBP00209 | American ginseng_1 | *Citrobacter freundii* complex sp. CFNIH2 |
| SBP00209 | American ginseng_1 | *Citrobacter freundii* complex sp. CFNIH2 |
| SBP00209 | American ginseng_1 | *Citrobacter freundii* complex sp. CFNIH3 |
| SBP00209 | American ginseng_1 | *Citrobacter freundii* complex sp. CFNIH3 |
| SBP00209 | American ginseng_1 | *Citrobacter koseri* |
| SBP00209 | American ginseng_1 | *Citrobacter koseri* |
| SBP00209 | American ginseng_1 | *Citrobacter rodentium* |
| SBP00209 | American ginseng_1 | *Citrobacter rodentium* |
| SBP00209 | American ginseng_1 | *Citrobacter werkmanii* |
| SBP00209 | American ginseng_1 | *Citrobacter werkmanii* |
| SBP00209 | American ginseng_1 | *Citromicrobium* sp. JL477 |
| SBP00209 | American ginseng_1 | *Citromicrobium* sp. JL477 |
| SBP00209 | American ginseng_1 | *Clavibacter michiganensis* |
| SBP00209 | American ginseng_1 | *Clavibacter michiganensis* |
| SBP00209 | American ginseng_1 | *Cloacibacterium normanense* |
| SBP00209 | American ginseng_1 | *Cloacibacterium normanense* |
| SBP00209 | American ginseng_1 | *Clostridiaceae bacterium* 1450207 |
| SBP00209 | American ginseng_1 | *Clostridiaceae bacterium* 1450207 |
| SBP00209 | American ginseng_1 | *Clostridiales bacterium* 70B-A |
| SBP00209 | American ginseng_1 | *Clostridiales bacterium* 708-A |
| SBP00209 | American ginseng_1 | *Clostridioides difficile* |
| SBP00209 | American ginseng_1 | *Clostridioides difficile* |
| SBP00209 | American ginseng_1 | *Clostridium acetobutylicum* |
| SBP00209 | American ginseng_1 | *Clostridium acetobutylicum* |
| SBP00209 | American ginseng_1 | *Clostridium argentinense* |
| SBP00209 | American ginseng_1 | *Clostridium argentinense* |
| SBP00209 | American ginseng_1 | *Clostridium autoethanogenum* |
| SBP00209 | American ginseng_1 | *Clostridium autoethanogenum* |
| SBP00209 | American ginseng_1 | *Clostridium baratii* |
| SBP00209 | American ginseng_1 | *Clostridium baratii* |
| SBP00209 | American ginseng_1 | *Clostridium beijerinckii* |
| SBP00209 | American ginseng_1 | *Clostridium beijerinckii* |
| SBP00209 | American ginseng_1 | *Clostridium botulinum* |
| SBP00209 | American ginseng_1 | *Clostridium botulinum* |
| SBP00209 | American ginseng_1 | *Clostridium butyricum* |
| SBP00209 | American ginseng_1 | *Clostridium butyricum* |
| SBP00209 | American ginseng_1 | *Clostridium carboxidivorans* |
| SBP00209 | American ginseng_1 | *Clostridium carboxidivorans* |
| SBP00209 | American ginseng_1 | *Clostridium cellulovorans* |
| SBP00209 | American ginseng_1 | *Clostridium cellulovorans* |
| SBP00209 | American ginseng_1 | *Clostridium chauvoei* |
| SBP00209 | American ginseng_1 | *Clostridium chauvoei* |
| SBP00209 | American ginseng_1 | *Clostridium drakei* |

TABLE 3-continued

List of species identified in each metagenomic sample of each SBP Sample

| SBP ID | SBP Host Common Name | Genus sp. |
|---|---|---|
| SBP00209 | American ginseng_1 | *Clostridium drakei* |
| SBP00209 | American ginseng_1 | *Clostridium estertheticum* |
| SBP00209 | American ginseng_1 | *Clostridium estertheticum* |
| SBP00209 | American ginseng_1 | *Clostridium formicaceticum* |
| SBP00209 | American ginseng_1 | *Clostridium formicaceticum* |
| SBP00209 | American ginseng_1 | *Clostridium isatidis* |
| SBP00209 | American ginseng_1 | *Clostridium isatidis* |
| SBP00209 | American ginseng_1 | *Clostridium kluyveri* |
| SBP00209 | American ginseng_1 | *Clostridium kluyveri* |
| SBP00209 | American ginseng_1 | *Clostridium novyi* |
| SBP00209 | American ginseng_1 | *Clostridium novyi* |
| SBP00209 | American ginseng_1 | *Clostridium pasteurianum* |
| SBP00209 | American ginseng_1 | *Clostridium pasteurianum* |
| SBP00209 | American ginseng_1 | *Clostridium perfringens* |
| SBP00209 | American ginseng_1 | *Clostridium perfringens* |
| SBP00209 | American ginseng_1 | *Clostridium saccharobutylicum* |
| SBP00209 | American ginseng_1 | *Clostridium saccharobutylicum* |
| SBP00209 | American ginseng_1 | *Clostridium saccharoperbutylacetonicum* |
| SBP00209 | American ginseng_1 | *Clostridium saccharoperbutylacetonicum* |
| SBP00209 | American ginseng_1 | *Clostridium scatologenes* |
| SBP00209 | American ginseng_1 | *Clostridium scatologenes* |
| SBP00209 | American ginseng_1 | *Clostridium septicum* |
| SBP00209 | American ginseng_1 | *Clostridium septicum* |
| SBP00209 | American ginseng_1 | *Clostridium* sp. AWRP |
| SBP00209 | American ginseng_1 | *Clostridium* sp. AWRP |
| SBP00209 | American ginseng_1 | *Clostridium* sp. CT4 |
| SBP00209 | American ginseng_1 | *Clostridium* sp. CT4 |
| SBP00209 | American ginseng_1 | *Clostridium* sp. DL-VIII |
| SBP00209 | American ginseng_1 | *Clostridium* sp. DL-VIII |
| SBP00209 | American ginseng_1 | *Clostridium* sp. JN-1 |
| SBP00209 | American ginseng_1 | *Clostridium* sp. JN-1 |
| SBP00209 | American ginseng_1 | *Clostridium* sp. JN500901 |
| SBP00209 | American ginseng_1 | *Clostridium* sp. JN500901 |
| SBP00209 | American ginseng_1 | *Clostridium sporogenes* |
| SBP00209 | American ginseng_1 | *Clostridium sporogenes* |
| SBP00209 | American ginseng_1 | *Clostridium taeniosporum* |
| SBP00209 | American ginseng_1 | *Clostridium taeniosporum* |
| SBP00209 | American ginseng_1 | *Clostridium tetani* |
| SBP00209 | American ginseng_1 | *Clostridium tetani* |
| SBP00209 | American ginseng_1 | *Clostridium tyrobutyricum* |
| SBP00209 | American ginseng_1 | *Clostridium tyrobutyricum* |
| SBP00209 | American ginseng_1 | *Cnuibacter physcomitrellae* |
| SBP00209 | American ginseng_1 | *Cnuibacter physcomitrellae* |
| SBP00209 | American ginseng_1 | *Cohaesibacter* sp. ES.047 |
| SBP00209 | American ginseng_1 | *Cohaesibacter* sp. ES.047 |
| SBP00209 | American ginseng_1 | *Cohnella* sp. 18JY8-7 |
| SBP00209 | American ginseng_1 | *Cohnella* sp. 18JY8-7 |
| SBP00209 | American ginseng_1 | *Collimonas arenae* |
| SBP00209 | American ginseng_1 | *Collimonas arenae* |
| SBP00209 | American ginseng_1 | *Collimonas fungivorans* |
| SBP00209 | American ginseng_1 | *Collimonas fungivorans* |
| SBP00209 | American ginseng_1 | *Collimonas pratensis* |
| SBP00209 | American ginseng_1 | *Collimonas pratensis* |
| SBP00209 | American ginseng_1 | *Collinsella aerofaciens* |
| SBP00209 | American ginseng_1 | *Collinsella aerofaciens* |
| SBP00209 | American ginseng_1 | *Colwellia beringensis* |
| SBP00209 | American ginseng_1 | *Colwellia beringensis* |
| SBP00209 | American ginseng_1 | *Colwellia psychrerythraea* |
| SBP00209 | American ginseng_1 | *Colwellia psychrerythraea* |
| SBP00209 | American ginseng_1 | *Colwellia* sp. Arc7-D |
| SBP00209 | American ginseng_1 | *Colwellia* sp. Arc7-D |
| SBP00209 | American ginseng_1 | *Colwellia* sp. MT41 |
| SBP00209 | American ginseng_1 | *Colwellia* sp. MT41 |
| SBP00209 | American ginseng_1 | *Colwellia* sp. PAMC 20917 |
| SBP00209 | American ginseng_1 | *Colwellia* sp. PAMC 20917 |
| SBP00209 | American ginseng_1 | *Colwellia* sp. PAMC 21821 |
| SBP00209 | American ginseng_1 | *Colwellia* sp. PAMC 21821 |
| SBP00209 | American ginseng_1 | *Comamonas aquatica* |
| SBP00209 | American ginseng_1 | *Comamonas aquatica* |
| SBP00209 | American ginseng_1 | *Comamonas kerstersii* |
| SBP00209 | American ginseng_1 | *Comamonas kerstersii* |
| SBP00209 | American ginseng_1 | *Comamonas serinivorans* |
| SBP00209 | American ginseng_1 | *Comamonas serinivorans* |
| SBP00209 | American ginseng_1 | *Comamonas terrigena* |
| SBP00209 | American ginseng_1 | *Comamonas terrigena* |
| SBP00209 | American ginseng_1 | *Comamonas testosteroni* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Comamonas testosteroni* |
| SBP00209 | American ginseng_1 | *Comamonas thiooxydans* |
| SBP00209 | American ginseng_1 | *Comamonas thiooxydans* |
| SBP00209 | American ginseng_1 | *Commensalibacter* sp. AMU001 |
| SBP00209 | American ginseng_1 | *Commensalibacter* sp. AMU001 |
| SBP00209 | American ginseng_1 | *Conexibacter woesei* |
| SBP00209 | American ginseng_1 | *Conexibacter woesei* |
| SBP00209 | American ginseng_1 | *Confluentimicrobium* sp. EMB200-NS6 |
| SBP00209 | American ginseng_1 | *Confluentimicrobium* sp. EMB200-NS6 |
| SBP00209 | American ginseng_1 | *Congregibacter litoralis* |
| SBP00209 | American ginseng_1 | *Congregibacter litoralis* |
| SBP00209 | American ginseng_1 | *Corallococcus coralloides* |
| SBP00209 | American ginseng_1 | *Corallococcus coralloides* |
| SBP00209 | American ginseng_1 | *Corynebacterium atypicum* |
| SBP00209 | American ginseng_1 | *Corynebacterium atypicum* |
| SBP00209 | American ginseng_1 | *Corynebacterium aurimucosum* |
| SBP00209 | American ginseng_1 | *Corynebacterium aurimucosum* |
| SBP00209 | American ginseng_1 | *Corynebacterium camporealensis* |
| SBP00209 | American ginseng_1 | *Corynebacterium camporealensis* |
| SBP00209 | American ginseng_1 | *Corynebacterium casei* |
| SBP00209 | American ginseng_1 | *Corynebacterium casei* |
| SBP00209 | American ginseng_1 | *Corynebacterium choanis* |
| SBP00209 | American ginseng_1 | *Corynebacterium choanis* |
| SBP00209 | American ginseng_1 | *Corynebacterium cystitidis* |
| SBP00209 | American ginseng_1 | *Corynebacterium cystitidis* |
| SBP00209 | American ginseng_1 | *Corynebacterium efficiens* |
| SBP00209 | American ginseng_1 | *Corynebacterium efficiens* |
| SBP00209 | American ginseng_1 | *Corynebacterium falsenii* |
| SBP00209 | American ginseng_1 | *Corynebacterium falsenii* |
| SBP00209 | American ginseng_1 | *Corynebacterium frankenforstense* |
| SBP00209 | American ginseng_1 | *Corynebacterium frankenforstense* |
| SBP00209 | American ginseng_1 | *Corynebacterium genitalium* |
| SBP00209 | American ginseng_1 | *Corynebacterium genitalium* |
| SBP00209 | American ginseng_1 | *Corynebacterium maris* |
| SBP00209 | American ginseng_1 | *Corynebacterium maris* |
| SBP00209 | American ginseng_1 | *Corynebacterium matruchotii* |
| SBP00209 | American ginseng_1 | *Corynebacterium matruchotii* |
| SBP00209 | American ginseng_1 | *Corynebacterium pseudotuberculosis* |
| SBP00209 | American ginseng_1 | *Corynebacterium pseudotuberculosis* |
| SBP00209 | American ginseng_1 | *Corynebacterium* sp. 2183 |
| SBP00209 | American ginseng_1 | *Corynebacterium* sp. 2183 |
| SBP00209 | American ginseng_1 | *Corynebacterium* sp. 2184 |
| SBP00209 | American ginseng_1 | *Corynebacterium* sp. 2184 |
| SBP00209 | American ginseng_1 | *Corynebacterium* sp. NML98-0116 |
| SBP00209 | American ginseng_1 | *Corynebacterium* sp. NML98-0116 |
| SBP00209 | American ginseng_1 | *Corynebacterium sphenisci* |
| SBP00209 | American ginseng_1 | *Corynebacterium sphenisci* |
| SBP00209 | American ginseng_1 | *Corynebacterium stationis* |
| SBP00209 | American ginseng_1 | *Corynebacterium stationis* |
| SBP00209 | American ginseng_1 | *Corynebacterium striatum* |
| SBP00209 | American ginseng_1 | *Corynebacterium striatum* |
| SBP00209 | American ginseng_1 | *Corynebacterium ulcerans* |
| SBP00209 | American ginseng_1 | *Corynebacterium ulcerans* |
| SBP00209 | American ginseng_1 | *Corynebacterium urealyticum* |
| SBP00209 | American ginseng_1 | *Corynebacterium urealyticum* |
| SBP00209 | American ginseng_1 | *Corynebacterium ureicelerivorans* |
| SBP00209 | American ginseng_1 | *Corynebacterium ureicelerivorans* |
| SBP00209 | American ginseng_1 | *Corynebacterium uterequi* |
| SBP00209 | American ginseng_1 | *Corynebacterium uterequi* |
| SBP00209 | American ginseng_1 | *Corynebacterium variabile* |
| SBP00209 | American ginseng_1 | *Corynebacterium variabile* |
| SBP00209 | American ginseng_1 | *Corynebacterium vitaeruminis* |
| SBP00209 | American ginseng_1 | *Corynebacterium vitaeruminis* |
| SBP00209 | American ginseng_1 | *Corynebacterium xerosis* |
| SBP00209 | American ginseng_1 | *Corynebacterium xerosis* |
| SBP00209 | American ginseng_1 | *Coxiella burnetii* |
| SBP00209 | American ginseng_1 | *Coxiella burnetii* |
| SBP00209 | American ginseng_1 | *Crenobacter* sp. K1W11S-77 |
| SBP00209 | American ginseng_1 | *Crenobacter* sp. K1W11S-77 |
| SBP00209 | American ginseng_1 | *Crinalium epipsammum* |
| SBP00209 | American ginseng_1 | *Crinalium epipsammum* |
| SBP00209 | American ginseng_1 | *Croceibacter atlanticus* |
| SBP00209 | American ginseng_1 | *Croceibacter atlanticus* |
| SBP00209 | American ginseng_1 | *Croceicoccus marinus* |
| SBP00209 | American ginseng_1 | *Croceicoccus marinus* |
| SBP00209 | American ginseng_1 | *Croceicoccus naphthovorans* |

TABLE 3-continued

List of species identified in each metagenomic sample of each SBP Sample

| SBP ID | SBP Host Common Name | Genus sp. |
|---|---|---|
| SBP00209 | American ginseng_1 | *Croceicoccus naphthovorans* |
| SBP00209 | American ginseng_1 | *Cronobacter condimenti* |
| SBP00209 | American ginseng_1 | *Cronobacter condimenti* |
| SBP00209 | American ginseng_1 | *Cronobacter dublinensis* |
| SBP00209 | American ginseng_1 | *Cronobacter dublinensis* |
| SBP00209 | American ginseng_1 | *Cronobacter malonaticus* |
| SBP00209 | American ginseng_1 | *Cronobacter malonaticus* |
| SBP00209 | American ginseng_1 | *Cronobacter muytjensii* |
| SBP00209 | American ginseng_1 | *Cronobacter muytjensii* |
| SBP00209 | American ginseng_1 | *Cronobacter sakazakii* |
| SBP00209 | American ginseng_1 | *Cronabacter sakazakii* |
| SBP00209 | American ginseng_1 | *Cronobacter turicensis* |
| SBP00209 | American ginseng_1 | *Cronobacter turicensis* |
| SBP00209 | American ginseng_1 | *Cronobacter universalis* |
| SBP00209 | American ginseng_1 | *Cronobacter universalis* |
| SBP00209 | American ginseng_1 | *Cryobacterium arcticum* |
| SBP00209 | American ginseng_1 | *Cryobacterium arcticum* |
| SBP00209 | American ginseng_1 | *Cryobacterium* sp. GCJ02 |
| SBP00209 | American ginseng_1 | *Cryobacterium* sp. GCJ02 |
| SBP00209 | American ginseng_1 | *Cryobacterium* sp. LW097 |
| SBP00209 | American ginseng_1 | *Cryobacterium* sp. LW097 |
| SBP00209 | American ginseng_1 | *Cryptobacterium curtum* |
| SBP00209 | American ginseng_1 | *Cryptobacterium curtum* |
| SBP00209 | American ginseng_1 | *Cuniculiplasma divulgatum* |
| SBP00209 | American ginseng_1 | *Cuniculiplasma divulgatum* |
| SBP00209 | American ginseng_1 | *Cupriavidus basilensis* |
| SBP00209 | American ginseng_1 | *Cupriavidus basilensis* |
| SBP00209 | American ginseng_1 | *Cupriavidus gilardii* |
| SBP00209 | American ginseng_1 | *Cupriavidus gilardii* |
| SBP00209 | American ginseng_1 | *Cupriavidus metallidurans* |
| SBP00209 | American ginseng_1 | *Cupriavidus metallidurans* |
| SBP00209 | American ginseng_1 | *Cupriavidus nantongensis* |
| SBP00209 | American ginseng_1 | *Cupriavidus nantongensis* |
| SBP00209 | American ginseng_1 | *Cupriavidus necator* |
| SBP00209 | American ginseng_1 | *Cupriavidus necator* |
| SBP00209 | American ginseng_1 | *Cupriavidus oxalaticus* |
| SBP00209 | American ginseng_1 | *Cupriavidus oxalaticus* |
| SBP00209 | American ginseng_1 | *Cupriavidus pauculus* |
| SBP00209 | American ginseng_1 | *Cupriavidus pauculus* |
| SBP00209 | American ginseng_1 | *Cupriavidus pinatubonensis* |
| SBP00209 | American ginseng_1 | *Cupriavidus pinatubonensis* |
| SBP00209 | American ginseng_1 | *Cupriavidus* sp. USMAHM13 |
| SBP00209 | American ginseng_1 | *Cupriavidus* sp. USMAHM13 |
| SBP00209 | American ginseng_1 | *Cupriavidus taiwanensis* |
| SBP00209 | American ginseng_1 | *Cupriavidus taiwanensis* |
| SBP00209 | American ginseng_1 | *Curtobacterium pusiltum* |
| SBP00209 | American ginseng_1 | *Curtobacterium pusillum* |
| SBP00209 | American ginseng_1 | *Curtobacterium* sp. BH-2-1-1 |
| SBP00209 | American ginseng_1 | *Curtobacterium* sp. BH-2-1-1 |
| SBP00209 | American ginseng_1 | *Curtobacterium* sp. MR_MD2014 |
| SBP00209 | American ginseng_1 | *Curtobacterium* sp. MR_MD2014 |
| SBP00209 | American ginseng_1 | *Curtobacterium* sp. SGAir0471 |
| SBP00209 | American ginseng_1 | *Curtobacterium* sp. SGAir0471 |
| SBP00209 | American ginseng_1 | *Curvibacter* sp. AEP1-3 |
| SBP00209 | American ginseng_1 | *Curvibacter* sp. AEP1-3 |
| SBP00209 | American ginseng_1 | *Cutibacterium acnes* |
| SBP00209 | American ginseng_1 | *Cutibacterium acnes* |
| SBP00209 | American ginseng_1 | *Cutibacterium avidum* |
| SBP00209 | American ginseng_1 | *Cutibacterium avidum* |
| SBP00209 | American ginseng_1 | *Cutibacterium granulosum* |
| SBP00209 | American ginseng_1 | *Cutibacterium granulosum* |
| SBP00209 | American ginseng_1 | *Cyanobacterium aponinum* |
| SBP00209 | American ginseng_1 | *Cyanobacterium aponinum* |
| SBP00209 | American ginseng_1 | cyanobacterium endosymbiont of *Epithemia turgida* |
| SBP00209 | American ginseng_1 | cyanobacterium endosymbiont of *Epithemia turgida* |
| SBP00209 | American ginseng_1 | *Cyanobium gracile* |
| SBP00209 | American ginseng_1 | *Cyanobium gracile* |
| SBP00209 | American ginseng_1 | *Cyanobium* sp. NIES-981 |
| SBP00209 | American ginseng_1 | *Cyanobium* sp. NIES-981 |
| SBP00209 | American ginseng_1 | *Cyanothece* sp. ATCC 51142 |
| SBP00209 | American ginseng_1 | *Cyanothece* sp. ATCC 51142 |
| SBP00209 | American ginseng_1 | *Cyanothece* sp. PCC 7424 |
| SBP00209 | American ginseng_1 | *Cyanothece* sp. PCC 7424 |
| SBP00209 | American ginseng_1 | *Cyclobacterium marinum* |
| SBP00209 | American ginseng_1 | *Cyclobacterium marinum* |
| SBP00209 | American ginseng_1 | *Cylindrospermum stagnale* |

TABLE 3-continued

List of species identified in each metagenomic sample of each SBP Sample

| SBP ID | SBP Host Common Name | Genus sp. |
|---|---|---|
| SBP00209 | American ginseng_1 | *Cylindrospermum stagnale* |
| SBP00209 | American ginseng_1 | *Cystobacter fuscus* |
| SBP00209 | American ginseng_1 | *Cystobacter fuscus* |
| SBP00209 | American ginseng_1 | *Cytophagales bacterium* TFI 002 |
| SBP00209 | American ginseng_1 | *Cytophagales bacterium* TFI 002 |
| SBP00209 | American ginseng_1 | *Dechloromonas aromatica* |
| SBP00209 | American ginseng_1 | *Dechloromonas aromatica* |
| SBP00209 | American ginseng_1 | *Dechloromonas* sp. HYN0024 |
| SBP00209 | American ginseng_1 | *Dechloromonas* sp. HYN0024 |
| SBP00209 | American ginseng_1 | *Deferribacter desulfuricans* |
| SBP00209 | American ginseng_1 | *Deferribacter desulfuricans* |
| SBP00209 | American ginseng_1 | *Defluviimonas alba* |
| SBP00209 | American ginseng_1 | *Defluviimonas alba* |
| SBP00209 | American ginseng_1 | *Defluviitoga tunisiensis* |
| SBP00209 | American ginseng_1 | *Defluviitoga tunisiensis* |
| SBP00209 | American ginseng_1 | *Dehalococcoides mccartyi* |
| SBP00209 | American ginseng_1 | *Dehalococcoides mccartyi* |
| SBP00209 | American ginseng_1 | *Deinococcus actinosclerus* |
| SBP00209 | American ginseng_1 | *Deinococcus actinosclerus* |
| SBP00209 | American ginseng_1 | *Deinococcus deserti* |
| SBP00209 | American ginseng_1 | *Deinococcus deserti* |
| SBP00209 | American ginseng_1 | *Deinococcus ficus* |
| SBP00209 | American ginseng_1 | *Deinococcus ficus* |
| SBP00209 | American ginseng_1 | *Deinococcus gobiensis* |
| SBP00209 | American ginseng_1 | *Deinococcus gobiensis* |
| SBP00209 | American ginseng_1 | *Deinococcus irradiatisoli* |
| SBP00209 | American ginseng_1 | *Deinococcus irradiatisoli* |
| SBP00209 | American ginseng_1 | *Deinococcus maricopensis* |
| SBP00209 | American ginseng_1 | *Deinococcus maricopensis* |
| SBP00209 | American ginseng_1 | *Deinococcus peraridilitoris* |
| SBP00209 | American ginseng_1 | *Deinococcus peraridilitoris* |
| SBP00209 | American ginseng_1 | *Deinococcus puniceus* |
| SBP00209 | American ginseng_1 | *Deinococcus puniceus* |
| SBP00209 | American ginseng_1 | *Deinococcus radiodurans* |
| SBP00209 | American ginseng_1 | *Deinococcus radiodurans* |
| SBP00209 | American ginseng_1 | *Deinococcus soli* Cha et al. 2016 |
| SBP00209 | American ginseng_1 | *Deinococcus soli* Cha et al. 2016 |
| SBP00209 | American ginseng_1 | *Deinococcus* sp. NW-56 |
| SBP00209 | American ginseng_1 | *Deinococcus* sp. NW-56 |
| SBP00209 | American ginseng_1 | *Deinococcus* sp. S14-83 |
| SBP00209 | American ginseng_1 | *Deinococcus* sp. S14-83 |
| SBP00209 | American ginseng_1 | *Deinococcus swuensis* |
| SBP00209 | American ginseng_1 | *Deinococcus swuensis* |
| SBP00209 | American ginseng_1 | *Deinococcus wulumuqiensis* |
| SBP00209 | American ginseng_1 | *Deinococcus wulumuqiensis* |
| SBP00209 | American ginseng_1 | *Delftia acidovorans* |
| SBP00209 | American ginseng_1 | *Delftia acidovorans* |
| SBP00209 | American ginseng_1 | *Delftia* sp. |
| SBP00209 | American ginseng_1 | *Delftia* sp. |
| SBP00209 | American ginseng_1 | *Delftia* sp. Cs1-4 |
| SBP00209 | American ginseng_1 | *Delftia* sp. Cs1-4 |
| SBP00209 | American ginseng_1 | *Delftia tsuruhatensis* |
| SBP00209 | American ginseng_1 | *Delftia tsuruhatensis* |
| SBP00209 | American ginseng_1 | *Denitrobacterium detoxificans* |
| SBP00209 | American ginseng_1 | *Denitrobacterium detoxificans* |
| SBP00209 | American ginseng_1 | *Dermabacter vaginalis* |
| SBP00209 | American ginseng_1 | *Dermabacter vaginalis* |
| SBP00209 | American ginseng_1 | *Dermacoccus nishinomiyaensis* |
| SBP00209 | American ginseng_1 | *Dermacoccus nishinomiyaensis* |
| SBP00209 | American ginseng_1 | *Desulfarculus baarsii* |
| SBP00209 | American ginseng_1 | *Desulfarculus baarsii* |
| SBP00209 | American ginseng_1 | *Desulfitobacterium hafniense* |
| SBP00209 | American ginseng_1 | *Desulfitobacterium hafniense* |
| SBP00209 | American ginseng_1 | *Desulfitobacterium metallireducens* |
| SBP00209 | American ginseng_1 | *Desulfitobacterium metallireducens* |
| SBP00209 | American ginseng_1 | *Desulfococcus multivorans* |
| SBP00209 | American ginseng_1 | *Desulfococcus multivorans* |
| SBP00209 | American ginseng_1 | *Desulfococcus oleovorans* |
| SBP00209 | American ginseng_1 | *Desulfococcus oleovorans* |
| SBP00209 | American ginseng_1 | *Desulfomicrobium orale* |
| SBP00209 | American ginseng_1 | *Desulfomicrobium orale* |
| SBP00209 | American ginseng_1 | *Desulfomonile tiedjei* |
| SBP00209 | American ginseng_1 | *Desulfomonile tiedjei* |
| SBP00209 | American ginseng_1 | *Desulfosporosinus youngiae* |
| SBP00209 | American ginseng_1 | *Desulfosporosinus youngiae* |
| SBP00209 | American ginseng_1 | *Desulfotalea psychrophila* |

TABLE 3-continued

List of species identified in each metagenomic sample of each SBP Sample

| SBP ID | SBP Host Common Name | Genus sp. |
|---|---|---|
| SBP00209 | American ginseng_1 | *Desulfotalea psychrophila* |
| SBP00209 | American ginseng_1 | *Desulfovibrio africanus* |
| SBP00209 | American ginseng_1 | *Desulfovibrio africanus* |
| SBP00209 | American ginseng_1 | *Desulfovibrio carbinolicus* |
| SBP00209 | American ginseng_1 | *Desulfovibrio carbinolicus* |
| SBP00209 | American ginseng_1 | *Desulfovibrio desulfuricans* |
| SBP00209 | American ginseng_1 | Desulfovibrio desulfuricans |
| SBP00209 | American ginseng_1 | *Desulfovibrio fairfieldensis* |
| SBP00209 | American ginseng_1 | *Desulfovibrio fairfieldensis* |
| SBP00209 | American ginseng_1 | *Desulfovibrio gigas* |
| SBP00209 | American ginseng_1 | *Desulfovibrio gigas* |
| SBP00209 | American ginseng_1 | *Desulfovibrio magneticus* |
| SBP00209 | American ginseng_1 | *Desulfovibrio magneticus* |
| SBP00209 | American ginseng_1 | *Desulfovibrio piger* |
| SBP00209 | American ginseng_1 | *Desulfovibrio piger* |
| SBP00209 | American ginseng_1 | *Desulfovibrio* sp. FW1012B |
| SBP00209 | American ginseng_1 | *Desulfovibrio* sp. FW1012B |
| SBP00209 | American ginseng_1 | *Desulfovibrio vulgaris* |
| SBP00209 | American ginseng_1 | *Desulfovibrio vulgaris* |
| SBP00209 | American ginseng_1 | *Desulfurella acetivorans* |
| SBP00209 | American ginseng_1 | *Desulfurella acetivorans* |
| SBP00209 | American ginseng_1 | *Desulfurispirillum indicum* |
| SBP00209 | American ginseng_1 | *Desulfurispirillum indicum* |
| SBP00209 | American ginseng_1 | *Desulfuromonas soudanensis* |
| SBP00209 | American ginseng_1 | *Desulfuromonas soudanensis* |
| SBP00209 | American ginseng_1 | *Desulfuromonas* sp. DDH964 |
| SBP00209 | American ginseng_1 | *Desulfuromonas* sp. DDH964 |
| SBP00209 | American ginseng_1 | *Devosia* sp. 1566 |
| SBP00209 | American ginseng_1 | *Devosia* sp. 1566 |
| SBP00209 | American ginseng_1 | *Devosia* sp. A16 |
| SBP00209 | American ginseng_1 | *Devosia* sp. A16 |
| SBP00209 | American ginseng_1 | *Devosia* sp. H5989 |
| SBP00209 | American ginseng_1 | *Devosia* sp. H5989 |
| SBP00209 | American ginseng_1 | *Devosia* sp. I507 |
| SBP00209 | American ginseng_1 | *Devosia* sp. I507 |
| SBP00209 | American ginseng_1 | *Dialister pneumosintes* |
| SBP00209 | American ginseng_1 | *Dialister pneumosintes* |
| SBP00209 | American ginseng_1 | *Dickeya chrysanthemi* |
| SBP00209 | American ginseng_1 | *Dickeya chrysanthemi* |
| SBP00209 | American ginseng_1 | *Dickeya dianthicola* |
| SBP00209 | American ginseng_1 | *Dickeya dianthicola* |
| SBP00209 | American ginseng_1 | *Dickeya paradisiaca* |
| SBP00209 | American ginseng_1 | *Dickeya paradisiaca* |
| SBP00209 | American ginseng_1 | *Dickeya* sp. NCPPB 569 |
| SBP00209 | American ginseng_1 | *Dickeya* sp. NCPPB 569 |
| SBP00209 | American ginseng_1 | *Dickeya zeae* |
| SBP00209 | American ginseng_1 | *Dickeya zeae* |
| SBP00209 | American ginseng_1 | *Dietzia lutea* |
| SBP00209 | American ginseng_1 | *Dietzia lutea* |
| SBP00209 | American ginseng_1 | *Dietzia psychralcaliphila* |
| SBP00209 | American ginseng_1 | *Dietzia psychralcaliphila* |
| SBP00209 | American ginseng_1 | *Dietzia* sp. JS16-p6b |
| SBP00209 | American ginseng_1 | *Dietzia* sp. JS16-p6b |
| SBP00209 | American ginseng_1 | *Dietzia* sp. oral taxon 368 |
| SBP00209 | American ginseng_1 | *Dietzia* sp. oral taxon 368 |
| SBP00209 | American ginseng_1 | *Dietzia timorensis* |
| SBP00209 | American ginseng_1 | *Dietzia timorensis* |
| SBP00209 | American ginseng_1 | *Dinoroseobacter shibae* |
| SBP00209 | American ginseng_1 | *Dinoroseobacter shibae* |
| SBP00209 | American ginseng_1 | *Diolcogaster facetosa* bracovirus |
| SBP00209 | American ginseng_1 | *Diolcogaster facetosa* bracovirus |
| SBP00209 | American ginseng_1 | *Dioscorea bacilliform* RT virus 1 |
| SBP00209 | American ginseng_1 | *Dioscorea bacilliform* RT virus 1 |
| SBP00209 | American ginseng_1 | *Diptera* sp. BOLD: AAB3286 |
| SBP00209 | American ginseng_1 | *Diptera* sp. BOLD: AA83286 |
| SBP00209 | American ginseng_1 | *Dokdonella koreensis* |
| SBP00209 | American ginseng_1 | *Dokdonella koreensis* |
| SBP00209 | American ginseng_1 | *Dokdonia donghaensis* |
| SBP00209 | American ginseng_1 | *Dokdonia donghaensis* |
| SBP00209 | American ginseng_1 | *Dolichospermum compactum* |
| SBP00209 | American ginseng_1 | *Dolichospermum compactum* |
| SBP00209 | American ginseng_1 | *Dyadobacter fermentans* |
| SBP00209 | American ginseng_1 | *Dyadobacter fermentans* |
| SBP00209 | American ginseng_1 | *Dyella japonica* |
| SBP00209 | American ginseng_1 | *Dyella japonica* |
| SBP00209 | American ginseng_1 | *Dyella* sp. M7H15-1 |

TABLE 3-continued

List of species identified in each metagenomic sample of each SBP Sample

| SBP ID | SBP Host Common Name | Genus sp. |
|---|---|---|
| SBP00209 | American ginseng_1 | *Dyella* sp. M7H15-1 |
| SBP00209 | American ginseng_1 | *Dyella thiooxydans* |
| SBP00209 | American ginseng_1 | *Dyella thiooxydans* |
| SBP00209 | American ginseng_1 | *Echinicola rosea* |
| SBP00209 | American ginseng_1 | *Echinicola rosea* |
| SBP00209 | American ginseng_1 | *Echinicola vietnamensis* |
| SBP00209 | American ginseng_1 | *Echinicola vietnamensis* |
| SBP00209 | American ginseng_1 | *Edwardsiella hoshinae* |
| SBP00209 | American ginseng_1 | *Edwardsiella hoshinae* |
| SBP00209 | American ginseng_1 | *Edwardsiella ictaluri* |
| SBP00209 | American ginseng_1 | *Edwardsiella ictaluri* |
| SBP00209 | American ginseng_1 | *Edwardsiella piscicida* |
| SBP00209 | American ginseng_1 | *Edwardsiella piscicida* |
| SBP00209 | American ginseng_1 | *Edwardsiella tarda* |
| SBP00209 | American ginseng_1 | *Edwardsiella tarda* |
| SBP00209 | American ginseng_1 | *Eggerthella lenta* |
| SBP00209 | American ginseng_1 | *Eggerthella lenta* |
| SBP00209 | American ginseng_1 | *Eggerthella* sp. YY7918 |
| SBP00209 | American ginseng_1 | *Eggerthella* sp. YY7918 |
| SBP00209 | American ginseng_1 | *Egibacter rhizosphaerae* |
| SBP00209 | American ginseng_1 | *Egibacter rhizosphaerae* |
| SBP00209 | American ginseng_1 | *Egicoccus halophilus* |
| SBP00209 | American ginseng_1 | *Egicoccus halophilus* |
| SBP00209 | American ginseng_1 | *Ehrlichia canis* |
| SBP00209 | American ginseng_1 | *Ehrlichia canis* |
| SBP00209 | American ginseng_1 | *Eikenella corrodens* |
| SBP00209 | American ginseng_1 | *Eikenella corrodens* |
| SBP00209 | American ginseng_1 | *Elizabethkingia anophelis* |
| SBP00209 | American ginseng_1 | *Elizabethkingia anophelis* |
| SBP00209 | American ginseng_1 | *Elizabethkingia bruuniana* |
| SBP00209 | American ginseng_1 | *Elizabethkingia bruuniana* |
| SBP00209 | American ginseng_1 | *Elizabethkingia meningoseptica* |
| SBP00209 | American ginseng_1 | *Elizabethkingia meningoseptica* |
| SBP00209 | American ginseng_1 | *Elizabethkingia ursingii* |
| SBP00209 | American ginseng_1 | *Elizabethkingia ursingii* |
| SBP00209 | American ginseng_1 | endosymbiont of unidentified scaly snail isolate Monju |
| SBP00209 | American ginseng_1 | endosymbiont of unidentified scaly snail isolate Monju |
| SBP00209 | American ginseng_1 | *Endozoicomonas montiporae* |
| SBP00209 | American ginseng_1 | *Endozoicomonas montiporae* |
| SBP00209 | American ginseng_1 | *Ensifer adhaerens* |
| SBP00209 | American ginseng_1 | *Ensifer adhaerens* |
| SBP00209 | American ginseng_1 | *Ensifer sojae* |
| SBP00209 | American ginseng_1 | *Ensifer sojae* |
| SBP00209 | American ginseng_1 | *Enterobacter asburiae* |
| SBP00209 | American ginseng_1 | *Enterobacter asburiae* |
| SBP00209 | American ginseng_1 | *Enterobacter bugandensis* |
| SBP00209 | American ginseng_1 | *Enterobacter bugandensis* |
| SBP00209 | American ginseng_1 | *Enterobacter cancerogenus* |
| SBP00209 | American ginseng_1 | *Enterobacter cancerogenus* |
| SBP00209 | American ginseng_1 | *Enterobacter cloacae* |
| SBP00209 | American ginseng_1 | *Enterobacter cloacae* |
| SBP00209 | American ginseng_1 | *Enterobacter cloacae* complex sp. |
| SBP00209 | American ginseng_1 | *Enterobacter cloacae* complex sp. |
| SBP00209 | American ginseng_1 | *Enterobacter cloacae* complex sp. ECNIH7 |
| SBP00209 | American ginseng_1 | *Enterobacter cloacae* complex sp. ECNIH7 |
| SBP00209 | American ginseng_1 | *Enterobacter cloacae* complex sp. FDA-CDC-AR_0132 |
| SBP00209 | American ginseng_1 | *Enterobacter cloacae* complex sp. FDA-CDC-AR_0132 |
| SBP00209 | American ginseng_1 | *Enterobacter cloacae* complex sp. FDA-CDC-AR_0164 |
| SBP00209 | American ginseng_1 | *Enterobacter cloacae* complex sp. FDA-CDC-AR_0164 |
| SBP00209 | American ginseng_1 | *Enterobacter hormaechei* |
| SBP00209 | American ginseng_1 | *Enterobacter hormaechei* |
| SBP00209 | American ginseng_1 | *Enterobacter kobei* |
| SBP00209 | American ginseng_1 | *Enterobacter kobei* |
| SBP00209 | American ginseng_1 | *Enterobacter ludwigii* |
| SBP00209 | American ginseng_1 | *Enterobacter ludwigii* |
| SBP00209 | American ginseng_1 | *Enterobacter roggenkampii* |
| SBP00209 | American ginseng_1 | *Enterobacter roggenkampii* |
| SBP00209 | American ginseng_1 | *Enterobacter soli* |
| SBP00209 | American ginseng_1 | *Enterobacter soli* |
| SBP00209 | American ginseng_1 | *Enterobacter* sp. 638 |
| SBP00209 | American ginseng_1 | *Enterobacter* sp. 638 |
| SBP00209 | American ginseng_1 | *Enterobacter* sp. Crenshaw |
| SBP00209 | American ginseng_1 | *Enterobacter* sp. Crenshaw |
| SBP00209 | American ginseng_1 | *Enterobacter* sp. E20 |
| SBP00209 | American ginseng_1 | *Enterobacter* sp. E20 |
| SBP00209 | American ginseng_1 | *Enterobacter* sp. FY-07 |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Enterobacter* sp. FY-07 |
| SBP00209 | American ginseng_1 | *Enterobacter* sp. HK169 |
| SBP00209 | American ginseng_1 | *Enterobacter* sp. HK169 |
| SBP00209 | American ginseng_1 | *Enterobacter* sp. N18-03635 |
| SBP00209 | American ginseng_1 | *Enterobacter* sp. N18-03635 |
| SBP00209 | American ginseng_1 | *Enterobacter* sp. ODB01 |
| SBP00209 | American ginseng_1 | *Enterobacter* sp. ODB01 |
| SBP00209 | American ginseng_1 | *Enterobacter* sp. R4-368 |
| SBP00209 | American ginseng_1 | *Enterobacter* sp. R4-368 |
| SBP00209 | American ginseng_1 | *Enterobacter* sp. SA187 |
| SBP00209 | American ginseng_1 | *Enterobacter* sp. SA187 |
| SBP00209 | American ginseng_1 | *Enterobacteriaceae bacterium* ENNIH1 |
| SBP00209 | American ginseng_1 | *Enterobacteriaceae bacterium* ENNIH1 |
| SBP00209 | American ginseng_1 | *Enterobacteriaceae bacterium* strain FGI 57 |
| SBP00209 | American ginseng_1 | *Enterobacteriaceae bacterium* strain FGI 57 |
| SBP00209 | American ginseng_1 | *Enterobacteriaceae bacterium* w17 |
| SBP00209 | American ginseng_1 | *Enterobacteriaceae bacterium* w17 |
| SBP00209 | American ginseng_1 | *Enterobacteriaceae bacterium* w6 |
| SBP00209 | American ginseng_1 | *Enterobacteriaceae bacterium* w6 |
| SBP00209 | American ginseng_1 | *Enterococcus avium* |
| SBP00209 | American ginseng_1 | *Enterococcus avium* |
| SBP00209 | American ginseng_1 | *Enterococcus cecorum* |
| SBP00209 | American ginseng_1 | *Enterococcus cecorum* |
| SBP00209 | American ginseng_1 | *Enterococcus durans* |
| SBP00209 | American ginseng_1 | *Enterococcus durans* |
| SBP00209 | American ginseng_1 | *Enterococcus faecalis* |
| SBP00209 | American ginseng_1 | *Enterococcus faecalis* |
| SBP00209 | American ginseng_1 | *Enterococcus faecium* |
| SBP00209 | American ginseng_1 | *Enterococcus faecium* |
| SBP00209 | American ginseng_1 | *Enterococcus gilvus* |
| SBP00209 | American ginseng_1 | *Enterococcus gilvus* |
| SBP00209 | American ginseng_1 | *Enterococcus mundtii* |
| SBP00209 | American ginseng_1 | *Enterococcus mundtii* |
| SBP00209 | American ginseng_1 | *Enterococcus* sp. CR-Ec1 |
| SBP00209 | American ginseng_1 | *Enterococcus* sp. CR-Ec1 |
| SBP00209 | American ginseng_1 | *Enterococcus* sp. FDAARGOS_375 |
| SBP00209 | American ginseng_1 | *Enterococcus* sp. FDAARGOS_375 |
| SBP00209 | American ginseng_1 | *Entomoplasma luminosum* |
| SBP00209 | American ginseng_1 | *Entomoplasma luminosum* |
| SBP00209 | American ginseng_1 | *Epibacterium mobile* |
| SBP00209 | American ginseng_1 | *Epibacterium mobile* |
| SBP00209 | American ginseng_1 | *Equid* gammaherpesvirus 5 |
| SBP00209 | American ginseng_1 | *Equid* gammaherpesvirus 5 |
| SBP00209 | American ginseng_1 | *Ereboglobus luteus* |
| SBP00209 | American ginseng_1 | *Ereboglobus luteus* |
| SBP00209 | American ginseng_1 | *Erwinia amylovora* |
| SBP00209 | American ginseng_1 | *Erwinia amylovora* |
| SBP00209 | American ginseng_1 | *Erwinia billingiae* |
| SBP00209 | American ginseng_1 | *Erwinia billingiae* |
| SBP00209 | American ginseng_1 | *Erwinia gerundensis* |
| SBP00209 | American ginseng_1 | *Erwinia gerundensis* |
| SBP00209 | American ginseng_1 | *Erwinia* sp. |
| SBP00209 | American ginseng_1 | *Erwinia* sp. |
| SBP00209 | American ginseng_1 | *Erwinia tasmaniensis* |
| SBP00209 | American ginseng_1 | *Erwinia tasmaniensis* |
| SBP00209 | American ginseng_1 | *Erysipelothrix rhusiopathiae* |
| SBP00209 | American ginseng_1 | *Erysipelothrix rhusiopathiae* |
| SBP00209 | American ginseng_1 | *Erysipelotrichaceae bacterium* SG0102 |
| SBP00209 | American ginseng_1 | *Erysipelotrichaceae bacterium* SG0102 |
| SBP00209 | American ginseng_1 | *Erythrobacter flavus* |
| SBP00209 | American ginseng_1 | *Erythrobacter flavus* |
| SBP00209 | American ginseng_1 | *Erythrobacter gangjinensis* |
| SBP00209 | American ginseng_1 | *Erythrobacter gangjinensis* |
| SBP00209 | American ginseng_1 | *Erythrobacter litoralis* |
| SBP00209 | American ginseng_1 | *Erythrobacter litoralis* |
| SBP00209 | American ginseng_1 | *Erythrobacter seohaensis* |
| SBP00209 | American ginseng_1 | *Erythrobacter seohaensis* |
| SBP00209 | American ginseng_1 | *Erythrobacter* sp. Alg231-14 |
| SBP00209 | American ginseng_1 | *Erythrobacter* sp. Alg231-14 |
| SBP00209 | American ginseng_1 | *Erythrobacter* sp. HKB08 |
| SBP00209 | American ginseng_1 | *Erythrobacter* sp. HKB08 |
| SBP00209 | American ginseng_1 | *Erythrobacter* sp. HL-111 |
| SBP00209 | American ginseng_1 | *Erythrobacter* sp. HL-111 |
| SBP00209 | American ginseng_1 | *Erythrobacter* sp. YH-07 |
| SBP00209 | American ginseng_1 | *Erythrobacter* sp. YH-07 |
| SBP00209 | American ginseng_1 | *Escherichia albertii* |

TABLE 3-continued

List of species identified in each metagenomic sample of each SBP Sample

| SBP ID | SBP Host Common Name | Genus sp. |
|---|---|---|
| SBP00209 | American ginseng_1 | *Escherichia albertii* |
| SBP00209 | American ginseng_1 | *Escherichia coli* |
| SBP00209 | American ginseng_1 | *Escherichia coli* |
| SBP00209 | American ginseng_1 | *Escherichia fergusonii* |
| SBP00209 | American ginseng_1 | *Escherichia fergusonii* |
| SBP00209 | American ginseng_1 | *Escherichia* sp. E4742 |
| SBP00209 | American ginseng_1 | *Escherichia* sp. E4742 |
| SBP00209 | American ginseng_1 | *Euzebya* sp. DY32-46 |
| SBP00209 | American ginseng_1 | *Euzebya* sp. DY32-46 |
| SBP00209 | American ginseng_1 | *Exiguobacterium mexicanum* |
| SBP00209 | American ginseng_1 | *Exiguobacterium mexicanum* |
| SBP00209 | American ginseng_1 | *Fabibacter pacificus* |
| SBP00209 | American ginseng_1 | *Fabibacter pacificus* |
| SBP00209 | American ginseng_1 | *Faecalibacterium prausnitzii* |
| SBP00209 | American ginseng_1 | *Faecalibacterium prausnitzii* |
| SBP00209 | American ginseng_1 | *Ferrimonas balearica* |
| SBP00209 | American ginseng_1 | *Ferrimonas balearica* |
| SBP00209 | American ginseng_1 | *Fibrella aestuarina* |
| SBP00209 | American ginseng_1 | *Fibrella aestuarina* |
| SBP00209 | American ginseng_1 | *Fibrobacter succinogenes* |
| SBP00209 | American ginseng_1 | *Fibrobacter succinogenes* |
| SBP00209 | American ginseng_1 | *Fictibacillus arsenicus* |
| SBP00209 | American ginseng_1 | *Fictibacillus arsenicus* |
| SBP00209 | American ginseng_1 | *Fictibacillus phosphorivorans* |
| SBP00209 | American ginseng_1 | *Fictibacillus phosphorivorans* |
| SBP00209 | American ginseng_1 | *Filifactor alocis* |
| SBP00209 | American ginseng_1 | *Filifactor alocis* |
| SBP00209 | American ginseng_1 | *Fimbriimonas ginsengisoli* |
| SBP00209 | American ginseng_1 | *Fimbriimonas ginsengisoli* |
| SBP00209 | American ginseng_1 | *Finegoldia magna* |
| SBP00209 | American ginseng_1 | *Finegoldia magna* |
| SBP00209 | American ginseng_1 | *Fischerella* sp. NIES-3754 |
| SBP00209 | American ginseng_1 | *Fischerella* sp. NIES-3754 |
| SBP00209 | American ginseng_1 | *Fischerella* sp. NIES-4106 |
| SBP00209 | American ginseng_1 | *Fischerella* sp. NIES-4106 |
| SBP00209 | American ginseng_1 | *Flammeovirga* sp. L12M1 |
| SBP00209 | American ginseng_1 | *Flammeovirga* sp. L12M1 |
| SBP00209 | American ginseng_1 | *Flammeovirga* sp. MY04 |
| SBP00209 | American ginseng_1 | *Flammeovirga* sp. MY04 |
| SBP00209 | American ginseng_1 | *Flammeovirgaceae bacterium* 311 |
| SBP00209 | American ginseng_1 | *Flammeovirgaceae bacterium* 311 |
| SBP00209 | American ginseng_1 | *Flaviflexus salsibiostraticola* |
| SBP00209 | American ginseng_1 | *Flaviflexus salsibiostraticola* |
| SBP00209 | American ginseng_1 | *Flavisolibacter* sp. 17J28-1 |
| SBP00209 | American ginseng_1 | *Flavisolibacter* sp. 17J28-1 |
| SBP00209 | American ginseng_1 | *Flavisolibacter tropicus* |
| SBP00209 | American ginseng_1 | *Flavisolibacter tropicus* |
| SBP00209 | American ginseng_1 | *Flavivirga eckloniae* |
| SBP00209 | American ginseng_1 | *Flavivirga eckloniae* |
| SBP00209 | American ginseng_1 | *Flavobacteriaceae bacterium* |
| SBP00209 | American ginseng_1 | *Flavobacteriaceae bacterium* |
| SBP00209 | American ginseng_1 | *Flavobacteriaceae bacterium* MAR_2010_188 |
| SBP00209 | American ginseng_1 | *Flavobacteriaceae bacterium* MAR_2010_188 |
| SBP00209 | American ginseng_1 | *Flavobacteriaceae bacterium* UJ101 |
| SBP00209 | American ginseng_1 | *Flavobacteriaceae bacterium* UJ101 |
| SBP00209 | American ginseng_1 | *Flavobacterium album* |
| SBP00209 | American ginseng_1 | *Flavobacterium album* |
| SBP00209 | American ginseng_1 | *Flavobacterium anhuiense* |
| SBP00209 | American ginseng_1 | *Flavobacterium anhuiense* |
| SBP00209 | American ginseng_1 | *Flavobacterium arcticum* |
| SBP00209 | American ginseng_1 | *Flavobacterium arcticum* |
| SBP00209 | American ginseng_1 | *Flavobacterium branchiophilum* |
| SBP00209 | American ginseng_1 | *Flavobacterium branchiophilum* |
| SBP00209 | American ginseng_1 | *Flavobacterium columnare* |
| SBP00209 | American ginseng_1 | *Flavobacterium columnare* |
| SBP00209 | American ginseng_1 | *Flavobacterium crassostreae* |
| SBP00209 | American ginseng_1 | *Flavobacterium crassostreae* |
| SBP00209 | American ginseng_1 | *Flavobacterium crocinum* |
| SBP00209 | American ginseng_1 | *Flavobacterium crocinum* |
| SBP00209 | American ginseng_1 | *Flavobacterium faecale* |
| SBP00209 | American ginseng_1 | *Flavobacterium faecale* |
| SBP00209 | American ginseng_1 | *Flavobacterium indicum* |
| SBP00209 | American ginseng_1 | *Flavobacterium indicum* |
| SBP00209 | American ginseng_1 | *Flavobacterium johnsoniae* |
| SBP00209 | American ginseng_1 | *Flavobacterium johnsoniae* |
| SBP00209 | American ginseng_1 | *Flavobacterium kingsejongi* |

TABLE 3-continued

List of species identified in each metagenomic sample of each SBP Sample

| SBP ID | SBP Host Common Name | Genus sp. |
|---|---|---|
| SBP00209 | American ginseng_1 | *Flavobacterium kingsejongi* |
| SBP00209 | American ginseng_1 | *Flavobacterium pallidum* |
| SBP00209 | American ginseng_1 | *Flavobacterium pallidum* |
| SBP00209 | American ginseng_1 | *Flavobacterium psychrophilum* |
| SBP00209 | American ginseng_1 | *Flavobacterium psychrophilum* |
| SBP00209 | American ginseng_1 | *Flavobacterium* sp. 140616W15 |
| SBP00209 | American ginseng_1 | *Flavobacterium* sp. 140616W15 |
| SBP00209 | American ginseng_1 | *Flavobacterium* sp. HYN0086 |
| SBP00209 | American ginseng_1 | *Flavobacterium* sp. HYN0086 |
| SBP00209 | American ginseng_1 | *Flexistipes sinusarabici* |
| SBP00209 | American ginseng_1 | *Flexistipes sinusarabici* |
| SBP00209 | American ginseng_1 | *Fluoribacter dumoffii* |
| SBP00209 | American ginseng_1 | *Fluoribacter dumoffii* |
| SBP00209 | American ginseng_1 | *Fluviicola taffensis* |
| SBP00209 | American ginseng_1 | *Fluviicola taffensis* |
| SBP00209 | American ginseng_1 | *Formosa agariphila* |
| SBP00209 | American ginseng_1 | *Formosa agariphila* |
| SBP00209 | American ginseng_1 | *Formosa* sp. Hel1_31_208 |
| SBP00209 | American ginseng_1 | *Formosa* sp. Hel1_31_208 |
| SBP00209 | American ginseng_1 | *Formosa* sp. Hel1_33_131 |
| SBP00209 | American ginseng_1 | *Formosa* sp. Hel1_33_131 |
| SBP00209 | American ginseng_1 | *Francisella hispaniensis* |
| SBP00209 | American ginseng_1 | *Francisella hispaniensis* |
| SBP00209 | American ginseng_1 | *Francisella* sp. FDC440 |
| SBP00209 | American ginseng_1 | *Francisella* sp. FDC440 |
| SBP00209 | American ginseng_1 | *Francisella* sp. TX077310 |
| SBP00209 | American ginseng_1 | *Francisella* sp. TX077310 |
| SBP00209 | American ginseng_1 | *Francisella tularensis* |
| SBP00209 | American ginseng_1 | *Francisella tularensis* |
| SBP00209 | American ginseng_1 | *Frankia alni* |
| SBP00209 | American ginseng_1 | *Frankia alni* |
| SBP00209 | American ginseng_1 | *Frankia casuarinae* |
| SBP00209 | American ginseng_1 | *Frankia casuarinae* |
| SBP00209 | American ginseng_1 | *Frankia inefficax* |
| SBP00209 | American ginseng_1 | *Frankia inefficax* |
| SBP00209 | American ginseng_1 | *Frankia* sp. EAN1pec |
| SBP00209 | American ginseng_1 | *Frankia* sp. EAN1pec |
| SBP00209 | American ginseng_1 | *Frankia* sp. QA3 |
| SBP00209 | American ginseng_1 | *Frankia* sp. QA3 |
| SBP00209 | American ginseng_1 | *Frankia* symbiont of *Datisca glomerata* |
| SBP00209 | American ginseng_1 | *Frankia* symbiont of *Datisca glomerata* |
| SBP00209 | American ginseng_1 | *Frankineae bacterium* MT45 |
| SBP00209 | American ginseng_1 | *Frankineae bacterium* MT45 |
| SBP00209 | American ginseng_1 | *Frateuria aurantia* |
| SBP00209 | American ginseng_1 | *Frateuria aurantia* |
| SBP00209 | American ginseng_1 | *Friedmanniella luteola* |
| SBP00209 | American ginseng_1 | *Friedmanniella luteola* |
| SBP00209 | American ginseng_1 | *Friedmanniella sagamiharensis* |
| SBP00209 | American ginseng_1 | *Friedmanniella sagamiharensis* |
| SBP00209 | American ginseng_1 | *Frondihabitans* sp. 762G35 |
| SBP00209 | American ginseng_1 | *Frondihabitans* sp. 762G35 |
| SBP00209 | American ginseng_1 | *Frondihabitans* sp. PAMC 28766 |
| SBP00209 | American ginseng_1 | *Frondihabitans* sp. PAMC 28766 |
| SBP00209 | American ginseng_1 | *Fuerstia marisgermanicae* |
| SBP00209 | American ginseng_1 | *Fuerstia marisgermanicae* |
| SBP00209 | American ginseng_1 | *Fusobacterium necrophorum* |
| SBP00209 | American ginseng_1 | *Fusobacterium necrophorum* |
| SBP00209 | American ginseng_1 | *Fusobacterium nucleatum* |
| SBP00209 | American ginseng_1 | *Fusobacterium nucleatum* |
| SBP00209 | American ginseng_1 | *Fusobacterium periodonticum* |
| SBP00209 | American ginseng_1 | *Fusobacterium periodonticum* |
| SBP00209 | American ginseng_1 | *Fusobacterium varium* |
| SBP00209 | American ginseng_1 | *Fusobacterium varium* |
| SBP00209 | American ginseng_1 | *Gallaecimonas* sp. HK-28 |
| SBP00209 | American ginseng_1 | *Gallaecimonas* sp. HK-28 |
| SBP00209 | American ginseng_1 | gamma *proteobacterium* HdN1 |
| SBP00209 | American ginseng_1 | gamma *proteobacterium* HdN1 |
| SBP00209 | American ginseng_1 | *Gammaproteobacteria bacterium* ESL0073 |
| SBP00209 | American ginseng_1 | *Gammaproteobacteria bacterium* ESL0073 |
| SBP00209 | American ginseng_1 | *Gardnerella vaginalis* |
| SBP00209 | American ginseng_1 | *Gardnerella vaginalis* |
| SBP00209 | American ginseng_1 | *Geitlerinema* sp. PCC 7407 |
| SBP00209 | American ginseng_1 | *Geitlerinema* sp. PCC 7407 |
| SBP00209 | American ginseng_1 | *Gemella haemolysans* |
| SBP00209 | American ginseng_1 | *Gemella haemolysans* |
| SBP00209 | American ginseng_1 | *Geminocystis herdmanii* |

TABLE 3-continued

List of species identified in each metagenomic sample of each SBP Sample

| SBP ID | SBP Host Common Name | Genus sp. |
|---|---|---|
| SBP00209 | American ginseng_1 | Geminocystis herdmanii |
| SBP00209 | American ginseng_1 | Geminocystis sp. NIES-3708 |
| SBP00209 | American ginseng_1 | Geminocystis sp. NIES-3708 |
| SBP00209 | American ginseng_1 | Geminocystis sp. NIES-3709 |
| SBP00209 | American ginseng_1 | Geminocystis sp. NIES-3709 |
| SBP00209 | American ginseng_1 | Gemmata obscuriglobus |
| SBP00209 | American ginseng_1 | Gemmata obscuriglobus |
| SBP00209 | American ginseng_1 | Gemmata sp. SH-PL17 |
| SBP00209 | American ginseng_1 | Gemmata sp. SH-PL17 |
| SBP00209 | American ginseng_1 | Gemmatimonas aurantiaca |
| SBP00209 | American ginseng_1 | Gemmatimonas aurantiaca |
| SBP00209 | American ginseng_1 | Gemmatimonas phototrophica |
| SBP00209 | American ginseng_1 | Gemmatimonas phototrophica |
| SBP00209 | American ginseng_1 | Gemmatirosa kalamazoonesis |
| SBP00209 | American ginseng_1 | Gemmatirosa kalamazoonesis |
| SBP00209 | American ginseng_1 | Gemmobacter sp. HYN0069 |
| SBP00209 | American ginseng_1 | Gemmobacter sp. HYN0069 |
| SBP00209 | American ginseng_1 | Geoalkalibacter subterraneus |
| SBP00209 | American ginseng_1 | Geoalkalibacter subterraneus |
| SBP00209 | American ginseng_1 | Geobacillus subterraneus |
| SBP00209 | American ginseng_1 | Geobacillus subterraneus |
| SBP00209 | American ginseng_1 | Geobacter anodireducens |
| SBP00209 | American ginseng_1 | Geobacter anodireducens |
| SBP00209 | American ginseng_1 | Geobacter pickeringii |
| SBP00209 | American ginseng_1 | Geobacter pickeringii |
| SBP00209 | American ginseng_1 | Geobacter sp. DSM 9736 |
| SBP00209 | American ginseng_1 | Geobacter sp. DSM 9736 |
| SBP00209 | American ginseng_1 | Geobacter sp. M18 |
| SBP00209 | American ginseng_1 | Geobacter sp. M18 |
| SBP00209 | American ginseng_1 | Geobacter sp. M21 |
| SBP00209 | American ginseng_1 | Geobacter sp. M21 |
| SBP00209 | American ginseng_1 | Geobacter sulfurreducens |
| SBP00209 | American ginseng_1 | Geobacter sulfurreducens |
| SBP00209 | American ginseng_1 | Geobacter uraniireducens |
| SBP00209 | American ginseng_1 | Geobacter uraniireducens |
| SBP00209 | American ginseng_1 | Geodermatophilus obscurus |
| SBP00209 | American ginseng_1 | Geodermatophilus obscurus |
| SBP00209 | American ginseng_1 | Georgenia sp. ZLJ0423 |
| SBP00209 | American ginseng_1 | Georgenia sp. ZLJ0423 |
| SBP00209 | American ginseng_1 | Geosporobacter ferrireducens |
| SBP00209 | American ginseng_1 | Geosporobacter ferrireducens |
| SBP00209 | American ginseng_1 | Gibbsiella quercinecans |
| SBP00209 | American ginseng_1 | Gibbsiella quercinecans |
| SBP00209 | American ginseng_1 | Gillisia sp. Hel1_33_143 |
| SBP00209 | American ginseng_1 | Gillisia sp. Hel1_33_143 |
| SBP00209 | American ginseng_1 | Glaciecola nitratireducens |
| SBP00209 | American ginseng_1 | Glaciecola nitratireducens |
| SBP00209 | American ginseng_1 | Glaciecola sp. THG-3.7 |
| SBP00209 | American ginseng_1 | Glaciecola sp. THG-3.7 |
| SBP00209 | American ginseng_1 | Glaesserella parasuis |
| SBP00209 | American ginseng_1 | Glaesserella parasuis |
| SBP00209 | American ginseng_1 | Glaesserella sp. 15-184 |
| SBP00209 | American ginseng_1 | Glaesserella sp. 15-184 |
| SBP00209 | American ginseng_1 | Gloeobacter kilaueensis |
| SBP00209 | American ginseng_1 | Gloeobacter kilaueensis |
| SBP00209 | American ginseng_1 | Gloeobacter violaceus |
| SBP00209 | American ginseng_1 | Gloeobacter violaceus |
| SBP00209 | American ginseng_1 | Gloeocapsa sp. PCC 7428 |
| SBP00209 | American ginseng_1 | Gloeocapsa sp. PCC 7428 |
| SBP00209 | American ginseng_1 | Gluconacetobacter diazotrophicus |
| SBP00209 | American ginseng_1 | Gluconacetobacter diazotrophicus |
| SBP00209 | American ginseng_1 | Gluconobacter albidus |
| SBP00209 | American ginseng_1 | Gluconobacter albidus |
| SBP00209 | American ginseng_1 | Glutamicibacter creatinolyticus |
| SBP00209 | American ginseng_1 | Glutamicibacter creatinolyticus |
| SBP00209 | American ginseng_1 | Glutamicibacter halophytocola |
| SBP00209 | American ginseng_1 | Glutamicibacter halophytocola |
| SBP00209 | American ginseng_1 | Glutamicibacter nicotianae |
| SBP00209 | American ginseng_1 | Glutamicibacter nicotianae |
| SBP00209 | American ginseng_1 | Gordonia alkanivorans |
| SBP00209 | American ginseng_1 | Gordonia alkanivorans |
| SBP00209 | American ginseng_1 | Gordonia bronchialis |
| SBP00209 | American ginseng_1 | Gordonia bronchialis |
| SBP00209 | American ginseng_1 | Gordonia iterans |
| SBP00209 | American ginseng_1 | Gordonia iterans |
| SBP00209 | American ginseng_1 | Gordonia phthalatica |

TABLE 3-continued

List of species identified in each metagenomic sample of each SBP Sample

| SBP ID | SBP Host Common Name | Genus sp. |
|---|---|---|
| SBP00209 | American ginseng_1 | *Gordonia phthalatica* |
| SBP00209 | American ginseng_1 | *Gordonia polyisoprenivorans* |
| SBP00209 | American ginseng_1 | *Gordonia polyisoprenivorans* |
| SBP00209 | American ginseng_1 | *Gordonia rubripertincta* |
| SBP00209 | American ginseng_1 | *Gordonia rubripertincta* |
| SBP00209 | American ginseng_1 | *Gordonia* sp. 1D |
| SBP00209 | American ginseng_1 | *Gordonia* sp. 1D |
| SBP00209 | American ginseng_1 | *Gordonia* sp. KTR9 |
| SBP00209 | American ginseng_1 | *Gordonia* sp. KTR9 |
| SBP00209 | American ginseng_1 | *Gordonia* sp. MMS17-SY073 |
| SBP00209 | American ginseng_1 | *Gordonia* sp. MMS17-SY073 |
| SBP00209 | American ginseng_1 | *Gordonia* sp. YC-JH1 |
| SBP00209 | American ginseng_1 | *Gordonia* sp. YC-JH1 |
| SBP00209 | American ginseng_1 | *Gordonla terrae* |
| SBP00209 | American ginseng_1 | *Gordonia terrae* |
| SBP00209 | American ginseng_1 | *Gordonibacter massiliensis* |
| SBP00209 | American ginseng_1 | *Gordonibacter massiliensis* |
| SBP00209 | American ginseng_1 | *Gordonibacter pamelaeae* |
| SBP00209 | American ginseng_1 | *Gordonibacter pamelaeae* |
| SBP00209 | American ginseng_1 | *Gottschalkia acidurici* |
| SBP00209 | American ginseng_1 | *Gottschalkia acidurici* |
| SBP00209 | American ginseng_1 | *Gramella forsetii* |
| SBP00209 | American ginseng_1 | *Gramella forsetii* |
| SBP00209 | American ginseng_1 | *Gramella salexigens* |
| SBP00209 | American ginseng_1 | *Gramella salexigens* |
| SBP00209 | American ginseng_1 | *Gramella* sp. MAR_2010_102 |
| SBP00209 | American ginseng_1 | *Gramella* sp. MAR_2010_102 |
| SBP00209 | American ginseng_1 | *Granulibacter bethesdensis* |
| SBP00209 | American ginseng_1 | *Granulibacter bethesdensis* |
| SBP00209 | American ginseng_1 | *Granulicella mallensis* |
| SBP00209 | American ginseng_1 | *Granulicella mallensis* |
| SBP00209 | American ginseng_1 | *Granulicella tundricola* |
| SBP00209 | American ginseng_1 | *Granulicella tundricola* |
| SBP00209 | American ginseng_1 | *Grimontia hollisae* |
| SBP00209 | American ginseng_1 | *Grimontia hollisae* |
| SBP00209 | American ginseng_1 | *Gryllotalpicola* sp. 2DFW10M-5 |
| SBP00209 | American ginseng_1 | *Gryllotalpicola* sp. 2DFW10M-5 |
| SBP00209 | American ginseng_1 | *Gynuella sunshinyii* |
| SBP00209 | American ginseng_1 | *Gynuella sunshinyii* |
| SBP00209 | American ginseng_1 | *Haematobacter massiliensis* |
| SBP00209 | American ginseng_1 | *Haematobacter massiliensis* |
| SBP00209 | American ginseng_1 | *Haemophilus haemolyticus* |
| SBP00209 | American ginseng_1 | *Haemophilus haemolyticus* |
| SBP00209 | American ginseng_1 | *Haemophilus influenzae* |
| SBP00209 | American ginseng_1 | *Haemophilus influenzae* |
| SBP00209 | American ginseng_1 | *Hafnia alvei* |
| SBP00209 | American ginseng_1 | *Hafnia alvei* |
| SBP00209 | American ginseng_1 | *Hafnia paralvei* |
| SBP00209 | American ginseng_1 | *Hafnia paralvei* |
| SBP00209 | American ginseng_1 | *Hahella chejuensis* |
| SBP00209 | American ginseng_1 | *Hahella chejuensis* |
| SBP00209 | American ginseng_1 | *Hahella* sp. KA22 |
| SBP00209 | American ginseng_1 | *Hahella* sp. KA22 |
| SBP00209 | American ginseng_1 | *Halanaerobium hydrogeniformans* |
| SBP00209 | American ginseng_1 | *Halanaerobium hydrogeniformans* |
| SBP00209 | American ginseng_1 | *Halanaerobium praevalens* |
| SBP00209 | American ginseng_1 | *Halanaerobium praevalens* |
| SBP00209 | American ginseng_1 | *Halapricum salinum* |
| SBP00209 | American ginseng_1 | *Halapricum salinum* |
| SBP00209 | American ginseng_1 | *Haliangium ochraceum* |
| SBP00209 | American ginseng_1 | *Haliangium ochraceum* |
| SBP00209 | American ginseng_1 | *Haliscomenobacter hydrossis* |
| SBP00209 | American ginseng_1 | *Haliscomenobacter hydrossis* |
| SBP00209 | American ginseng_1 | *Haloarcula marismortui* |
| SBP00209 | American ginseng_1 | *Haloarcula marismortui* |
| SBP00209 | American ginseng_1 | *Haloarculaceae archaeon* HArcel1 |
| SBP00209 | American ginseng_1 | *Haloarculaceae archaeon* HArcel1 |
| SBP00209 | American ginseng_1 | *Halobacillus litoralis* |
| SBP00209 | American ginseng_1 | *Halobacillus litoralis* |
| SBP00209 | American ginseng_1 | *Halobacteriovorax* sp. BALOs_7 |
| SBP00209 | American ginseng_1 | *Halobacteriovorax* sp. BALOs_7 |
| SBP00209 | American ginseng_1 | *Halobacterium hubeiense* |
| SBP00209 | American ginseng_1 | *Halobacterium hubeiense* |
| SBP00209 | American ginseng_1 | *Halobacterium* sp. DL1 |
| SBP00209 | American ginseng_1 | *Halobacterium* sp. DL1 |
| SBP00209 | American ginseng_1 | *Halobiforma lacisalsi* |

TABLE 3-continued

List of species identified in each metagenomic sample of each SBP Sample

| SBP ID | SBP Host Common Name | Genus sp. |
|---|---|---|
| SBP00209 | American ginseng_1 | Halobiforma lacisalsi |
| SBP00209 | American ginseng_1 | Halocella sp. SP3-1 |
| SBP00209 | American ginseng_1 | Halocella sp. SP3-1 |
| SBP00209 | American ginseng_1 | Halocynthiibacter arcticus |
| SBP00209 | American ginseng_1 | Halocynthiibacter arcticus |
| SBP00209 | American ginseng_1 | Haloferax gibbonsii |
| SBP00209 | American ginseng_1 | Haloferax gibbonsii |
| SBP00209 | American ginseng_1 | Haloferax volcanii |
| SBP00209 | American ginseng_1 | Haloferax volcanii |
| SBP00209 | American ginseng_1 | Halomicronema hongdechloris |
| SBP00209 | American ginseng_1 | Halomicronema hongdechloris |
| SBP00209 | American ginseng_1 | Halomonas aestuarii |
| SBP00209 | American ginseng_1 | Halomonas aestuarii |
| SBP00209 | American ginseng_1 | Halomonas beimenensis |
| SBP00209 | American ginseng_1 | Halomonas beimenensis |
| SBP00209 | American ginseng_1 | Halomonas hydrothermalis |
| SBP00209 | American ginseng_1 | Halomonas hydrothermalis |
| SBP00209 | American ginseng_1 | Halomonas sp. 1513 |
| SBP00209 | American ginseng_1 | Halomonas sp. 1513 |
| SBP00209 | American ginseng_1 | Halomonas sp. A3H3 |
| SBP00209 | American ginseng_1 | Halomonas sp. A3H3 |
| SBP00209 | American ginseng_1 | Halomonas sp. JS92-SW72 |
| SBP00209 | American ginseng_1 | Halomonas sp. JS92-SW72 |
| SBP00209 | American ginseng_1 | Halomonas sp. KO116 |
| SBP00209 | American ginseng_1 | Halomonas sp. KO116 |
| SBP00209 | American ginseng_1 | Halomonas sp. SF2003 |
| SBP00209 | American ginseng_1 | Halomonas sp. SF2003 |
| SBP00209 | American ginseng_1 | Halomonas subglaciescola |
| SBP00209 | American ginseng_1 | Halomonas subglaciescola |
| SBP00209 | American ginseng_1 | Halomonas venusta |
| SBP00209 | American ginseng_1 | Halomonas venusta |
| SBP00209 | American ginseng_1 | Halopenitus persicus |
| SBP00209 | American ginseng_1 | Halopenitus persicus |
| SBP00209 | American ginseng_1 | Halopiger xanaduensis |
| SBP00209 | American ginseng_1 | Halopiger xanaduensis |
| SBP00209 | American ginseng_1 | Haloquadratum walsbyi |
| SBP00209 | American ginseng_1 | Haloquadratum walsbyi |
| SBP00209 | American ginseng_1 | Halorhabdus tiamatea |
| SBP00209 | American ginseng_1 | Halorhabdus tiamatea |
| SBP00209 | American ginseng_1 | Halorhodospira halophila |
| SBP00209 | American ginseng_1 | Halorhodospira halophila |
| SBP00209 | American ginseng_1 | Halorubrum ezzemoulense |
| SBP00209 | American ginseng_1 | Halorubrum ezzemoulense |
| SBP00209 | American ginseng_1 | Halorubrum lacusprofundi |
| SBP00209 | American ginseng_1 | Halorubrum lacusprofundi |
| SBP00209 | American ginseng_1 | Halorubrum sp. BOL3-1 |
| SBP00209 | American ginseng_1 | Halorubrum sp. BOL3-1 |
| SBP00209 | American ginseng_1 | Halorussus sp. RC-68 |
| SBP00209 | American ginseng_1 | Halorussus sp. RC-68 |
| SBP00209 | American ginseng_1 | Halotalea alkalilenta |
| SBP00209 | American ginseng_1 | Halotalea alkalilenta |
| SBP00209 | American ginseng_1 | Haloterrigena turkmenica |
| SBP00209 | American ginseng_1 | Haloterrigena turkmenica |
| SBP00209 | American ginseng_1 | Halothece sp. PCC 7418 |
| SBP00209 | American ginseng_1 | Halothece sp. PCC 7418 |
| SBP00209 | American ginseng_1 | Halothiobacillus neapolitanus |
| SBP00209 | American ginseng_1 | Halothiobacillus neapolitanus |
| SBP00209 | American ginseng_1 | Halothiobacillus sp. LS2 |
| SBP00209 | American ginseng_1 | Halothiobacillus sp. LS2 |
| SBP00209 | American ginseng_1 | Hartmannibacter diazotrophicus |
| SBP00209 | American ginseng_1 | Hartmannibacter diazotrophicus |
| SBP00209 | American ginseng_1 | Hathewaya histolytica |
| SBP00209 | American ginseng_1 | Hathewaya histolytica |
| SBP00209 | American ginseng_1 | Helicobacter apodemus |
| SBP00209 | American ginseng_1 | Helicobacter apodemus |
| SBP00209 | American ginseng_1 | Helicobacter bilis |
| SBP00209 | American ginseng_1 | Helicobacter bilis |
| SBP00209 | American ginseng_1 | Helicobacter cetorum |
| SBP00209 | American ginseng_1 | Helicobacter cetorum |
| SBP00209 | American ginseng_1 | Helicobacter cinaedi |
| SBP00209 | American ginseng_1 | Helicobacter cinaedi |
| SBP00209 | American ginseng_1 | Helicobacter himalayensis |
| SBP00209 | American ginseng_1 | Helicobacter himalayensis |
| SBP00209 | American ginseng_1 | Helicobacter pullorum |
| SBP00209 | American ginseng_1 | Helicobacter pullorum |
| SBP00209 | American ginseng_1 | Helicobacter pylori |

TABLE 3-continued

List of species identified in each metagenomic sample of each SBP Sample

| SBP ID | SBP Host Common Name | Genus sp. |
|---|---|---|
| SBP00209 | American ginseng_1 | *Helicobacter pylori* |
| SBP00209 | American ginseng_1 | *Helicobacter saguini* |
| SBP00209 | American ginseng_1 | *Helicobacter saguini* |
| SBP00209 | American ginseng_1 | *Heliobacterium modesticaldum* |
| SBP00209 | American ginseng_1 | *Heliobacterium modesticaldum* |
| SBP00209 | American ginseng_1 | *Hemileuca* sp. nucleopolyhedrovirus |
| SBP00209 | American ginseng_1 | *Hemileuca* sp. nucleopolyhedrovirus |
| SBP00209 | American ginseng_1 | *Herbaspirillum hiltneri* |
| SBP00209 | American ginseng_1 | *Herbaspirillum hiltneri* |
| SBP00209 | American ginseng_1 | *Herbaspirillum huttiense* |
| SBP00209 | American ginseng_1 | *Herbaspirillum huttiense* |
| SBP00209 | American ginseng_1 | *Herbaspirillum robiniae* |
| SBP00209 | American ginseng_1 | *Herbaspirillum robiniae* |
| SBP00209 | American ginseng_1 | *Herbaspirillum rubrisubalbicans* |
| SBP00209 | American ginseng_1 | *Herbaspirillum rubrisubalbicans* |
| SBP00209 | American ginseng_1 | *Herbaspirillum seropedicae* |
| SBP00209 | American ginseng_1 | *Herbaspirillum seropedicae* |
| SBP00209 | American ginseng_1 | *Herbaspirillum* sp. meg3 |
| SBP00209 | American ginseng_1 | *Herbaspirillum* sp. meg3 |
| SBP00209 | American ginseng_1 | *Herminiimonas arsenicoxydans* |
| SBP00209 | American ginseng_1 | *Herminilmonas arsenicoxydans* |
| SBP00209 | American ginseng_1 | *Herminiimonas arsenitoxidans* |
| SBP00209 | American ginseng_1 | *Herminiimonas arsenitoxidans* |
| SBP00209 | American ginseng_1 | Hibiscus green spot virus 2 |
| SBP00209 | American ginseng_1 | Hibiscus green spot virus 2 |
| SBP00209 | American ginseng_1 | *Histophilus somni* |
| SBP00209 | American ginseng_1 | *Histophilus somni* |
| SBP00209 | American ginseng_1 | *Hoeflea phototrophica* |
| SBP00209 | American ginseng_1 | *Hoeflea phototrophica* |
| SBP00209 | American ginseng_1 | *Hoeflea* sp. IMCC20628 |
| SBP00209 | American ginseng_1 | *Hoeflea* sp. IMCC20628 |
| SBP00209 | American ginseng_1 | *Humibacter* sp. BT305 |
| SBP00209 | American ginseng_1 | *Humibacter* sp. BT305 |
| SBP00209 | American ginseng_1 | *Hungateiclostridium clariflavum* |
| SBP00209 | American ginseng_1 | *Hungateiclostridium clariflavum* |
| SBP00209 | American ginseng_1 | *Hungateiclostridium saccincola* |
| SBP00209 | American ginseng_1 | *Hungateiclostridium saccincola* |
| SBP00209 | American ginseng_1 | *Hungatella hathewayi* |
| SBP00209 | American ginseng_1 | *Hungatella hathewayi* |
| SBP00209 | American ginseng_1 | *Hydrogenobacter thermophilus* |
| SBP00209 | American ginseng_1 | *Hydrogenobacter thermophilus* |
| SBP00209 | American ginseng_1 | *Hydrogenobaculum* sp. Y04AAS1 |
| SBP00209 | American ginseng_1 | *Hydrogenobaculum* sp. Y04AAS1 |
| SBP00209 | American ginseng_1 | *Hydrogenophaga crassostreae* |
| SBP00209 | American ginseng_1 | *Hydrogenophaga crassostreae* |
| SBP00209 | American ginseng_1 | *Hydrogenophaga pseudoflava* |
| SBP00209 | American ginseng_1 | *Hydrogenophaga pseudoflava* |
| SBP00209 | American ginseng_1 | *Hydrogenophaga* sp. NH-16 |
| SBP00209 | American ginseng_1 | *Hydrogenophaga* sp. NH-16 |
| SBP00209 | American ginseng_1 | *Hydrogenophaga* sp. PBC |
| SBP00209 | American ginseng_1 | *Hydrogenophaga* sp. PBC |
| SBP00209 | American ginseng_1 | *Hydrogenophaga* sp. RAC07 |
| SBP00209 | American ginseng_1 | *Hydrogenophaga* sp. RAC07 |
| SBP00209 | American ginseng_1 | *Hydrogenovibrio thermophilus* |
| SBP00209 | American ginseng_1 | *Hydrogenovibrio thermophilus* |
| SBP00209 | American ginseng_1 | *Hylemonella gracilis* |
| SBP00209 | American ginseng_1 | *Hylemonella gracilis* |
| SBP00209 | American ginseng_1 | *Hymenobacter sedentarius* |
| SBP00209 | American ginseng_1 | *Hymenobacter sedentarius* |
| SBP00209 | American ginseng_1 | *Hymenobacter* sp. 17J36-26 |
| SBP00209 | American ginseng_1 | *Hymenobacter* sp. 17J36-26 |
| SBP00209 | American ginseng_1 | *Hymenobacter* sp. 17J68-5 |
| SBP00209 | American ginseng_1 | *Hymenobacter* sp. 17J68-5 |
| SBP00209 | American ginseng_1 | *Hymenobacter* sp. DG25B |
| SBP00209 | American ginseng_1 | *Hymenobacter* sp. DG25B |
| SBP00209 | American ginseng_1 | *Hymenobacter* sp. PAMC 26554 |
| SBP00209 | American ginseng_1 | *Hymenobacter* sp. PAMC 26554 |
| SBP00209 | American ginseng_1 | *Hymenobacter* sp. PAMC 26628 |
| SBP00209 | American ginseng_1 | *Hymenobacter* sp. PAMC 26628 |
| SBP00209 | American ginseng_1 | *Hymenobacter* sp. sh-6 |
| SBP00209 | American ginseng_1 | *Hymenobacter* sp. sh-6 |
| SBP00209 | American ginseng_1 | *Hymenobacter swuensis* |
| SBP00209 | American ginseng_1 | *Hymenobacter swuensis* |
| SBP00209 | American ginseng_1 | *Hyperthermus butylicus* |
| SBP00209 | American ginseng_1 | *Hyperthermus butylicus* |
| SBP00209 | American ginseng_1 | *Hyphomicrobium denitrificans* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Hyphomicrobium denitrificans* |
| SBP00209 | American ginseng_1 | *Hyphomicrobium nitrativorans* |
| SBP00209 | American ginseng_1 | *Hyphomicrobium nitrativorans* |
| SBP00209 | American ginseng_1 | *Hyphomicrobium* sp. MC1 |
| SBP00209 | American ginseng_1 | *Hyphomicrobium* sp. MC1 |
| SBP00209 | American ginseng_1 | *Hyphomonas neptunium* |
| SBP00209 | American ginseng_1 | *Hyphomonas neptunium* |
| SBP00209 | American ginseng_1 | *Hyphomonas* sp. CACIAM 19H1 |
| SBP00209 | American ginseng_1 | *Hyphomonas* sp. CACIAM 19H1 |
| SBP00209 | American ginseng_1 | *Hyphomonas* sp. Mor2 |
| SBP00209 | American ginseng_1 | *Hyphomonas* sp. Mor2 |
| SBP00209 | American ginseng_1 | *Idiomarinaceae bacterium* HL-53 |
| SBP00209 | American ginseng_1 | *Idiomarinaceae bacterium* HL-53 |
| SBP00209 | American ginseng_1 | *Ignavibacterium album* |
| SBP00209 | American ginseng_1 | *Ignavibacterium album* |
| SBP00209 | American ginseng_1 | *Ilyobacter polytropus* |
| SBP00209 | American ginseng_1 | *Ilyobacter polytropus* |
| SBP00209 | American ginseng_1 | *Immundisolibacter cernigliae* |
| SBP00209 | American ginseng_1 | *Immundisolibacter cernigliae* |
| SBP00209 | American ginseng_1 | *Indioceanicola profundi* |
| SBP00209 | American ginseng_1 | *Indioceanicola profundi* |
| SBP00209 | American ginseng_1 | *Inhella inkyongensis* |
| SBP00209 | American ginseng_1 | *Inhella inkyongensis* |
| SBP00209 | American ginseng_1 | *Intrasporangium calvum* |
| SBP00209 | American ginseng_1 | *Intrasporangium calvum* |
| SBP00209 | American ginseng_1 | *Isoptericola dokdonensis* |
| SBP00209 | American ginseng_1 | *Isoptericola dokdonensis* |
| SBP00209 | American ginseng_1 | *Isoptericola variabilis* |
| SBP00209 | American ginseng_1 | *Isoptericola variabilis* |
| SBP00209 | American ginseng_1 | *Isosphaera pallida* |
| SBP00209 | American ginseng_1 | *Isosphaera pallida* |
| SBP00209 | American ginseng_1 | *Janibacter indicus* |
| SBP00209 | American ginseng_1 | *Janibacter indicus* |
| SBP00209 | American ginseng_1 | *Janibacter limosus* |
| SBP00209 | American ginseng_1 | *Janibacter limosus* |
| SBP00209 | American ginseng_1 | *Jannaschia* sp. CCS1 |
| SBP00209 | American ginseng_1 | *Jannaschia* sp. CCS1 |
| SBP00209 | American ginseng_1 | *Janthinobacterium agaricidamnosum* |
| SBP00209 | American ginseng_1 | *Janthinobacterium agaricidamnosum* |
| SBP00209 | American ginseng_1 | *Janthinobacterium* sp. 1_2014MBL_MicDiv |
| SBP00209 | American ginseng_1 | *Janthinobacterium* sp. 1_2014MBL_MicDiv |
| SBP00209 | American ginseng_1 | *Janthinobacterium* sp. 17J80-10 |
| SBP00209 | American ginseng_1 | *Janthinobacterium* sp. 17J80-10 |
| SBP00209 | American ginseng_1 | *Janthinobacterium* sp. B9-8 |
| SBP00209 | American ginseng_1 | *Janthinobacterium* sp. B9-8 |
| SBP00209 | American ginseng_1 | *Janthinobacterium* sp. LM6 |
| SBP00209 | American ginseng_1 | *Janthinobacterium* sp. LM6 |
| SBP00209 | American ginseng_1 | *Janthinobacterium* sp. Marseille |
| SBP00209 | American ginseng_1 | *Janthinobacterium* sp. Marseille |
| SBP00209 | American ginseng_1 | *Janthinobacterium svalbardensis* |
| SBP00209 | American ginseng_1 | *Janthinobacterium svalbardensis* |
| SBP00209 | American ginseng_1 | *Jatrophihabitans* sp. GAS493 |
| SBP00209 | American ginseng_1 | *Jatrophihabitans* sp. GAS493 |
| SBP00209 | American ginseng_1 | *Jeongeupia* sp. USM3 |
| SBP00209 | American ginseng_1 | *Jeongeupia* sp. USM3 |
| SBP00209 | American ginseng_1 | *Jeotgalibaca* sp. PTS2502 |
| SBP00209 | American ginseng_1 | *Jeotgalibaca* sp. PTS2502 |
| SBP00209 | American ginseng_1 | *Jeotgalibacillus malaysiensis* |
| SBP00209 | American ginseng_1 | *Jeotgalibacillus malaysiensis* |
| SBP00209 | American ginseng_1 | *Jiangella alkaliphila* |
| SBP00209 | American ginseng_1 | *Jiangella alkaliphila* |
| SBP00209 | American ginseng_1 | *Jiangella* sp. DSM 45060 |
| SBP00209 | American ginseng_1 | *Jiangella* sp. DSM 45060 |
| SBP00209 | American ginseng_1 | *Kallithea virus* |
| SBP00209 | American ginseng_1 | *Kallithea virus* |
| SBP00209 | American ginseng_1 | *Kangiella koreensis* |
| SBP00209 | American ginseng_1 | *Kangiella koreensis* |
| SBP00209 | American ginseng_1 | *Kangiella profundi* |
| SBP00209 | American ginseng_1 | *Kangiella profundi* |
| SBP00209 | American ginseng_1 | *Kerstersia gyiorum* |
| SBP00209 | American ginseng_1 | *Kerstersia gyiorum* |
| SBP00209 | American ginseng_1 | *Ketobacter alkanivorans* |
| SBP00209 | American ginseng_1 | *Ketobacter alkanivorans* |
| SBP00209 | American ginseng_1 | *Ketogulonicigenium robustum* |
| SBP00209 | American ginseng_1 | *Ketogulonicigenium robustum* |
| SBP00209 | American ginseng_1 | *Ketogulonicigenium vulgare* |

TABLE 3-continued

List of species identified in each metagenomic sample of each SBP Sample

| SBP ID | SBP Host Common Name | Genus sp. |
|---|---|---|
| SBP00209 | American ginseng_1 | Ketogulonicigenium vulgare |
| SBP00209 | American ginseng_1 | Kibdelosporangium phytohabitans |
| SBP00209 | American ginseng_1 | Kibdelosporangium phytohabitans |
| SBP00209 | American ginseng_1 | Kineococcus radiotolerans |
| SBP00209 | American ginseng_1 | Kineococcus radiotolerans |
| SBP00209 | American ginseng_1 | Kingella kingae |
| SBP00209 | American ginseng_1 | Kingella kingae |
| SBP00209 | American ginseng_1 | Kitasatospora albolonga |
| SBP00209 | American ginseng_1 | Kitasatospora albolonga |
| SBP00209 | American ginseng_1 | Kitasatospora aureofaciens |
| SBP00209 | American ginseng_1 | Kitasatospora aureofaciens |
| SBP00209 | American ginseng_1 | Kitasatospora setae |
| SBP00209 | American ginseng_1 | Kitasatospora setae |
| SBP00209 | American ginseng_1 | Kitasatospora sp. MMS16-BH015 |
| SBP00209 | American ginseng_1 | Kitasatospora sp. MMS16-BH015 |
| SBP00209 | American ginseng_1 | Klebsiella aerogenes |
| SBP00209 | American ginseng_1 | Klebsiella aerogenes |
| SBP00209 | American ginseng_1 | Klebsiella michiganensis |
| SBP00209 | American ginseng_1 | Klebsiella michiganensis |
| SBP00209 | American ginseng_1 | Klebsiella oxytoca |
| SBP00209 | American ginseng_1 | Klebsiella oxytoca |
| SBP00209 | American ginseng_1 | Klebsiella pneumoniae |
| SBP00209 | American ginseng_1 | Klebsiella pneumoniae |
| SBP00209 | American ginseng_1 | Klebsiella quasipneumoniae |
| SBP00209 | American ginseng_1 | Klebsiella quasipneumoniae |
| SBP00209 | American ginseng_1 | Klebsiella sp. FDAARGOS_511 |
| SBP00209 | American ginseng_1 | Klebsiella sp. FDAARGOS_511 |
| SBP00209 | American ginseng_1 | Klebsiella sp. M5al |
| SBP00209 | American ginseng_1 | Klebsiella sp. M5al |
| SBP00209 | American ginseng_1 | Klebsiella sp. WCHKl090001 |
| SBP00209 | American ginseng_1 | Klebsiella sp. WCHKl090001 |
| SBP00209 | American ginseng_1 | Klebsiella variicola |
| SBP00209 | American ginseng_1 | Klebsiella variicola |
| SBP00209 | American ginseng_1 | Kluyvera intermedia |
| SBP00209 | American ginseng_1 | Kluyvera intermedia |
| SBP00209 | American ginseng_1 | Kocuria flava |
| SBP00209 | American ginseng_1 | Kocuria flava |
| SBP00209 | American ginseng_1 | Kocuria indica |
| SBP00209 | American ginseng_1 | Kocuria indica |
| SBP00209 | American ginseng_1 | Kocuria palustris |
| SBP00209 | American ginseng_1 | Kocuria palustris |
| SBP00209 | American ginseng_1 | Kocuria rosea |
| SBP00209 | American ginseng_1 | Kocuria rosea |
| SBP00209 | American ginseng_1 | Kocuria turfanensis |
| SBP00209 | American ginseng_1 | Kocuria turfanensis |
| SBP00209 | American ginseng_1 | Komagataeibacter medellinensis |
| SBP00209 | American ginseng_1 | Komagataeibacter medellinensis |
| SBP00209 | American ginseng_1 | Komagataeibacter nataicola |
| SBP00209 | American ginseng_1 | Komagataeibacter nataicola |
| SBP00209 | American ginseng_1 | Komagataeibacter saccharivorans |
| SBP00209 | American ginseng_1 | Komagataeibacter saccharivorans |
| SBP00209 | American ginseng_1 | Komagataeibacter xylinus |
| SBP00209 | American ginseng_1 | Komagataeibacter xylinus |
| SBP00209 | American ginseng_1 | Kordia sp. SMS9 |
| SBP00209 | American ginseng_1 | Kordia sp. SMS9 |
| SBP00209 | American ginseng_1 | Kosakonia cowanii |
| SBP00209 | American ginseng_1 | Kosakonia cowanii |
| SBP00209 | American ginseng_1 | Kosakonia oryzae |
| SBP00209 | American ginseng_1 | Kosakonia oryzae |
| SBP00209 | American ginseng_1 | Kosakonia radicincitans |
| SBP00209 | American ginseng_1 | Kosakonia radicincitans |
| SBP00209 | American ginseng_1 | Kosakonia sacchari |
| SBP00209 | American ginseng_1 | Kosakonia sacchari |
| SBP00209 | American ginseng_1 | Kosakonia sp. CCTCC M2018092 |
| SBP00209 | American ginseng_1 | Kosakonia sp. CCTCC M2018092 |
| SBP00209 | American ginseng_1 | Kozakia baliensis |
| SBP00209 | American ginseng_1 | Kozakia baliensis |
| SBP00209 | American ginseng_1 | Kribbella flavida |
| SBP00209 | American ginseng_1 | Kribbella flavida |
| SBP00209 | American ginseng_1 | Kurthia zopfii |
| SBP00209 | American ginseng_1 | Kurthia zopfii |
| SBP00209 | American ginseng_1 | Kushneria konosiri |
| SBP00209 | American ginseng_1 | Kushneria konosiri |
| SBP00209 | American ginseng_1 | Kushneria marisflavi |
| SBP00209 | American ginseng_1 | Kushneria marisflavi |
| SBP00209 | American ginseng_1 | Kutzneria albida |

TABLE 3-continued

List of species identified in each metagenomic sample of each SBP Sample

| SBP ID | SBP Host Common Name | Genus sp. |
|---|---|---|
| SBP00209 | American ginseng_1 | *Kutzneria albida* |
| SBP00209 | American ginseng_1 | *Kytococcus sedentarius* |
| SBP00209 | American ginseng_1 | *Kytococcus sedentarius* |
| SBP00209 | American ginseng_1 | *Labrenzia aggregata* |
| SBP00209 | American ginseng_1 | *Labrenzia aggregata* |
| SBP00209 | American ginseng_1 | *Labrenzia* sp. VG12 |
| SBP00209 | American ginseng_1 | *Labrenzia* sp. VG12 |
| SBP00209 | American ginseng_1 | *Lachnoanaerobaculum umeaense* |
| SBP00209 | American ginseng_1 | *Lachnoanaerobaculum umeaense* |
| SBP00209 | American ginseng_1 | *Lachnoclostridium phocaeense* |
| SBP00209 | American ginseng_1 | *Lachnoclostridium phocaeense* |
| SBP00209 | American ginseng_1 | *Lachnoclostridium phytofermentans* |
| SBP00209 | American ginseng_1 | *Lachnoclostridium phytofermentans* |
| SBP00209 | American ginseng_1 | *Lachnoclostridium* sp. YL32 |
| SBP00209 | American ginseng_1 | *Lachnoclostridium* sp. YL32 |
| SBP00209 | American ginseng_1 | *Lachnospiraceae bacterium* GAM79 |
| SBP00209 | American ginseng_1 | *Lachnospiraceae bacterium* GAM79 |
| SBP00209 | American ginseng_1 | *Lacimicrobium alkaliphilum* |
| SBP00209 | American ginseng_1 | *Lacimicrobium alkaliphilum* |
| SBP00209 | American ginseng_1 | *Lacinutrix* sp. 5H-3-7-4 |
| SBP00209 | American ginseng_1 | *Lacinutrix* sp. 5H-3-7-4 |
| SBP00209 | American ginseng_1 | *Lacinutrix* sp. Bg11-31 |
| SBP00209 | American ginseng_1 | *Lacinutrix* sp. Bg11-31 |
| SBP00209 | American ginseng_1 | *Lactobacillus acidophilus* |
| SBP00209 | American ginseng_1 | *Lactobacillus acidophilus* |
| SBP00209 | American ginseng_1 | *Lactobacillus alimentarius* |
| SBP00209 | American ginseng_1 | *Lactobacillus alimentarius* |
| SBP00209 | American ginseng_1 | *Lactobacillus allii* |
| SBP00209 | American ginseng_1 | *Lactobacillus allii* |
| SBP00209 | American ginseng_1 | *Lactobacillus amylovorus* |
| SBP00209 | American ginseng_1 | *Lactobacillus amylovorus* |
| SBP00209 | American ginseng_1 | *Lactobacillus animalis* |
| SBP00209 | American ginseng_1 | *Lactobacillus animalis* |
| SBP00209 | American ginseng_1 | *Lactobacillus backii* |
| SBP00209 | American ginseng_1 | *Lactobacillus backii* |
| SBP00209 | American ginseng_1 | *Lactobacillus brevis* |
| SBP00209 | American ginseng_1 | *Lactobacillus brevis* |
| SBP00209 | American ginseng_1 | *Lactobacillus buchneri* |
| SBP00209 | American ginseng_1 | *Lactobacillus buchneri* |
| SBP00209 | American ginseng_1 | *Lactobacillus coryniformis* |
| SBP00209 | American ginseng_1 | *Lactobacillus coryniformis* |
| SBP00209 | American ginseng_1 | *Lactobacillus crispatus* |
| SBP00209 | American ginseng_1 | *Lactobacillus crispatus* |
| SBP00209 | American ginseng_1 | *Lactobacillus crustorum* |
| SBP00209 | American ginseng_1 | *Lactobacillus crustorum* |
| SBP00209 | American ginseng_1 | *Lactobacillus curvatus* |
| SBP00209 | American ginseng_1 | *Lactobacillus curvatus* |
| SBP00209 | American ginseng_1 | *Lactobacillus delbrueckii* |
| SBP00209 | American ginseng_1 | *Lactobacillus delbrueckii* |
| SBP00209 | American ginseng_1 | *Lactobacillus farciminis* |
| SBP00209 | American ginseng_1 | *Lactobacillus farciminis* |
| SBP00209 | American ginseng_1 | *Lactobacillus fermentum* |
| SBP00209 | American ginseng_1 | *Lactobacillus fermentum* |
| SBP00209 | American ginseng_1 | *Lactobacillus fuchuensis* |
| SBP00209 | American ginseng_1 | *Lactobacillus fuchuensis* |
| SBP00209 | American ginseng_1 | *Lactobacillus gasseri* |
| SBP00209 | American ginseng_1 | *Lactobacillus gasseri* |
| SBP00209 | American ginseng_1 | *Lactobacillus heilongjiangensis* |
| SBP00209 | American ginseng_1 | *Lactobacillus heilongjiangensis* |
| SBP00209 | American ginseng_1 | *Lactobacillus helsingborgensis* |
| SBP00209 | American ginseng_1 | *Lactobacillus helsingborgensis* |
| SBP00209 | American ginseng_1 | *Lactobacillus jensenii* |
| SBP00209 | American ginseng_1 | *Lactobacillus jensenii* |
| SBP00209 | American ginseng_1 | *Lactobacillus johnsonii* |
| SBP00209 | American ginseng_1 | *Lactobacillus johnsonii* |
| SBP00209 | American ginseng_1 | *Lactobacillus kullabergensis* |
| SBP00209 | American ginseng_1 | *Lactobacillus kullabergensis* |
| SBP00209 | American ginseng_1 | *Lactobacillus parabuchneri* |
| SBP00209 | American ginseng_1 | *Lactobacillus parabuchneri* |
| SBP00209 | American ginseng_1 | *Lactobacillus paracasei* |
| SBP00209 | American ginseng_1 | *Lactobacillus paracasei* |
| SBP00209 | American ginseng_1 | *Lactobacillus paraplantarum* |
| SBP00209 | American ginseng_1 | *Lactobacillus paraplantarum* |
| SBP00209 | American ginseng_1 | *Lactobacillus pentosus* |
| SBP00209 | American ginseng_1 | *Lactobacillus pentosus* |
| SBP00209 | American ginseng_1 | *Lactobacillus reuteri* |

TABLE 3-continued

List of species identified in each metagenomic sample of each SBP Sample

| SBP ID | SBP Host Common Name | Genus sp. |
|---|---|---|
| SBP00209 | American ginseng_1 | *Lactobacillus reuteri* |
| SBP00209 | American ginseng_1 | *Lactobacillus sakei* |
| SBP00209 | American ginseng_1 | *Lactobacillus sakei* |
| SBP00209 | American ginseng_1 | *Lactobacillus* sp. BHWM-4 |
| SBP00209 | American ginseng_1 | *Lactobacillus* sp. BHWM-4 |
| SBP00209 | American ginseng_1 | *Lactobacillus* sp. HBUAS52074 |
| SBP00209 | American ginseng_1 | *Lactobacillus* sp. HBUAS52074 |
| SBP00209 | American ginseng_1 | *Lactococcus garvieae* |
| SBP00209 | American ginseng_1 | *Lactococcus garvieae* |
| SBP00209 | American ginseng_1 | *Lactococcus lactis* |
| SBP00209 | American ginseng_1 | *Lactococcus lactis* |
| SBP00209 | American ginseng_1 | *Lactococcus piscium* |
| SBP00209 | American ginseng_1 | *Lactococcus piscium* |
| SBP00209 | American ginseng_1 | *Lacunisphaera limnophila* |
| SBP00209 | American ginseng_1 | *Lacunisphaera limnophila* |
| SBP00209 | American ginseng_1 | *Laribacter hongkongensis* |
| SBP00209 | American ginseng_1 | *Laribacter hongkongensis* |
| SBP00209 | American ginseng_1 | *Lautropia mirabilis* |
| SBP00209 | American ginseng_1 | *Lautropia mirabilis* |
| SBP00209 | American ginseng_1 | *Leclercia adecarboxylata* |
| SBP00209 | American ginseng_1 | *Leclercia adecarboxylata* |
| SBP00209 | American ginseng_1 | *Leclercia* sp. LSNIH1 |
| SBP00209 | American ginseng_1 | *Leclercia* sp. LSNIH1 |
| SBP00209 | American ginseng_1 | *Leclercia* sp. LSNIH3 |
| SBP00209 | American ginseng_1 | *Leclercia* sp. LSNIH3 |
| SBP00209 | American ginseng_1 | *Legionella anisa* |
| SBP00209 | American ginseng_1 | *Legionella anisa* |
| SBP00209 | American ginseng_1 | *Legionella hackeliae* |
| SBP00209 | American ginseng_1 | *Legionella hackeliae* |
| SBP00209 | American ginseng_1 | *Legionella israelensis* |
| SBP00209 | American ginseng_1 | *Legionella israelensis* |
| SBP00209 | American ginseng_1 | *Legionella lansingensis* |
| SBP00209 | American ginseng_1 | *Legionella lansingensis* |
| SBP00209 | American ginseng_1 | *Legionella longbeachae* |
| SBP00209 | American ginseng_1 | *Legionella longbeachae* |
| SBP00209 | American ginseng_1 | *Legionella pneumophila* |
| SBP00209 | American ginseng_1 | *Legionella pneumophila* |
| SBP00209 | American ginseng_1 | *Legionella sainthelensi* |
| SBP00209 | American ginseng_1 | *Legionella sainthelensi* |
| SBP00209 | American ginseng_1 | *Legionella waltersii* |
| SBP00209 | American ginseng_1 | *Legionella waltersii* |
| SBP00209 | American ginseng_1 | *Leifsonia* sp. 21MFCrub1.1 |
| SBP00209 | American ginseng_1 | *Leifsonia* sp. 21MFCrub1.1 |
| SBP00209 | American ginseng_1 | *Leifsonia xyli* |
| SBP00209 | American ginseng_1 | *Leifsonia xyli* |
| SBP00209 | American ginseng_1 | *Leisingera aquaemixtae* |
| SBP00209 | American ginseng_1 | *Leisingera aquaemixtae* |
| SBP00209 | American ginseng_1 | *Leisingera methylohalidivorans* |
| SBP00209 | American ginseng_1 | *Leisingera methylohalidivorans* |
| SBP00209 | American ginseng_1 | *Lelliottia amnigena* |
| SBP00209 | American ginseng_1 | *Lelliottia amnigena* |
| SBP00209 | American ginseng_1 | *Lelliottia jeotgali* |
| SBP00209 | American ginseng_1 | *Lelliottia jeotgali* |
| SBP00209 | American ginseng_1 | *Lelliottia nimipressuralis* |
| SBP00209 | American ginseng_1 | *Lelliottia nimipressuralis* |
| SBP00209 | American ginseng_1 | *Lelliottia* sp. WB101 |
| SBP00209 | American ginseng_1 | *Lelliottia* sp. WB101 |
| SBP00209 | American ginseng_1 | *Lentibacillus amyloliquefaciens* |
| SBP00209 | American ginseng_1 | *Lentibacillus amyloliquefaciens* |
| SBP00209 | American ginseng_1 | *Lentzea guizhouensis* |
| SBP00209 | American ginseng_1 | *Lentzea guizhouensis* |
| SBP00209 | American ginseng_1 | *Leptolyngbya* sp. O-77 |
| SBP00209 | American ginseng_1 | *Leptolyngbya* sp. O-77 |
| SBP00209 | American ginseng_1 | *Leptospira biflexa* |
| SBP00209 | American ginseng_1 | *Leptospira biflexa* |
| SBP00209 | American ginseng_1 | *Leptospira interrogans* |
| SBP00209 | American ginseng_1 | *Leptospira interrogans* |
| SBP00209 | American ginseng_1 | *Leptospira kmetyi* |
| SBP00209 | American ginseng_1 | *Leptospira kmetyi* |
| SBP00209 | American ginseng_1 | *Leptospira mayottensis* |
| SBP00209 | American ginseng_1 | *Leptospira mayottensis* |
| SBP00209 | American ginseng_1 | *Leptospira santarosai* |
| SBP00209 | American ginseng_1 | *Leptospira santarosai* |
| SBP00209 | American ginseng_1 | *Leptothrix cholodnii* |
| SBP00209 | American ginseng_1 | *Leptothrix cholodnii* |
| SBP00209 | American ginseng_1 | *Leptotrichia* sp. oral taxon 212 |

TABLE 3-continued

List of species identified in each metagenomic sample of each SBP Sample

| SBP ID | SBP Host Common Name | Genus sp. |
|---|---|---|
| SBP00209 | American ginseng_1 | *Leptotrichia* sp. oral taxon 212 |
| SBP00209 | American ginseng_1 | *Leucobacter* sp. DSM 101948 |
| SBP00209 | American ginseng_1 | *Leucobacter* sp. DSM 101948 |
| SBP00209 | American ginseng_1 | *Leucobacter triazinivorans* |
| SBP00209 | American ginseng_1 | *Leucobacter triazinivorans* |
| SBP00209 | American ginseng_1 | *Leuconostoc kimchii* |
| SBP00209 | American ginseng_1 | *Leuconostoc kimchii* |
| SBP00209 | American ginseng_1 | *Libanicoccus massiliensis* |
| SBP00209 | American ginseng_1 | *Libanicoccus massiliensis* |
| SBP00209 | American ginseng_1 | *Limnochorda pilosa* |
| SBP00209 | American ginseng_1 | *Limnochorda pilosa* |
| SBP00209 | American ginseng_1 | *Limnohabitans* sp. 103DPR2 |
| SBP00209 | American ginseng_1 | *Limnohabitans* sp. 103DPR2 |
| SBP00209 | American ginseng_1 | *Limnohabitans* sp. 63ED37-2 |
| SBP00209 | American ginseng_1 | *Limnohabitans* sp. 63ED37-2 |
| SBP00209 | American ginseng_1 | *Listeria ivanovii* |
| SBP00209 | American ginseng_1 | *Listeria ivanovii* |
| SBP00209 | American ginseng_1 | *Litorilituus sediminis* |
| SBP00209 | American ginseng_1 | *Litorilituus sediminis* |
| SBP00209 | American ginseng_1 | *Luteibacter rhizovicinus* |
| SBP00209 | American ginseng_1 | *Luteibacter rhizovicinus* |
| SBP00209 | American ginseng_1 | *Luteimonas* sp. 100111 |
| SBP00209 | American ginseng_1 | *Luteimonas* sp. 100111 |
| SBP00209 | American ginseng_1 | *Luteimonas* sp. 83-4 |
| SBP00209 | American ginseng_1 | *Luteimonas* sp. 83-4 |
| SBP00209 | American ginseng_1 | *Luteimonas* sp. JM171 |
| SBP00209 | American ginseng_1 | *Luteimonas* sp. JM171 |
| SBP00209 | American ginseng_1 | *Luteipulveratus mongoliensis* |
| SBP00209 | American ginseng_1 | *Luteipulveratus mongoliensis* |
| SBP00209 | American ginseng_1 | *Luteitalea pratensis* |
| SBP00209 | American ginseng_1 | *Luteitalea pratensis* |
| SBP00209 | American ginseng_1 | *Lutibacter profundi* |
| SBP00209 | American ginseng_1 | *Lutibacter profundi* |
| SBP00209 | American ginseng_1 | *Lutibacter* sp. LPB0138 |
| SBP00209 | American ginseng_1 | *Lutibacter* sp. LPB0138 |
| SBP00209 | American ginseng_1 | *Lysinibacillus* sp. 2017 |
| SBP00209 | American ginseng_1 | *Lysinibacillus* sp. 2017 |
| SBP00209 | American ginseng_1 | *Lysinibacillus* sp. Marseille-P5727 |
| SBP00209 | American ginseng_1 | *Lysinibacillus* sp. Marseille-P5727 |
| SBP00209 | American ginseng_1 | *Lysinibacillus* sp. SGAir0095 |
| SBP00209 | American ginseng_1 | *Lysinibacillus* sp. SGAir0095 |
| SBP00209 | American ginseng_1 | *Lysinibacillus* sp. YS11 |
| SBP00209 | American ginseng_1 | *Lysinibacillus* sp. YS11 |
| SBP00209 | American ginseng_1 | *Lysinibacillus sphaericus* |
| SBP00209 | American ginseng_1 | *Lysinibacillus sphaericus* |
| SBP00209 | American ginseng_1 | *Lysinimonas* sp. 2DFWR-13 |
| SBP00209 | American ginseng_1 | *Lysinimonas* sp. 2DFWR-13 |
| SBP00209 | American ginseng_1 | *Lysobacter antibioticus* |
| SBP00209 | American ginseng_1 | *Lysobacter antibioticus* |
| SBP00209 | American ginseng_1 | *Lysobacter capsici* |
| SBP00209 | American ginseng_1 | *Lysobacter capsici* |
| SBP00209 | American ginseng_1 | *Lysobacter enzymogenes* |
| SBP00209 | American ginseng_1 | *Lysobacter enzymogenes* |
| SBP00209 | American ginseng_1 | *Lysobacter gummosus* |
| SBP00209 | American ginseng_1 | *Lysobacter gummosus* |
| SBP00209 | American ginseng_1 | *Lysobacter maris* |
| SBP00209 | American ginseng_1 | *Lysobacter maris* |
| SBP00209 | American ginseng_1 | *Lysobacter* sp. TY2-98 |
| SBP00209 | American ginseng_1 | *Lysobacter* sp. TY2-98 |
| SBP00209 | American ginseng_1 | *Macrococcus canis* |
| SBP00209 | American ginseng_1 | *Macrococcus canis* |
| SBP00209 | American ginseng_1 | *Macrococcus* sp. IME1552 |
| SBP00209 | American ginseng_1 | *Macrococcus* sp. IME1552 |
| SBP00209 | American ginseng_1 | *Magnetospira* sp. QH-2 |
| SBP00209 | American ginseng_1 | *Magnetospira* sp. QH-2 |
| SBP00209 | American ginseng_1 | *Magnetospirillum gryphiswaldense* |
| SBP00209 | American ginseng_1 | *Magnetospirillum gryphiswaldense* |
| SBP00209 | American ginseng_1 | *Magnetospirillum magneticum* |
| SBP00209 | American ginseng_1 | *Magnetospirillum magneticum* |
| SBP00209 | American ginseng_1 | *Magnetospirillum* sp. ME-1 |
| SBP00209 | American ginseng_1 | *Magnetospirillum* sp. ME-1 |
| SBP00209 | American ginseng_1 | *Magnetospirillum* sp. XM-1 |
| SBP00209 | American ginseng_1 | *Magnetospirillum* sp. XM-1 |
| SBP00209 | American ginseng_1 | *Mannheimia varigena* |
| SBP00209 | American ginseng_1 | *Mannheimia varigena* |
| SBP00209 | American ginseng_1 | *Maribacter cobaltidurans* |

TABLE 3-continued

List of species identified in each metagenomic sample of each SBP Sample

| SBP ID | SBP Host Common Name | Genus sp. |
|---|---|---|
| SBP00209 | American ginseng_1 | *Maribacter cobaltidurans* |
| SBP00209 | American ginseng_1 | *Maribacter* sp. HTCC2170 |
| SBP00209 | American ginseng_1 | *Maribacter* sp. HTCC2170 |
| SBP00209 | American ginseng_1 | *Maribacter* sp. MJ134 |
| SBP00209 | American ginseng_1 | *Maribacter* sp. MJ134 |
| SBP00209 | American ginseng_1 | *Maribacter* sp. T28 |
| SBP00209 | American ginseng_1 | *Maribacter* sp. T28 |
| SBP00209 | American ginseng_1 | *Maricaulis maris* |
| SBP00209 | American ginseng_1 | *Maricaulis maris* |
| SBP00209 | American ginseng_1 | *Marichromatium purpuratum* |
| SBP00209 | American ginseng_1 | *Marichromatium purpuratum* |
| SBP00209 | American ginseng_1 | *Marinifilaceae bacterium* SPP2 |
| SBP00209 | American ginseng_1 | *Marinifilaceae bacterium* SPP2 |
| SBP00209 | American ginseng_1 | *Marinilactibacillus* sp. 15R |
| SBP00209 | American ginseng_1 | *Marinilactibacillus* sp. 15R |
| SBP00209 | American ginseng_1 | *Marinobacter hydrocarbonoclasticus* |
| SBP00209 | American ginseng_1 | *Marinobacter hydrocarbonoclasticus* |
| SBP00209 | American ginseng_1 | *Marinobacter salinus* |
| SBP00209 | American ginseng_1 | *Marinobacter salinus* |
| SBP00209 | American ginseng_1 | *Marinobacter similis* |
| SBP00209 | American ginseng_1 | *Marinobacter similis* |
| SBP00209 | American ginseng_1 | *Marinobacter* sp. CP1 |
| SBP00209 | American ginseng_1 | *Marinobacter* sp. CP1 |
| SBP00209 | American ginseng_1 | *Marinobacter* sp. LQ44 |
| SBP00209 | American ginseng_1 | *Marinobacter* sp. LQ44 |
| SBP00209 | American ginseng_1 | *Marinobacter* sp. LV10RS10-11A |
| SBP00209 | American ginseng_1 | *Marinobacter* sp. LV10RS10-11A |
| SBP00209 | American ginseng_1 | *Marinobacter* sp. NP-4(2019) |
| SBP00209 | American ginseng_1 | *Marinobacter* sp. NP-4(2019) |
| SBP00209 | American ginseng_1 | *Marinobacterium aestuarii* |
| SBP00209 | American ginseng_1 | *Marinobacterium aestuarii* |
| SBP00209 | American ginseng_1 | *Marinomonas mediterranea* |
| SBP00209 | American ginseng_1 | *Marinomonas mediterranea* |
| SBP00209 | American ginseng_1 | *Marinomonas posidonica* |
| SBP00209 | American ginseng_1 | *Marinomonas posidonica* |
| SBP00209 | American ginseng_1 | *Marinomonas primoryensis* |
| SBP00209 | American ginseng_1 | *Marinomonas primoryensis* |
| SBP00209 | American ginseng_1 | *Marinomonas* sp. MWYL1 |
| SBP00209 | American ginseng_1 | *Marinomonas* sp. MWYL1 |
| SBP00209 | American ginseng_1 | *Marinovum algicola* |
| SBP00209 | American ginseng_1 | *Marinovum algicola* |
| SBP00209 | American ginseng_1 | *Mariprofundus ferrinatatus* |
| SBP00209 | American ginseng_1 | *Mariprofundus ferrinatatus* |
| SBP00209 | American ginseng_1 | *Marivirga tractuosa* |
| SBP00209 | American ginseng_1 | *Marivirga tractuosa* |
| SBP00209 | American ginseng_1 | *Marmoricola scoriae* |
| SBP00209 | American ginseng_1 | *Marmoricola scoriae* |
| SBP00209 | American ginseng_1 | *Martelella endophytica* |
| SBP00209 | American ginseng_1 | *Martelella endophytica* |
| SBP00209 | American ginseng_1 | *Martelella mediterranea* |
| SBP00209 | American ginseng_1 | *Martelella mediterranea* |
| SBP00209 | American ginseng_1 | *Martelella* sp. AD-3 |
| SBP00209 | American ginseng_1 | *Martelella* sp. AD-3 |
| SBP00209 | American ginseng_1 | *Massilia albidiflava* |
| SBP00209 | American ginseng_1 | *Massilia albidiflava* |
| SBP00209 | American ginseng_1 | *Massilia armeniaca* |
| SBP00209 | American ginseng_1 | *Massilia armeniaca* |
| SBP00209 | American ginseng_1 | *Massilia lutea* |
| SBP00209 | American ginseng_1 | *Massilia lutea* |
| SBP00209 | American ginseng_1 | *Massilia oculi* |
| SBP00209 | American ginseng_1 | *Massilia oculi* |
| SBP00209 | American ginseng_1 | *Massilia plicata* |
| SBP00209 | American ginseng_1 | *Massilia plicata* |
| SBP00209 | American ginseng_1 | *Massilia putida* |
| SBP00209 | American ginseng_1 | *Massilia putida* |
| SBP00209 | American ginseng_1 | *Massilia* sp. NR 4-1 |
| SBP00209 | American ginseng_1 | *Massilia* sp. NR 4-1 |
| SBP00209 | American ginseng_1 | *Massilia* sp. WG5 |
| SBP00209 | American ginseng_1 | *Massilia* sp. WG5 |
| SBP00209 | American ginseng_1 | *Massilia* sp. YMA4 |
| SBP00209 | American ginseng_1 | *Massilia* sp. YMA4 |
| SBP00209 | American ginseng_1 | *Massilia umbonata* |
| SBP00209 | American ginseng_1 | *Massilia umbonata* |
| SBP00209 | American ginseng_1 | *Massilia violaceinigra* |
| SBP00209 | American ginseng_1 | *Massilia violaceinigra* |
| SBP00209 | American ginseng_1 | *Megamonas hypermegale* |

TABLE 3-continued

List of species identified in each metagenomic sample of each SBP Sample

| SBP ID | SBP Host Common Name | Genus sp. |
|---|---|---|
| SBP00209 | American ginseng_1 | *Megamonas hypermegale* |
| SBP00209 | American ginseng_1 | *Megasphaera elsdenii* |
| SBP00209 | American ginseng_1 | *Megasphaera elsdenii* |
| SBP00209 | American ginseng_1 | *Megasphaera hexanoica* |
| SBP00209 | American ginseng_1 | *Megasphaera hexanoica* |
| SBP00209 | American ginseng_1 | *Megavirus chiliensis* |
| SBP00209 | American ginseng_1 | *Megavirus chiliensis* |
| SBP00209 | American ginseng_1 | *Melaminivora* sp. SC2-7 |
| SBP00209 | American ginseng_1 | *Melaminivora* sp. SC2-7 |
| SBP00209 | American ginseng_1 | *Melaminivora* sp. SC2-9 |
| SBP00209 | American ginseng_1 | *Melaminivora* sp. SC2-9 |
| SBP00209 | American ginseng_1 | *Melittangium boletus* |
| SBP00209 | American ginseng_1 | *Melittangium boletus* |
| SBP00209 | American ginseng_1 | *Mesoplasma coleopterae* |
| SBP00209 | American ginseng_1 | *Mesoplasma coleopterae* |
| SBP00209 | American ginseng_1 | *Mesoplasma florum* |
| SBP00209 | American ginseng_1 | *Mesoplasma florum* |
| SBP00209 | American ginseng_1 | *Mesorhizobium amorphae* |
| SBP00209 | American ginseng_1 | *Mesorhizobium amorphae* |
| SBP00209 | American ginseng_1 | *Mesorhizobium australicum* |
| SBP00209 | American ginseng_1 | *Mesorhizobium australicum* |
| SBP00209 | American ginseng_1 | *Mesorhizobium ciceri* |
| SBP00209 | American ginseng_1 | *Mesorhizobium ciceri* |
| SBP00209 | American ginseng_1 | *Mesorhizobium huakuii* |
| SBP00209 | American ginseng_1 | *Mesorhizobium huakuii* |
| SBP00209 | American ginseng_1 | *Mesorhizobium japonicum* |
| SBP00209 | American ginseng_1 | *Mesorhizobium japonicum* |
| SBP00209 | American ginseng_1 | *Mesorhizobium loti* |
| SBP00209 | American ginseng_1 | *Mesorhizobium loti* |
| SBP00209 | American ginseng_1 | *Mesorhizobium oceanicum* |
| SBP00209 | American ginseng_1 | *Mesorhizobium oceanicum* |
| SBP00209 | American ginseng_1 | *Mesorhizobium opportunistum* |
| SBP00209 | American ginseng_1 | *Mesorhizobium opportunistum* |
| SBP00209 | American ginseng_1 | *Mesorhizobium* sp. DCY119 |
| SBP00209 | American ginseng_1 | *Mesorhizobium* sp. DCY119 |
| SBP00209 | American ginseng_1 | *Mesorhizobium* sp. M1B.F.Ca.ET.045.04.1.1 |
| SBP00209 | American ginseng_1 | *Mesorhizobium* sp. M1B.F.Ca.ET.045.04.1.1 |
| SBP00209 | American ginseng_1 | *Mesorhizobium* sp. M1D.F.Ca.ET.043.01.1.1 |
| SBP00209 | American ginseng_1 | *Mesorhizobium* sp. M1D.F.Ca.ET.043.01.1.1 |
| SBP00209 | American ginseng_1 | *Mesorhizobium* sp. M1E.F.Ca.ET.045.02.1.1 |
| SBP00209 | American ginseng_1 | *Mesorhizobium* sp. M1E.F.Ca.ET.045.02.1.1 |
| SBP00209 | American ginseng_1 | *Mesorhizobium* sp. M2A.F.Ca.ET.043.02.1.1 |
| SBP00209 | American ginseng_1 | *Mesorhizobium* sp. M2A.F.Ca.ET.043.02.1.1 |
| SBP00209 | American ginseng_1 | *Mesorhizobium* sp. M2A.F.Ca.ET.043.05.1.1 |
| SBP00209 | American ginseng_1 | *Mesorhizobium* sp. M2A.F.Ca.ET.043.05.1.1 |
| SBP00209 | American ginseng_1 | *Mesorhizobium* sp. M2A.F.Ca.ET.046.03.2.1 |
| SBP00209 | American ginseng_1 | *Mesorhizobium* sp. M2A.F.Ca.ET.046.03.2.1 |
| SBP00209 | American ginseng_1 | *Mesorhizobium* sp. M3A.F.Ca.ET.080.04.2.1 |
| SBP00209 | American ginseng_1 | *Mesorhizobium* sp. M3A.F.Ca.ET.080.04.2.1 |
| SBP00209 | American ginseng_1 | *Mesorhizobium* sp. M4B.F.Ca.ET.058.02.1.1 |
| SBP00209 | American ginseng_1 | *Mesorhizobium* sp. M4B.F.Ca.ET.058.02.1.1 |
| SBP00209 | American ginseng_1 | *Mesorhizobium* sp. M6A.T.Cr.TU.016.01.1.1 |
| SBP00209 | American ginseng_1 | *Mesorhizobium* sp. M6A.T.Cr.TU.016.01.1.1 |
| SBP00209 | American ginseng_1 | *Mesorhizobium* sp. M7A.F.Ce.TU.012.03.2.1 |
| SBP00209 | American ginseng_1 | *Mesorhizobium* sp. M7A.F.Ce,TU.012.03.2.1 |
| SBP00209 | American ginseng_1 | *Mesorhizobium* sp. M7D.F.Ca.US.005.01.1.1 |
| SBP00209 | American ginseng_1 | *Mesorhizobium* sp. M7D.F.Ca.US.005.01.1.1 |
| SBP00209 | American ginseng_1 | *Mesorhizobium* sp. M9A.F.Ca.ET.002.03.1.2 |
| SBP00209 | American ginseng_1 | *Mesorhizobium* sp. M9A.F.Ca.ET.002.03.1.2 |
| SBP00209 | American ginseng_1 | *Mesorhizobium* sp. WSM1497 |
| SBP00209 | American ginseng_1 | *Mesorhizobium* sp. WSM1497 |
| SBP00209 | American ginseng_1 | *Mesotoga prima* |
| SBP00209 | American ginseng_1 | *Mesotoga prima* |
| SBP00209 | American ginseng_1 | *Metallosphaera hakonensis* |
| SBP00209 | American ginseng_1 | *Metallosphaera hakonensis* |
| SBP00209 | American ginseng_1 | *Metallosphaera sedula* |
| SBP00209 | American ginseng_1 | *Metallosphaera sedula* |
| SBP00209 | American ginseng_1 | *Methanobacterium* sp. MB1 |
| SBP00209 | American ginseng_1 | *Methanobacterium* sp. MB1 |
| SBP00209 | American ginseng_1 | *Methanobrevibacter olleyae* |
| SBP00209 | American ginseng_1 | *Methanobrevibacter olleyae* |
| SBP00209 | American ginseng_1 | *Methanobrevibacter* sp. YE315 |
| SBP00209 | American ginseng_1 | *Methanobrevibacter* sp. YE315 |
| SBP00209 | American ginseng_1 | *Methanocaldococcus fervens* |
| SBP00209 | American ginseng_1 | *Methanocaldococcus fervens* |
| SBP00209 | American ginseng_1 | *Methanocella arvoryzae* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Methanocella arvoryzae* |
| SBP00209 | American ginseng_1 | *Methanocella paludicola* |
| SBP00209 | American ginseng_1 | *Methanocella paludicola* |
| SBP00209 | American ginseng_1 | *Methanococcus maripaludis* |
| SBP00209 | American ginseng_1 | *Methanococcus maripaludis* |
| SBP00209 | American ginseng_1 | *Methanococcus voltae* |
| SBP00209 | American ginseng_1 | *Methanococcus voltae* |
| SBP00209 | American ginseng_1 | *Methanocorpusculum labreanum* |
| SBP00209 | American ginseng_1 | *Methanocorpusculum labreanum* |
| SBP00209 | American ginseng_1 | *Methanoculleus bourgensis* |
| SBP00209 | American ginseng_1 | *Methanoculleus bourgensis* |
| SBP00209 | American ginseng_1 | *Methanoculleus marisnigri* |
| SBP00209 | American ginseng_1 | *Methanoculleus marisnigri* |
| SBP00209 | American ginseng_1 | *Methanohalophilus portucalensis* |
| SBP00209 | American ginseng_1 | *Methanohalophilus portucalensis* |
| SBP00209 | American ginseng_1 | *Methanolacinia petrolearia* |
| SBP00209 | American ginseng_1 | *Methanolacinia petrolearia* |
| SBP00209 | American ginseng_1 | *Methanomethylovorans hollandica* |
| SBP00209 | American ginseng_1 | *Methanomethylovorans hollandica* |
| SBP00209 | American ginseng_1 | *Methanoplanus limicola* |
| SBP00209 | American ginseng_1 | *Methanoplanus limicola* |
| SBP00209 | American ginseng_1 | *Methanosarcina barkeri* |
| SBP00209 | American ginseng_1 | *Methanosarcina barkeri* |
| SBP00209 | American ginseng_1 | *Methanosarcina horonobensis* |
| SBP00209 | American ginseng_1 | *Methanosarcina horonobensis* |
| SBP00209 | American ginseng_1 | *Methanosarcina lacustris* |
| SBP00209 | American ginseng_1 | *Methanosarcina lacustris* |
| SBP00209 | American ginseng_1 | *Methanosarcina mazei* |
| SBP00209 | American ginseng_1 | *Methanosarcina mazei* |
| SBP00209 | American ginseng_1 | *Methanosarcina siciliae* |
| SBP00209 | American ginseng_1 | *Methanosarcina siciliae* |
| SBP00209 | American ginseng_1 | *Methanosarcina thermophila* |
| SBP00209 | American ginseng_1 | *Methanosarcina thermophila* |
| SBP00209 | American ginseng_1 | *Methanothermobacter thermautotrophicus* |
| SBP00209 | American ginseng_1 | *Methanothermobacter thermautotrophicus* |
| SBP00209 | American ginseng_1 | *Methanothrix soehngenii* |
| SBP00209 | American ginseng_1 | *Methanothrix soehngenii* |
| SBP00209 | American ginseng_1 | *Methanotorris igneus* |
| SBP00209 | American ginseng_1 | *Methanotorris igneus* |
| SBP00209 | American ginseng_1 | *Methylacidiphilum fumariolicum* |
| SBP00209 | American ginseng_1 | *Methylacidiphilum fumariolicum* |
| SBP00209 | American ginseng_1 | *Methylacidiphilum infernorum* |
| SBP00209 | American ginseng_1 | *Methylacidiphilum infernorum* |
| SBP00209 | American ginseng_1 | *Methylibium petroleiphilum* |
| SBP00209 | American ginseng_1 | *Methylibium petroleiphilum* |
| SBP00209 | American ginseng_1 | *Methylobacillus flagellatus* |
| SBP00209 | American ginseng_1 | *Methylobacillus flagellatus* |
| SBP00209 | American ginseng_1 | *Methylobacterium aquaticum* |
| SBP00209 | American ginseng_1 | *Methylobacterium aquaticum* |
| SBP00209 | American ginseng_1 | *Methylobacterium brachiatum* |
| SBP00209 | American ginseng_1 | *Methylobacterium brachiatum* |
| SBP00209 | American ginseng_1 | *Methylobacterium currus* |
| SBP00209 | American ginseng_1 | *Methylobacterium currus* |
| SBP00209 | American ginseng_1 | *Methylobacterium nodulans* |
| SBP00209 | American ginseng_1 | *Methylobacterium nodulans* |
| SBP00209 | American ginseng_1 | *Methylobacterium phyllosphaerae* |
| SBP00209 | American ginseng_1 | *Methylobacterium phyllosphaerae* |
| SBP00209 | American ginseng_1 | *Methylobacterium radiotolerans* |
| SBP00209 | American ginseng_1 | *Methylobacterium radiotolerans* |
| SBP00209 | American ginseng_1 | *Methylobacterium* sp. 17SD2-17 |
| SBP00209 | American ginseng_1 | *Methylobacterium* sp. 17SD2-17 |
| SBP00209 | American ginseng_1 | *Methylobacterium* sp. 17Sr1-1 |
| SBP00209 | American ginseng_1 | *Methylobacterium* sp. 17Sr1-1 |
| SBP00209 | American ginseng_1 | *Methylobacterium* sp. 17Sr1-28 |
| SBP00209 | American ginseng_1 | *Methylobacterium* sp. 17Sr1-28 |
| SBP00209 | American ginseng_1 | *Methylobacterium* sp. 17Sr1-43 |
| SBP00209 | American ginseng_1 | *Methylobacterium* sp. 17Sr1-43 |
| SBP00209 | American ginseng_1 | *Methylobacterium* sp. 4-46 |
| SBP00209 | American ginseng_1 | *Methylobacterium* sp. 4-46 |
| SBP00209 | American ginseng_1 | *Methylobacterium* sp. AMS5 |
| SBP00209 | American ginseng_1 | *Methylobacterium* sp. AMS5 |
| SBP00209 | American ginseng_1 | *Methylobacterium* sp. C1 |
| SBP00209 | American ginseng_1 | *Methylobacterium* sp. C1 |
| SBP00209 | American ginseng_1 | *Methylobacterium* sp. DM1 |
| SBP00209 | American ginseng_1 | *Methylobacterium* sp. DM1 |
| SBP00209 | American ginseng_1 | *Methyloceanibacter caenitepidi* |

TABLE 3-continued

List of species identified in each metagenomic sample of each SBP Sample

| SBP ID | SBP Host Common Name | Genus sp. |
|---|---|---|
| SBP00209 | American ginseng_1 | *Methyloceanibacter caenitepidi* |
| SBP00209 | American ginseng_1 | *Methyloceanibacter* sp. wino2 |
| SBP00209 | American ginseng_1 | *Methyloceanibacter* sp. wino2 |
| SBP00209 | American ginseng_1 | *Methylocella silvestris* |
| SBP00209 | American ginseng_1 | *Methylocella silvestris* |
| SBP00209 | American ginseng_1 | *Methylocella tundrae* |
| SBP00209 | American ginseng_1 | *Methylocella tundrae* |
| SBP00209 | American ginseng_1 | *Methylococcus capsulatus* |
| SBP00209 | American ginseng_1 | *Methylococcus capsulatus* |
| SBP00209 | American ginseng_1 | *Methylocystis bryophila* |
| SBP00209 | American ginseng_1 | *Methylocystis bryophila* |
| SBP00209 | American ginseng_1 | *Methylocystis rosea* |
| SBP00209 | American ginseng_1 | *Methylocystis rosea* |
| SBP00209 | American ginseng_1 | *Methylocystis* sp. SC2 |
| SBP00209 | American ginseng_1 | *Methylocystis* sp. SC2 |
| SBP00209 | American ginseng_1 | *Methylomicrobium album* |
| SBP00209 | American ginseng_1 | *Methylomicrobium album* |
| SBP00209 | American ginseng_1 | *Methylomicrobium buryatense* |
| SBP00209 | American ginseng_1 | *Methylomicrobium buryatense* |
| SBP00209 | American ginseng_1 | *Methylomicrobium* sp. wino1 |
| SBP00209 | American ginseng_1 | *Methylomicrobium* sp. wino1 |
| SBP00209 | American ginseng_1 | *Methylomonas denitrificans* |
| SBP00209 | American ginseng_1 | *Methylomonas denitrificans* |
| SBP00209 | American ginseng_1 | *Methylomonas koyamae* |
| SBP00209 | American ginseng_1 | *Methylomonas koyamae* |
| SBP00209 | American ginseng_1 | *Methylomonas* sp. LW13 |
| SBP00209 | American ginseng_1 | *Methylomonas* sp. LW13 |
| SBP00209 | American ginseng_1 | *Methylorubrum extorquens* |
| SBP00209 | American ginseng_1 | *Methylorubrum extorquens* |
| SBP00209 | American ginseng_1 | *Methylorubrum populi* |
| SBP00209 | American ginseng_1 | *Methylorubrum populi* |
| SBP00209 | American ginseng_1 | *Methylosinus trichosporium* |
| SBP00209 | American ginseng_1 | *Methylosinus trichosporium* |
| SBP00209 | American ginseng_1 | *Methyloversatilis* sp. RAC08 |
| SBP00209 | American ginseng_1 | *Methyloversatilis* sp. RAC08 |
| SBP00209 | American ginseng_1 | *Methylovirgula ligni* |
| SBP00209 | American ginseng_1 | *Methylovirgula ligni* |
| SBP00209 | American ginseng_1 | *Methylovorus glucosotrophus* |
| SBP00209 | American ginseng_1 | *Methylovorus glucosotrophus* |
| SBP00209 | American ginseng_1 | *Micavibrio aeruginosavorus* |
| SBP00209 | American ginseng_1 | *Micavibrio aeruginosavorus* |
| SBP00209 | American ginseng_1 | *Microbacterium aurum* |
| SBP00209 | American ginseng_1 | *Microbacterium aurum* |
| SBP00209 | American ginseng_1 | *Microbacterium chocolatum* |
| SBP00209 | American ginseng_1 | *Microbacterium chocolatum* |
| SBP00209 | American ginseng_1 | *Microbacterium foliorum* |
| SBP00209 | American ginseng_1 | *Microbacterium foliorum* |
| SBP00209 | American ginseng_1 | *Microbacterium hominis* |
| SBP00209 | American ginseng_1 | *Microbacterium hominis* |
| SBP00209 | American ginseng_1 | *Microbacterium lemovicicum* |
| SBP00209 | American ginseng_1 | *Microbacterium lemovicicum* |
| SBP00209 | American ginseng_1 | *Microbacterium oleivorans* |
| SBP00209 | American ginseng_1 | *Microbacterium oleivorans* |
| SBP00209 | American ginseng_1 | *Microbacterium oxydans* |
| SBP00209 | American ginseng_1 | *Microbacterium oxydans* |
| SBP00209 | American ginseng_1 | *Microbacterium paludicola* |
| SBP00209 | American ginseng_1 | *Microbacterium paludicola* |
| SBP00209 | American ginseng_1 | *Microbacterium paraoxydans* |
| SBP00209 | American ginseng_1 | *Microbacterium paraoxydans* |
| SBP00209 | American ginseng_1 | *Microbacterium pygmaeum* |
| SBP00209 | American ginseng_1 | *Microbacterium pygmaeum* |
| SBP00209 | American ginseng_1 | *Microbacterium sediminis* |
| SBP00209 | American ginseng_1 | *Microbacterium sediminis* |
| SBP00209 | American ginseng_1 | *Microbacterium* sp. 1.5R |
| SBP00209 | American ginseng_1 | *Microbacterium* sp. 1.5R |
| SBP00209 | American ginseng_1 | *Microbacterium* sp. 10M-3C3 |
| SBP00209 | American ginseng_1 | *Microbacterium* sp. 10M-3C3 |
| SBP00209 | American ginseng_1 | *Microbacterium* sp. ABRD_28 |
| SBP00209 | American ginseng_1 | *Microbacterium* sp. ABRD_28 |
| SBP00209 | American ginseng_1 | *Microbacterium* sp. BH-3-3-3 |
| SBP00209 | American ginseng_1 | *Microbacterium* sp. BH-3-3-3 |
| SBP00209 | American ginseng_1 | *Microbacterium* sp. CGR1 |
| SBP00209 | American ginseng_1 | *Microbacterium* sp. CGR1 |
| SBP00209 | American ginseng_1 | *Microbacterium* sp. LKL04 |
| SBP00209 | American ginseng_1 | *Microbacterium* sp. LKL04 |
| SBP00209 | American ginseng_1 | *Microbacterium* sp. No. 7 |

TABLE 3-continued

List of species identified in each metagenomic sample of each SBP Sample

| SBP ID | SBP Host Common Name | Genus sp. |
|---|---|---|
| SBP00209 | American ginseng_1 | *Microbacterium* sp. No. 7 |
| SBP00209 | American ginseng_1 | *Microbacterium* sp. PAMC 28756 |
| SBP00209 | American ginseng_1 | *Microbacterium* sp. PAMC 28756 |
| SBP00209 | American ginseng_1 | *Microbacterium* sp. PM5 |
| SBP00209 | American ginseng_1 | *Microbacterium* sp. PM5 |
| SBP00209 | American ginseng_1 | *Microbacterium* sp. SGAir0570 |
| SBP00209 | American ginseng_1 | *Microbacterium* sp. SGAir0570 |
| SBP00209 | American ginseng_1 | *Microbacterium* sp. str. 'China' |
| SBP00209 | American ginseng_1 | *Microbacterium* sp. str. 'China' |
| SBP00209 | American ginseng_1 | *Microbacterium* sp. TPU 3598 |
| SBP00209 | American ginseng_1 | *Microbacterium* sp. TPU 3598 |
| SBP00209 | American ginseng_1 | *Microbacterium* sp. XT11 |
| SBP00209 | American ginseng_1 | *Microbacterium* sp. XT11 |
| SBP00209 | American ginseng_1 | *Microbacterium* sp. Y-01 |
| SBP00209 | American ginseng_1 | *Microbacterium* sp. Y-01 |
| SBP00209 | American ginseng_1 | *Microbacterium testaceum* |
| SBP00209 | American ginseng_1 | *Microbacterium testaceum* |
| SBP00209 | American ginseng_1 | *Microbulbifer agarilyticus* |
| SBP00209 | American ginseng_1 | *Microbulbifer agarilyticus* |
| SBP00209 | American ginseng_1 | *Microbulbifer* sp. A4B17 |
| SBP00209 | American ginseng_1 | *Microbulbifer* sp. A4B17 |
| SBP00209 | American ginseng_1 | *Microbulbifer thermotolerans* |
| SBP00209 | American ginseng_1 | *Microbulbifer thermotolerans* |
| SBP00209 | American ginseng_1 | *Microcella alkaliphila* |
| SBP00209 | American ginseng_1 | *Microcella alkaliphila* |
| SBP00209 | American ginseng_1 | *Microchaete diplosiphon* |
| SBP00209 | American ginseng_1 | *Microchaete diplosiphon* |
| SBP00209 | American ginseng_1 | *Micrococcus luteus* |
| SBP00209 | American ginseng_1 | *Micrococcus luteus* |
| SBP00209 | American ginseng_1 | *Microcoleus* sp. PCC 7113 |
| SBP00209 | American ginseng_1 | *Microcoleus* sp. PCC 7113 |
| SBP00209 | American ginseng_1 | *Microcystis aeruginosa* |
| SBP00209 | American ginseng_1 | *Microcystis aeruginosa* |
| SBP00209 | American ginseng_1 | *Microcystis panniformis* |
| SBP00209 | American ginseng_1 | *Microcystis panniformis* |
| SBP00209 | American ginseng_1 | *Microlunatus phosphovorus* |
| SBP00209 | American ginseng_1 | *Microlunatus phosphovorus* |
| SBP00209 | American ginseng_1 | *Microlunatus soli* |
| SBP00209 | American ginseng_1 | *Microlunatus soli* |
| SBP00209 | American ginseng_1 | *Micromonospora aurantiaca* |
| SBP00209 | American ginseng_1 | *Micromonospora aurantiaca* |
| SBP00209 | American ginseng_1 | *Micromonospora auratinigra* |
| SBP00209 | American ginseng_1 | *Micromonospora auratinigra* |
| SBP00209 | American ginseng_1 | *Micromonospora chokoriensis* |
| SBP00209 | American ginseng_1 | *Micromonospora chokoriensis* |
| SBP00209 | American ginseng_1 | *Micromonospora coriariae* |
| SBP00209 | American ginseng_1 | *Micromonospora coriariae* |
| SBP00209 | American ginseng_1 | *Micromonospora coxensis* |
| SBP00209 | American ginseng_1 | *Micromonospora coxensis* |
| SBP00209 | American ginseng_1 | *Micromonospora echinaurantiaca* |
| SBP00209 | American ginseng_1 | *Micromonospora echinaurantiaca* |
| SBP00209 | American ginseng_1 | *Micromonospora echinofusca* |
| SBP00209 | American ginseng_1 | *Micromonospora echinofusca* |
| SBP00209 | American ginseng_1 | *Micromonospora echinospora* |
| SBP00209 | American ginseng_1 | *Micromonospora echinospora* |
| SBP00209 | American ginseng_1 | *Micromonospora inositola* |
| SBP00209 | American ginseng_1 | *Micromonospora inositola* |
| SBP00209 | American ginseng_1 | *Micromonospora krabiensis* |
| SBP00209 | American ginseng_1 | *Micromonospora krabiensis* |
| SBP00209 | American ginseng_1 | *Micromonospora narathiwatensis* |
| SBP00209 | American ginseng_1 | *Micromonospora narathiwatensis* |
| SBP00209 | American ginseng_1 | *Micromonospora purpureochromogenes* |
| SBP00209 | American ginseng_1 | *Micromonospora purpureochromogenes* |
| SBP00209 | American ginseng_1 | *Micromonospora rifamycinica* |
| SBP00209 | American ginseng_1 | *Micromonospora rifamycinica* |
| SBP00209 | American ginseng_1 | *Micromonospora siamensis* |
| SBP00209 | American ginseng_1 | *Micromonospora siamensis* |
| SBP00209 | American ginseng_1 | *Micromonospora* sp. B006 |
| SBP00209 | American ginseng_1 | *Micromonospora* sp. B006 |
| SBP00209 | American ginseng_1 | *Micromonospora* sp. WMMA2032 |
| SBP00209 | American ginseng_1 | *Micromonospora* sp. WMMA2032 |
| SBP00209 | American ginseng_1 | *Micromonospora tulbaghiae* |
| SBP00209 | American ginseng_1 | *Micromonospora tulbaghiae* |
| SBP00209 | American ginseng_1 | *Micromonospora viridifaciens* |
| SBP00209 | American ginseng_1 | *Micromonospora viridifaciens* |
| SBP00209 | American ginseng_1 | *Micromonospora zamorensis* |

TABLE 3-continued

List of species identified in each metagenomic sample of each SBP Sample

| SBP ID | SBP Host Common Name | Genus sp. |
|---|---|---|
| SBP00209 | American ginseng_1 | *Micromonospora zamorensis* |
| SBP00209 | American ginseng_1 | *Micropruina glycogenica* |
| SBP00209 | American ginseng_1 | *Micropruina glycogenica* |
| SBP00209 | American ginseng_1 | *Microterricola viridarii* |
| SBP00209 | American ginseng_1 | *Microterricola viridarii* |
| SBP00209 | American ginseng_1 | *Microvirga ossetica* |
| SBP00209 | American ginseng_1 | *Microvirga ossetica* |
| SBP00209 | American ginseng_1 | *Microvirga* sp. 17 mud 1-3 |
| SBP00209 | American ginseng_1 | *Microvirga* sp. 17 mud 1-3 |
| SBP00209 | American ginseng_1 | *Microvirgula aerodenitrificans* |
| SBP00209 | American ginseng_1 | *Microvirgula aerodenitrificans* |
| SBP00209 | American ginseng_1 | *Mimivirus* terra2 |
| SBP00209 | American ginseng_1 | *Mimivirus* terra2 |
| SBP00209 | American ginseng_1 | *Miniimonas* sp. S16 |
| SBP00209 | American ginseng_1 | *Miniimonas* sp. S16 |
| SBP00209 | American ginseng_1 | *Mitsuaria* sp. 7 |
| SBP00209 | American ginseng_1 | *Mitsuaria* sp. 7 |
| SBP00209 | American ginseng_1 | *Mixta gaviniae* |
| SBP00209 | American ginseng_1 | *Mixta gaviniae* |
| SBP00209 | American ginseng_1 | *Modestobacter marinus* |
| SBP00209 | American ginseng_1 | *Modestobacter marinus* |
| SBP00209 | American ginseng_1 | *Moorea producens* |
| SBP00209 | American ginseng_1 | *Moorea producens* |
| SBP00209 | American ginseng_1 | *Moraxella bovoculi* |
| SBP00209 | American ginseng_1 | *Moraxella bovoculi* |
| SBP00209 | American ginseng_1 | *Moraxella osloensis* |
| SBP00209 | American ginseng_1 | *Moraxella osloensis* |
| SBP00209 | American ginseng_1 | *Morganella morganii* |
| SBP00209 | American ginseng_1 | *Morganella morganii* |
| SBP00209 | American ginseng_1 | *Mucilaginibacter mallensis* |
| SBP00209 | American ginseng_1 | *Mucilaginibacter mallensis* |
| SBP00209 | American ginseng_1 | *Mucilaginibacter paludis* |
| SBP00209 | American ginseng_1 | *Mucilaginibacter paludis* |
| SBP00209 | American ginseng_1 | *Mucilaginibacter* sp. BJC16-A31 |
| SBP00209 | American ginseng_1 | *Mucilaginibacter* sp. BJC16-A31 |
| SBP00209 | American ginseng_1 | *Mucilaginibacter* sp. PAMC 26640 |
| SBP00209 | American ginseng_1 | *Mucilaginibacter* sp. PAMC 26640 |
| SBP00209 | American ginseng_1 | *Muribaculum intestinale* |
| SBP00209 | American ginseng_1 | *Muribaculum intestinale* |
| SBP00209 | American ginseng_1 | *Muricauda lutaonensis* |
| SBP00209 | American ginseng_1 | *Muricauda lutaonensis* |
| SBP00209 | American ginseng_1 | *Muricauda ruestringensis* |
| SBP00209 | American ginseng_1 | *Muricauda ruestringensis* |
| SBP00209 | American ginseng_1 | Murid betaherpesvirus 1 |
| SBP00209 | American ginseng_1 | Murid betaherpesvirus 1 |
| SBP00209 | American ginseng_1 | *Mycetocola* sp. 449 |
| SBP00209 | American ginseng_1 | *Mycetocola* sp. 449 |
| SBP00209 | American ginseng_1 | *Mycoavidus cysteinexigens* |
| SBP00209 | American ginseng_1 | *Mycoavidus cysteinexigens* |
| SBP00209 | American ginseng_1 | *Mycobacterium avium* |
| SBP00209 | American ginseng_1 | *Mycobacterium avium* |
| SBP00209 | American ginseng_1 | *Mycobacterium chimaera* |
| SBP00209 | American ginseng_1 | *Mycobacterium chimaera* |
| SBP00209 | American ginseng_1 | *Mycobacterium colombiense* |
| SBP00209 | American ginseng_1 | *Mycobacterium colombiense* |
| SBP00209 | American ginseng_1 | *Mycobacterium dioxanotrophicus* |
| SBP00209 | American ginseng_1 | *Mycobacterium dioxanotrophicus* |
| SBP00209 | American ginseng_1 | *Mycobacterium haemophilum* |
| SBP00209 | American ginseng_1 | *Mycobacterium haemophilum* |
| SBP00209 | American ginseng_1 | *Mycobacterium intracellulare* |
| SBP00209 | American ginseng_1 | *Mycobacterium intracellulare* |
| SBP00209 | American ginseng_1 | *Mycobacterium kansasii* |
| SBP00209 | American ginseng_1 | *Mycobacterium kansasii* |
| SBP00209 | American ginseng_1 | *Mycobacterium leprae* |
| SBP00209 | American ginseng_1 | *Mycobacterium leprae* |
| SBP00209 | American ginseng_1 | *Mycobacterium lepraemurium* |
| SBP00209 | American ginseng_1 | *Mycobacterium lepraemurium* |
| SBP00209 | American ginseng_1 | *Mycobacterium marinum* |
| SBP00209 | American ginseng_1 | *Mycobacterium marinum* |
| SBP00209 | American ginseng_1 | *Mycobacterium marseillense* |
| SBP00209 | American ginseng_1 | *Mycobacterium marseillense* |
| SBP00209 | American ginseng_1 | *Mycobacterium paragordonae* |
| SBP00209 | American ginseng_1 | *Mycobacterium paragordonae* |
| SBP00209 | American ginseng_1 | *Mycobacterium shigaense* |
| SBP00209 | American ginseng_1 | *Mycobacterium shigaense* |
| SBP00209 | American ginseng_1 | *Mycobacterium* sp. djl-10 |

TABLE 3-continued

List of species identified in each metagenomic sample of each SBP Sample

| SBP ID | SBP Host Common Name | Genus sp. |
|---|---|---|
| SBP00209 | American ginseng_1 | Mycobacterium sp. djl-10 |
| SBP00209 | American ginseng_1 | Mycobacterium sp. DL90 |
| SBP00209 | American ginseng_1 | Mycobacterium sp. DL90 |
| SBP00209 | American ginseng_1 | Mycobacterium sp. EPa45 |
| SBP00209 | American ginseng_1 | Mycobacterium sp. EPa45 |
| SBP00209 | American ginseng_1 | Mycobacterium sp. JS623 |
| SBP00209 | American ginseng_1 | Mycobacterium sp. JS623 |
| SBP00209 | American ginseng_1 | Mycobacterium sp. MS1601 |
| SBP00209 | American ginseng_1 | Mycobacterium sp. MS1601 |
| SBP00209 | American ginseng_1 | Mycobacterium sp. PYR15 |
| SBP00209 | American ginseng_1 | Mycobacterium sp. PYR15 |
| SBP00209 | American ginseng_1 | Mycobacterium sp. VKM Ac-1817D |
| SBP00209 | American ginseng_1 | Mycobacterium sp. VKM Ac-1817D |
| SBP00209 | American ginseng_1 | Mycobacterium sp. WY10 |
| SBP00209 | American ginseng_1 | Mycobacterium sp. WY10 |
| SBP00209 | American ginseng_1 | Mycobacterium sp. YC-RL4 |
| SBP00209 | American ginseng_1 | Mycobacterium sp. YC-RL4 |
| SBP00209 | American ginseng_1 | Mycobacteroides abscessus |
| SBP00209 | American ginseng_1 | Mycobacteroides abscessus |
| SBP00209 | American ginseng_1 | Mycobacteroides chelonae |
| SBP00209 | American ginseng_1 | Mycobacteroides chelonae |
| SBP00209 | American ginseng_1 | Mycobacteroides immunogenum |
| SBP00209 | American ginseng_1 | Mycobacteroides immunogenum |
| SBP00209 | American ginseng_1 | Mycobacteroides saopaulense |
| SBP00209 | American ginseng_1 | Mycobacteroides saopaulense |
| SBP00209 | American ginseng_1 | Mycolicibacter sinensis |
| SBP00209 | American ginseng_1 | Mycolicibacter sinensis |
| SBP00209 | American ginseng_1 | Mycolicibacter terrae |
| SBP00209 | American ginseng_1 | Mycolicibacter terrae |
| SBP00209 | American ginseng_1 | Mycolicibacterium aurum |
| SBP00209 | American ginseng_1 | Mycolicibacterium aurum |
| SBP00209 | American ginseng_1 | Mycolicibacterium chitae |
| SBP00209 | American ginseng_1 | Mycolicibacterium chitae |
| SBP00209 | American ginseng_1 | Mycolicibacterium chubuense |
| SBP00209 | American ginseng_1 | Mycolicibacterium chubuense |
| SBP00209 | American ginseng_1 | Mycolicibacterium flavescens |
| SBP00209 | American ginseng_1 | Mycolicibacterium flavescens |
| SBP00209 | American ginseng_1 | Mycolicibacterium fortuitum |
| SBP00209 | American ginseng_1 | Mycolicibacterium fortuitum |
| SBP00209 | American ginseng_1 | Mycolicibacterium gilvum |
| SBP00209 | American ginseng_1 | Mycolicibacterium gilvum |
| SBP00209 | American ginseng_1 | Mycolicibacterium goodii |
| SBP00209 | American ginseng_1 | Mycolicibacterium goodii |
| SBP00209 | American ginseng_1 | Mycolicibacterium hassiacum |
| SBP00209 | American ginseng_1 | Mycolicibacterium hassiacum |
| SBP00209 | American ginseng_1 | Mycolicibacterium rhodesiae |
| SBP00209 | American ginseng_1 | Mycolicibacterium rhodesiae |
| SBP00209 | American ginseng_1 | Mycolicibacterium rutilum |
| SBP00209 | American ginseng_1 | Mycolicibacterium rutilum |
| SBP00209 | American ginseng_1 | Mycolicibacterium smegmatis |
| SBP00209 | American ginseng_1 | Mycolicibacterium smegmatis |
| SBP00209 | American ginseng_1 | Mycolicibacterium thermoresistibile |
| SBP00209 | American ginseng_1 | Mycolicibacterium thermoresistibile |
| SBP00209 | American ginseng_1 | Mycolicibacterium vaccae |
| SBP00209 | American ginseng_1 | Mycolicibacterium vaccae |
| SBP00209 | American ginseng_1 | Mycolicibacterium vanbaalenii |
| SBP00209 | American ginseng_1 | Mycolicibacterium vanbaalenii |
| SBP00209 | American ginseng_1 | Mycoplasma agalactiae |
| SBP00209 | American ginseng_1 | Mycoplasma agalactiae |
| SBP00209 | American ginseng_1 | Mycoplasma anseris |
| SBP00209 | American ginseng_1 | Mycoplasma anseris |
| SBP00209 | American ginseng_1 | Mycoplasma bovigenitalium |
| SBP00209 | American ginseng_1 | Mycoplasma bovigenitalium |
| SBP00209 | American ginseng_1 | Mycoplasma bovoculi |
| SBP00209 | American ginseng_1 | Mycoplasma bovoculi |
| SBP00209 | American ginseng_1 | Mycoplasma citelli |
| SBP00209 | American ginseng_1 | Mycoplasma citelli |
| SBP00209 | American ginseng_1 | Mycoplasma flocculare |
| SBP00209 | American ginseng_1 | Mycoplasma flocculare |
| SBP00209 | American ginseng_1 | Mycoplasma haemocanis |
| SBP00209 | American ginseng_1 | Mycoplasma haemocanis |
| SBP00209 | American ginseng_1 | Mycoplasma hominis |
| SBP00209 | American ginseng_1 | Mycoplasma hominis |
| SBP00209 | American ginseng_1 | Mycoplasma mycoides |
| SBP00209 | American ginseng_1 | Mycoplasma mycoides |
| SBP00209 | American ginseng_1 | Mycoplasma ovis |

TABLE 3-continued

List of species identified in each metagenomic sample of each SBP Sample

| SBP ID | SBP Host Common Name | Genus sp. |
|---|---|---|
| SBP00209 | American ginseng_1 | *Mycoplasma ovis* |
| SBP00209 | American ginseng_1 | *Mycoplasma phocicerebrale* |
| SBP00209 | American ginseng_1 | *Mycoplasma phocicerebrale* |
| SBP00209 | American ginseng_1 | *Mycoplasma* sp. (ex *Biomphalaria glabrata*) |
| SBP00209 | American ginseng_1 | *Mycoplasma* sp. (ex *Biomphalaria glabrata*) |
| SBP00209 | American ginseng_1 | *Myroides odoratus* |
| SBP00209 | American ginseng_1 | *Myroides odoratus* |
| SBP00209 | American ginseng_1 | *Myxococcus fulvus* |
| SBP00209 | American ginseng_1 | *Myxococcus fulvus* |
| SBP00209 | American ginseng_1 | *Myxococcus hansupus* |
| SBP00209 | American ginseng_1 | *Myxococcus hansupus* |
| SBP00209 | American ginseng_1 | *Myxococcus macrosporus* |
| SBP00209 | American ginseng_1 | *Myxococcus macrosporus* |
| SBP00209 | American ginseng_1 | *Myxococcus stipitatus* |
| SBP00209 | American ginseng_1 | *Myxococcus stipitatus* |
| SBP00209 | American ginseng_1 | *Myxococcus xanthus* |
| SBP00209 | American ginseng_1 | *Myxococcus xanthus* |
| SBP00209 | American ginseng_1 | *Nakamurella multipartita* |
| SBP00209 | American ginseng_1 | *Nakamurella multipartita* |
| SBP00209 | American ginseng_1 | *Nakamurella panacisegetis* |
| SBP00209 | American ginseng_1 | *Nakamurella panacisegetis* |
| SBP00209 | American ginseng_1 | *Natranaerobius thermophilus* |
| SBP00209 | American ginseng_1 | *Natranaerobius thermophilus* |
| SBP00209 | American ginseng_1 | *Natrinema pallidum* |
| SBP00209 | American ginseng_1 | *Natrinema pallidum* |
| SBP00209 | American ginseng_1 | *Natrinema versiforme* |
| SBP00209 | American ginseng_1 | *Natrinema versiforme* |
| SBP00209 | American ginseng_1 | *Natronococcus occultus* |
| SBP00209 | American ginseng_1 | *Natronococcus occultus* |
| SBP00209 | American ginseng_1 | *Natronolimnobius aegyptiacus* |
| SBP00209 | American ginseng_1 | *Natronolimnobius aegyptiacus* |
| SBP00209 | American ginseng_1 | *Natronomonas moolapensis* |
| SBP00209 | American ginseng_1 | *Natronomonas moolapensis* |
| SBP00209 | American ginseng_1 | *Nautilia profundicola* |
| SBP00209 | American ginseng_1 | *Nautilia profundicola* |
| SBP00209 | American ginseng_1 | *Neisseria elongata* |
| SBP00209 | American ginseng_1 | *Neisseria elongata* |
| SBP00209 | American ginseng_1 | *Neisseria meningitidis* |
| SBP00209 | American ginseng_1 | *Neisseria meningitidis* |
| SBP00209 | American ginseng_1 | *Neisseria* sp. 10023 |
| SBP00209 | American ginseng_1 | *Neisseria* sp. 10023 |
| SBP00209 | American ginseng_1 | *Neisseria* sp. KEM232 |
| SBP00209 | American ginseng_1 | *Neisseria* sp. KEM232 |
| SBP00209 | American ginseng_1 | *Neisseria* sp. oral taxon 014 |
| SBP00209 | American ginseng_1 | *Neisseria* sp. oral taxon 014 |
| SBP00209 | American ginseng_1 | *Neisseria zoodegmatis* |
| SBP00209 | American ginseng_1 | *Neisseria zoodegmatis* |
| SBP00209 | American ginseng_1 | *Neoasaia chiangmaiensis* |
| SBP00209 | American ginseng_1 | *Neoasaia chiangmaiensis* |
| SBP00209 | American ginseng_1 | *Neomicrococcus aestuarii* |
| SBP00209 | American ginseng_1 | *Neomicrococcus aestuarii* |
| SBP00209 | American ginseng_1 | *Neorhizobium galegae* |
| SBP00209 | American ginseng_1 | *Neorhizobium galegae* |
| SBP00209 | American ginseng_1 | *Neorhizobium* sp. NCHU2750 |
| SBP00209 | American ginseng_1 | *Neorhizobium* sp. NCHU2750 |
| SBP00209 | American ginseng_1 | *Neorhizobium* sp. SOG26 |
| SBP00209 | American ginseng_1 | *Neorhizobium* sp. SOG26 |
| SBP00209 | American ginseng_1 | *Niabella ginsenosidivorans* |
| SBP00209 | American ginseng_1 | *Niabella ginsenosidivorans* |
| SBP00209 | American ginseng_1 | *Niabella soli* |
| SBP00209 | American ginseng_1 | *Niabella soli* |
| SBP00209 | American ginseng_1 | *Niastella koreensis* |
| SBP00209 | American ginseng_1 | *Niastella koreensis* |
| SBP00209 | American ginseng_1 | *Nissabacter* sp. SGAir0207 |
| SBP00209 | American ginseng_1 | *Nissabacter* sp. SGAir0207 |
| SBP00209 | American ginseng_1 | *Nitratireductor basaltis* |
| SBP00209 | American ginseng_1 | *Nitratireductor basaltis* |
| SBP00209 | American ginseng_1 | *Nitratireductor* sp. OM-1 |
| SBP00209 | American ginseng_1 | *Nitratireductor* sp. OM-1 |
| SBP00209 | American ginseng_1 | *Nitrobacter hamburgensis* |
| SBP00209 | American ginseng_1 | *Nitrobacter hamburgensis* |
| SBP00209 | American ginseng_1 | *Nitrobacter winogradskyi* |
| SBP00209 | American ginseng_1 | *Nitrobacter winogradskyi* |
| SBP00209 | American ginseng_1 | *Nitrosococcus halophilus* |
| SBP00209 | American ginseng_1 | *Nitrosococcus halophilus* |
| SBP00209 | American ginseng_1 | *Nitrosococcus oceani* |

TABLE 3-continued

List of species identified in each metagenomic sample of each SBP Sample

| SBP ID | SBP Host Common Name | Genus sp. |
|---|---|---|
| SBP00209 | American ginseng_1 | *Nitrosococcus oceani* |
| SBP00209 | American ginseng_1 | *Nitrosococcus wardiae* |
| SBP00209 | American ginseng_1 | *Nitrosococcus wardiae* |
| SBP00209 | American ginseng_1 | *Nitrosococcus watsonii* |
| SBP00209 | American ginseng_1 | *Nitrosococcus watsonii* |
| SBP00209 | American ginseng_1 | *Nitrosomonas* sp. AL212 |
| SBP00209 | American ginseng_1 | *Nitrosomonas* sp. AL212 |
| SBP00209 | American ginseng_1 | *Nitrososphaera viennensis* |
| SBP00209 | American ginseng_1 | *Nitrososphaera viennensis* |
| SBP00209 | American ginseng_1 | *Nitrosospira briensis* |
| SBP00209 | American ginseng_1 | *Nitrosospira briensis* |
| SBP00209 | American ginseng_1 | *Nitrosospira lacus* |
| SBP00209 | American ginseng_1 | *Nitrosospira lacus* |
| SBP00209 | American ginseng_1 | *Nitrosospira multiformis* |
| SBP00209 | American ginseng_1 | *Nitrosospira multiformis* |
| SBP00209 | American ginseng_1 | *Nitrospira moscoviensis* |
| SBP00209 | American ginseng_1 | *Nitrospira moscoviensis* |
| SBP00209 | American ginseng_1 | *Nitrospirillum amazonense* |
| SBP00209 | American ginseng_1 | *Nitrospirillum amazonense* |
| SBP00209 | American ginseng_1 | *Niveispirillum cyanobacteriorum* |
| SBP00209 | American ginseng_1 | *Niveispirillum cyanobacteriorum* |
| SBP00209 | American ginseng_1 | *Nocardia asteroides* |
| SBP00209 | American ginseng_1 | *Nocardia asteroides* |
| SBP00209 | American ginseng_1 | *Nocardia brasiliensis* |
| SBP00209 | American ginseng_1 | *Nocardia brasiliensis* |
| SBP00209 | American ginseng_1 | *Nocardia cyriacigeorgica* |
| SBP00209 | American ginseng_1 | *Nocardia cyriacigeorgica* |
| SBP00209 | American ginseng_1 | *Nocardia farcinica* |
| SBP00209 | American ginseng_1 | *Nocardia farcinica* |
| SBP00209 | American ginseng_1 | *Nocardia nova* |
| SBP00209 | American ginseng_1 | *Nocardia nova* |
| SBP00209 | American ginseng_1 | *Nocardia seriolae* |
| SBP00209 | American ginseng_1 | *Nocardia seriolae* |
| SBP00209 | American ginseng_1 | *Nocardia* sp. CFHS0054 |
| SBP00209 | American ginseng_1 | *Nocardia* sp. CFHS0054 |
| SBP00209 | American ginseng_1 | *Nocardia* sp. CS682 |
| SBP00209 | American ginseng_1 | *Nocardia* sp. CS682 |
| SBP00209 | American ginseng_1 | *Nocardia* sp. Y48 |
| SBP00209 | American ginseng_1 | *Nocardia* sp. Y48 |
| SBP00209 | American ginseng_1 | *Nocardia terpenica* |
| SBP00209 | American ginseng_1 | *Nocardia terpenica* |
| SBP00209 | American ginseng_1 | *Nocardioides baekrokdamisoli* |
| SBP00209 | American ginseng_1 | *Nocardioides baekrokdamisoli* |
| SBP00209 | American ginseng_1 | *Nocardioides daphniae* |
| SBP00209 | American ginseng_1 | *Nocardioides daphniae* |
| SBP00209 | American ginseng_1 | *Nocardioides dokdonensis* |
| SBP00209 | American ginseng_1 | *Nocardioides dokdonensis* |
| SBP00209 | American ginseng_1 | *Nocardioides humi* |
| SBP00209 | American ginseng_1 | *Nocardioides humi* |
| SBP00209 | American ginseng_1 | *Nocardioides* sp. 603 |
| SBP00209 | American ginseng_1 | *Nocardioides* sp. 603 |
| SBP00209 | American ginseng_1 | *Nocardioides* sp. 78 |
| SBP00209 | American ginseng_1 | *Nocardioides* sp. 78 |
| SBP00209 | American ginseng_1 | *Nocardioides* sp. CF8 |
| SBP00209 | American ginseng_1 | *Nocardioides* sp. CF8 |
| SBP00209 | American ginseng_1 | *Nocardioides* sp. HY056 |
| SBP00209 | American ginseng_1 | *Nocardioides* sp. HY056 |
| SBP00209 | American ginseng_1 | *Nocardioides* sp. JS614 |
| SBP00209 | American ginseng_1 | *Nocardioides* sp. JS614 |
| SBP00209 | American ginseng_1 | *Nocardiopsis alba* |
| SBP00209 | American ginseng_1 | *Nocardiopsis alba* |
| SBP00209 | American ginseng_1 | *Nocardiopsis dassonvillei* |
| SBP00209 | American ginseng_1 | *Nocardiopsis dassonvillei* |
| SBP00209 | American ginseng_1 | *Nocardiopsis gilva* |
| SBP00209 | American ginseng_1 | *Nocardiopsis gilva* |
| SBP00209 | American ginseng_1 | *Nodularia spumigena* |
| SBP00209 | American ginseng_1 | *Nodularia spumigena* |
| SBP00209 | American ginseng_1 | *Nonlabens dokdonensis* |
| SBP00209 | American ginseng_1 | *Nonlabens dokdonensis* |
| SBP00209 | American ginseng_1 | *Nonlabens* sp. M8-3u-79 |
| SBP00209 | American ginseng_1 | *Nonlabens* sp. MB-3u-79 |
| SBP00209 | American ginseng_1 | *Nonomuraea* sp. ATCC 55076 |
| SBP00209 | American ginseng_1 | *Nonomuraea* sp. ATCC 55076 |
| SBP00209 | American ginseng_1 | *Nostoc carneum* |
| SBP00209 | American ginseng_1 | *Nostoc carneum* |
| SBP00209 | American ginseng_1 | *Nostoc flagelliforme* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Nostoc flagelliforme* |
| SBP00209 | American ginseng_1 | *Nostoc punctiforme* |
| SBP00209 | American ginseng_1 | *Nostoc punctiforme* |
| SBP00209 | American ginseng_1 | *Nostoc* sp. 'Lobaria pulmonaria (5183) cyanobiont* |
| SBP00209 | American ginseng_1 | *Nostoc* sp. 'Lobaria pulmonaria (5183) cyanobiont* |
| SBP00209 | American ginseng_1 | *Nostoc* sp. 'Peltigera membranacea cyanobiont' N6 |
| SBP00209 | American ginseng_1 | *Nostoc* sp. 'Peltigera membranacea cyanoblont' N6 |
| SBP00209 | American ginseng_1 | *Nostoc* sp. CENA543 |
| SBP00209 | American ginseng_1 | *Nostoc* sp. CENA543 |
| SBP00209 | American ginseng_1 | *Nostoc* sp. NIES-4103 |
| SBP00209 | American ginseng_1 | *Nostoc* sp. NIES-4103 |
| SBP00209 | American ginseng_1 | *Nostoc* sp. PCC 7107 |
| SBP00209 | American ginseng_1 | *Nostoc* sp. PCC 7107 |
| SBP00209 | American ginseng_1 | *Nostoc* sp. PCC 7524 |
| SBP00209 | American ginseng_1 | *Nostoc* sp. PCC 7524 |
| SBP00209 | American ginseng_1 | *Nostoc sphaeroides* |
| SBP00209 | American ginseng_1 | *Nostoc sphaeroides* |
| SBP00209 | American ginseng_1 | *Nostocales cyanobacterium* HT-58-2 |
| SBP00209 | American ginseng_1 | *Nostocales cyanobacterium* HT-58-2 |
| SBP00209 | American ginseng_1 | Noumeavirus |
| SBP00209 | American ginseng_1 | Noumeavirus |
| SBP00209 | American ginseng_1 | *Novibacillus thermophilus* |
| SBP00209 | American ginseng_1 | *Novibacillus thermophilus* |
| SBP00209 | American ginseng_1 | *Novosphingobium aromaticivorans* |
| SBP00209 | American ginseng_1 | *Novosphingobium aromaticivorans* |
| SBP00209 | American ginseng_1 | *Novosphingobium pentaromativorans* |
| SBP00209 | American ginseng_1 | *Novosphingobium pentaromativorans* |
| SBP00209 | American ginseng_1 | *Novosphingobium resinovorum* |
| SBP00209 | American ginseng_1 | *Novosphingobium resinovorum* |
| SBP00209 | American ginseng_1 | *Novosphingobium* sp. P6W |
| SBP00209 | American ginseng_1 | *Novosphingobium* sp. P6W |
| SBP00209 | American ginseng_1 | *Novosphingobium* sp. PP1Y |
| SBP00209 | American ginseng_1 | *Novosphingobium* sp. PP1Y |
| SBP00209 | American ginseng_1 | *Novosphingobium* sp. THN1 |
| SBP00209 | American ginseng_1 | *Novosphingobium* sp. THN1 |
| SBP00209 | American ginseng_1 | *Novosphingobium tardaugens* |
| SBP00209 | American ginseng_1 | *Novosphingobium tardaugens* |
| SBP00209 | American ginseng_1 | *Oceanithermus profundus* |
| SBP00209 | American ginseng_1 | *Oceanithermus profundus* |
| SBP00209 | American ginseng_1 | *Oceanobacillus iheyensis* |
| SBP00209 | American ginseng_1 | *Oceanobacillus iheyensis* |
| SBP00209 | American ginseng_1 | *Oceanobacillus kimchii* |
| SBP00209 | American ginseng_1 | *Oceanobacillus kimchii* |
| SBP00209 | American ginseng_1 | *Oceanobacillus* sp. 160 |
| SBP00209 | American ginseng_1 | *Oceanobacillus* sp. 160 |
| SBP00209 | American ginseng_1 | *Ochrobactrum anthropi* |
| SBP00209 | American ginseng_1 | *Ochrobactrum anthropi* |
| SBP00209 | American ginseng_1 | *Ochrobactrum pseudogrignonense* |
| SBP00209 | American ginseng_1 | *Ochrobactrum pseudogrignonense* |
| SBP00209 | American ginseng_1 | *Ochrobactrum* sp. A44 |
| SBP00209 | American ginseng_1 | *Ochrobactrum* sp. A44 |
| SBP00209 | American ginseng_1 | *Octadecabacter antarcticus* |
| SBP00209 | American ginseng_1 | *Octadecabacter antarcticus* |
| SBP00209 | American ginseng_1 | *Octadecabacter temperatus* |
| SBP00209 | American ginseng_1 | *Octadecabacter temperatus* |
| SBP00209 | American ginseng_1 | *Oenococcus sicerae* |
| SBP00209 | American ginseng_1 | *Oenococcus sicerae* |
| SBP00209 | American ginseng_1 | *Oenococcus* sp. UCMA 16435 |
| SBP00209 | American ginseng_1 | *Oenococcus* sp. UCMA 16435 |
| SBP00209 | American ginseng_1 | *Oleiphilus messinensis* |
| SBP00209 | American ginseng_1 | *Oleiphilus messinensis* |
| SBP00209 | American ginseng_1 | *Oligotropha carboxidovorans* |
| SBP00209 | American ginseng_1 | *Oligotropha carboxidovorans* |
| SBP00209 | American ginseng_1 | *Olsenella* sp. Marseille-P2300 |
| SBP00209 | American ginseng_1 | *Olsenella* sp. Marseille-P2300 |
| SBP00209 | American ginseng_1 | *Olsenella uli* |
| SBP00209 | American ginseng_1 | *Olsenella uli* |
| SBP00209 | American ginseng_1 | *Opitutaceae bacterium* TAV5 |
| SBP00209 | American ginseng_1 | *Opitutaceae bacterium* TAV5 |
| SBP00209 | American ginseng_1 | *Opitutus* sp. GAS368 |
| SBP00209 | American ginseng_1 | *Opitutus* sp. GAS368 |
| SBP00209 | American ginseng_1 | *Opitutus terrae* |
| SBP00209 | American ginseng_1 | *Opitutus terrae* |
| SBP00209 | American ginseng_1 | *Orientia tsutsugamushi* |
| SBP00209 | American ginseng_1 | *Orientia tsutsugamushi* |
| SBP00209 | American ginseng_1 | *Ornithinimicrobium flavum* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Ornithinimicrobium flavum* |
| SBP00209 | American ginseng_1 | *Ornithinimicrobium* sp. AMA3305 |
| SBP00209 | American ginseng_1 | *Ornithinimicrobium* sp. AMA3305 |
| SBP00209 | American ginseng_1 | *Ornithobacterium rhinotracheale* |
| SBP00209 | American ginseng_1 | *Ornithobacterium rhinotracheale* |
| SBP00209 | American ginseng_1 | *Orrella dioscoreae* |
| SBP00209 | American ginseng_1 | *Orrella dioscoreae* |
| SBP00209 | American ginseng_1 | *Oscillatoria acuminata* |
| SBP00209 | American ginseng_1 | *Oscillatoria acuminata* |
| SBP00209 | American ginseng_1 | *Oscillatoria nigro-viridis* |
| SBP00209 | American ginseng_1 | *Oscillatoria nigro-viridis* |
| SBP00209 | American ginseng_1 | *Oscillibacter* sp. PEA192 |
| SBP00209 | American ginseng_1 | *Oscillibacter* sp. PEA192 |
| SBP00209 | American ginseng_1 | *Oscillibacter valericigenes* |
| SBP00209 | American ginseng_1 | *Oscillibacter valericigenes* |
| SBP00209 | American ginseng_1 | *Ottowia oryzae* |
| SBP00209 | American ginseng_1 | *Ottowia oryzae* |
| SBP00209 | American ginseng_1 | *Ottowia* sp. oral taxon 894 |
| SBP00209 | American ginseng_1 | *Ottowia* sp. oral taxon 894 |
| SBP00209 | American ginseng_1 | *Paenarthrobacter aurescens* |
| SBP00209 | American ginseng_1 | *Paenarthrobacter aurescens* |
| SBP00209 | American ginseng_1 | *Paenibacillaceae bacterium* GAS479 |
| SBP00209 | American ginseng_1 | *Paenibacillaceae bacterium* GAS479 |
| SBP00209 | American ginseng_1 | *Paenibacillus baekrokdamisoli* |
| SBP00209 | American ginseng_1 | *Paenibacillus baekrokdamisoli* |
| SBP00209 | American ginseng_1 | *Paenibacillus beijingensis* |
| SBP00209 | American ginseng_1 | *Paenibacillus beijingensis* |
| SBP00209 | American ginseng_1 | *Paenibacillus borealis* |
| SBP00209 | American ginseng_1 | *Paenibacillus borealis* |
| SBP00209 | American ginseng_1 | *Paenibacillus bovis* |
| SBP00209 | American ginseng_1 | *Paenibacillus bovis* |
| SBP00209 | American ginseng_1 | *Paenibacillus chitinolyticus* |
| SBP00209 | American ginseng_1 | *Paenibacillus chitinolyticus* |
| SBP00209 | American ginseng_1 | *Paenibacillus crassostreae* |
| SBP00209 | American ginseng_1 | *Paenibacillus crassostreae* |
| SBP00209 | American ginseng_1 | *Paenibacillus donghaensis* |
| SBP00209 | American ginseng_1 | *Paenibacillus donghaensis* |
| SBP00209 | American ginseng_1 | *Paenibacillus durus* |
| SBP00209 | American ginseng_1 | *Paenibacillus durus* |
| SBP00209 | American ginseng_1 | *Paenibacillus graminis* |
| SBP00209 | American ginseng_1 | *Paenibacillus graminis* |
| SBP00209 | American ginseng_1 | *Paenibacillus ihbetae* |
| SBP00209 | American ginseng_1 | *Paenibacillus ihbetae* |
| SBP00209 | American ginseng_1 | *Paenibacillus larvae* |
| SBP00209 | American ginseng_1 | *Paenibacillus larvae* |
| SBP00209 | American ginseng_1 | *Paenibacillus lautus* |
| SBP00209 | American ginseng_1 | *Paenibacillus lautus* |
| SBP00209 | American ginseng_1 | *Paenibacillus lentus* |
| SBP00209 | American ginseng_1 | *Paenibacillus lentus* |
| SBP00209 | American ginseng_1 | *Paenibacillus mucilaginosus* |
| SBP00209 | American ginseng_1 | *Paenibacillus mucilaginosus* |
| SBP00209 | American ginseng_1 | *Paenibacillus naphthalenovorans* |
| SBP00209 | American ginseng_1 | *Paenibacillus naphthalenovorans* |
| SBP00209 | American ginseng_1 | *Paenibacillus odorifer* |
| SBP00209 | American ginseng_1 | *Paenibacillus odorifer* |
| SBP00209 | American ginseng_1 | *Paenibacillus physcomitrellae* |
| SBP00209 | American ginseng_1 | *Paenibacillus physcomitrellae* |
| SBP00209 | American ginseng_1 | *Paenibacillus polymyxa* |
| SBP00209 | American ginseng_1 | *Paenibacillus polymyxa* |
| SBP00209 | American ginseng_1 | *Paenibacillus* sp. 18JY67-1 |
| SBP00209 | American ginseng_1 | *Paenibacillus* sp. 18JY67-1 |
| SBP00209 | American ginseng_1 | *Paenibacillus* sp. 32O-W |
| SBP00209 | American ginseng_1 | *Paenibacillus* sp. 32O-W |
| SBP00209 | American ginseng_1 | *Paenibacillus* sp. CAA11 |
| SBP00209 | American ginseng_1 | *Paenibacillus* sp. CAA11 |
| SBP00209 | American ginseng_1 | *Paenibacillus* sp. DCT19 |
| SBP00209 | American ginseng_1 | *Paenibacillus* sp. DCT19 |
| SBP00209 | American ginseng_1 | *Paenibacillus* sp. FSL H7-0357 |
| SBP00209 | American ginseng_1 | *Paenibacillus* sp. FSL H7-0357 |
| SBP00209 | American ginseng_1 | *Paenibacillus* sp. FSL H7-0737 |
| SBP00209 | American ginseng_1 | *Paenibacillus* sp. FSL H7-0737 |
| SBP00209 | American ginseng_1 | *Paenibacillus* sp. FSL P4-0081 |
| SBP00209 | American ginseng_1 | *Paenibacillus* sp. FSL P4-0081 |
| SBP00209 | American ginseng_1 | *Paenibacillus* sp. FSL R5-0345 |
| SBP00209 | American ginseng_1 | *Paenibacillus* sp. FSL R5-0345 |
| SBP00209 | American ginseng_1 | *Paenibacillus* sp. FSL R5-0912 |

TABLE 3-continued

List of species identified in each metagenomic sample of each SBP Sample

| SBP ID | SBP Host Common Name | Genus sp. |
|---|---|---|
| SBP00209 | American ginseng_1 | *Paenibacillus* sp. FSL R5-0912 |
| SBP00209 | American ginseng_1 | *Paenibacillus* sp. FSL R7-0273 |
| SBP00209 | American ginseng_1 | *Paenibacillus* sp. FSL R7-0273 |
| SBP00209 | American ginseng_1 | *Paenibacillus* sp. FSL R7-0331 |
| SBP00209 | American ginseng_1 | *Paenibacillus* sp. FSL R7-0331 |
| SBP00209 | American ginseng_1 | *Paenibacillus* sp. IHBB 10380 |
| SBP00209 | American ginseng_1 | *Paenibacillus* sp. IHBB 10380 |
| SBP00209 | American ginseng_1 | *Paenibacillus* sp. MBLB1234 |
| SBP00209 | American ginseng_1 | *Paenibacillus* sp. MBLB1234 |
| SBP00209 | American ginseng_1 | *Paenibacillus* sp. RUD330 |
| SBP00209 | American ginseng_1 | *Paenibacillus* sp. RUD330 |
| SBP00209 | American ginseng_1 | *Paenibacillus* sp. Y412MC10 |
| SBP00209 | American ginseng_1 | *Paenibacillus* sp. Y412MC10 |
| SBP00209 | American ginseng_1 | *Paenibacillus stellifer* |
| SBP00209 | American ginseng_1 | *Paenibacillus stellifer* |
| SBP00209 | American ginseng_1 | *Paenibacillus terrae* |
| SBP00209 | American ginseng_1 | *Paenibacillus terrae* |
| SBP00209 | American ginseng_1 | *Paenibacillus xylanexedens* |
| SBP00209 | American ginseng_1 | *Paenibacillus xylanexedens* |
| SBP00209 | American ginseng_1 | *Paenibacillus yonginensis* |
| SBP00209 | American ginseng_1 | *Paenibacillus yonginensis* |
| SBP00209 | American ginseng_1 | *Paeniclostridium sordellii* |
| SBP00209 | American ginseng_1 | *Paeniclostridium sordellii* |
| SBP00209 | American ginseng_1 | *Paenisporosarcina* sp. K2R23-3 |
| SBP00209 | American ginseng_1 | *Paenisporosarcina* sp. K2R23-3 |
| SBP00209 | American ginseng_1 | *Pajaroellobacter abortibovis* |
| SBP00209 | American ginseng_1 | *Pajaroellobacter abortibovis* |
| SBP00209 | American ginseng_1 | *Paludisphaera borealis* |
| SBP00209 | American ginseng_1 | *Paludisphaera borealis* |
| SBP00209 | American ginseng_1 | *Pandoraea apista* |
| SBP00209 | American ginseng_1 | *Pandoraea apista* |
| SBP00209 | American ginseng_1 | *Pandoraea faecigallinarum* |
| SBP00209 | American ginseng_1 | *Pandoraea faecigallinarum* |
| SBP00209 | American ginseng_1 | *Pandoraea norimbergensis* |
| SBP00209 | American ginseng_1 | *Pandoraea norimbergensis* |
| SBP00209 | American ginseng_1 | *Pandoraea oxalativorans* |
| SBP00209 | American ginseng_1 | *Pandoraea oxalativorans* |
| SBP00209 | American ginseng_1 | *Pandoraea pnomenusa* |
| SBP00209 | American ginseng_1 | *Pandoraea pnomenusa* |
| SBP00209 | American ginseng_1 | *Pandoraea pulmonicola* |
| SBP00209 | American ginseng_1 | *Pandoraea pulmonicola* |
| SBP00209 | American ginseng_1 | *Pandoraea sputorum* |
| SBP00209 | American ginseng_1 | *Pandoraea sputorum* |
| SBP00209 | American ginseng_1 | *Pandoraea thiooxydans* |
| SBP00209 | American ginseng_1 | *Pandoraea thiooxydans* |
| SBP00209 | American ginseng_1 | *Pandoraea vervacti* |
| SBP00209 | American ginseng_1 | *Pandoraea vervacti* |
| SBP00209 | American ginseng_1 | *Pannonibacter phragmitetus* |
| SBP00209 | American ginseng_1 | *Pannonibacter phragmitetus* |
| SBP00209 | American ginseng_1 | *Pantoea agglomerans* |
| SBP00209 | American ginseng_1 | *Pantoea agglomerans* |
| SBP00209 | American ginseng_1 | *Pantoea alhagi* |
| SBP00209 | American ginseng_1 | *Pantoea alhagi* |
| SBP00209 | American ginseng_1 | *Pantoea ananatis* |
| SBP00209 | American ginseng_1 | *Pantoea ananatis* |
| SBP00209 | American ginseng_1 | *Pantoea rwandensis* |
| SBP00209 | American ginseng_1 | *Pantoea rwandensis* |
| SBP00209 | American ginseng_1 | *Pantoea* sp. At-9b |
| SBP00209 | American ginseng_1 | *Pantoea* sp. At-9b |
| SBP00209 | American ginseng_1 | *Pantoea* sp. PSNIH1 |
| SBP00209 | American ginseng_1 | *Pantoea* sp. PSNIH1 |
| SBP00209 | American ginseng_1 | *Pantoea* sp. PSNIH2 |
| SBP00209 | American ginseng_1 | *Pantoea* sp. PSNIH2 |
| SBP00209 | American ginseng_1 | *Pantoea stewartii* |
| SBP00209 | American ginseng_1 | *Pantoea stewartii* |
| SBP00209 | American ginseng_1 | *Pantoea vagans* |
| SBP00209 | American ginseng_1 | *Pantoea vagans* |
| SBP00209 | American ginseng_1 | *Paraburkholderia aromaticivorans* |
| SBP00209 | American ginseng_1 | *Paraburkholderia aromaticivorans* |
| SBP00209 | American ginseng_1 | *Paraburkholderia caffeinilytica* |
| SBP00209 | American ginseng_1 | *Paraburkholderia caffeinilytica* |
| SBP00209 | American ginseng_1 | *Paraburkholderia caledonica* |
| SBP00209 | American ginseng_1 | *Paraburkholderia caledonica* |
| SBP00209 | American ginseng_1 | *Paraburkholderia caribensis* |
| SBP00209 | American ginseng_1 | *Paraburkholderia caribensis* |
| SBP00209 | American ginseng_1 | *Paraburkholderia fungorum* |

TABLE 3-continued

List of species identified in each metagenomic sample of each SBP Sample

| SBP ID | SBP Host Common Name | Genus sp. |
|---|---|---|
| SBP00209 | American ginseng_1 | *Paraburkholderia fungorum* |
| SBP00209 | American ginseng_1 | *Paraburkholderia graminis* |
| SBP00209 | American ginseng_1 | *Paraburkholderia graminis* |
| SBP00209 | American ginseng_1 | *Paraburkholderia hospita* |
| SBP00209 | American ginseng_1 | *Paraburkholderia hospita* |
| SBP00209 | American ginseng_1 | *Paraburkholderia phenoliruptrix* |
| SBP00209 | American ginseng_1 | *Paraburkholderia phenoliruptrix* |
| SBP00209 | American ginseng_1 | *Paraburkholderia phymatum* |
| SBP00209 | American ginseng_1 | *Paraburkholderia phymatum* |
| SBP00209 | American ginseng_1 | *Paraburkholderia phytofirmans* |
| SBP00209 | American ginseng_1 | *Paraburkholderia phytofirmans* |
| SBP00209 | American ginseng_1 | *Paraburkholderia rhizoxinica* |
| SBP00209 | American ginseng_1 | *Paraburkholderia rhizoxinica* |
| SBP00209 | American ginseng_1 | *Paraburkholderia* sp. DCR13 |
| SBP00209 | American ginseng_1 | *Paraburkholderia* sp. DCR13 |
| SBP00209 | American ginseng_1 | *Paraburkholderia* sp. SOS3 |
| SBP00209 | American ginseng_1 | *Paraburkholderia* sp. SOS3 |
| SBP00209 | American ginseng_1 | *Paraburkholderia sprentiae* |
| SBP00209 | American ginseng_1 | *Paraburkholderia sprentiae* |
| SBP00209 | American ginseng_1 | *Paraburkholderia terrae* |
| SBP00209 | American ginseng_1 | *Paraburkholderia terrae* |
| SBP00209 | American ginseng_1 | *Paraburkholderia terricola* |
| SBP00209 | American ginseng_1 | *Paraburkholderia terricola* |
| SBP00209 | American ginseng_1 | *Paraburkholderia xenovorans* |
| SBP00209 | American ginseng_1 | *Paraburkholderia xenovorans* |
| SBP00209 | American ginseng_1 | *Parachlamydia acanthamoebae* |
| SBP00209 | American ginseng_1 | *Parachlamydia acanthamoebae* |
| SBP00209 | American ginseng_1 | *Paracoccus aminophilus* |
| SBP00209 | American ginseng_1 | *Paracoccus aminophilus* |
| SBP00209 | American ginseng_1 | *Paracoccus aminovorans* |
| SBP00209 | American ginseng_1 | *Paracoccus aminovorans* |
| SBP00209 | American ginseng_1 | *Paracoccus contaminans* |
| SBP00209 | American ginseng_1 | *Paracoccus contaminans* |
| SBP00209 | American ginseng_1 | *Paracoccus denitrificans* |
| SBP00209 | American ginseng_1 | *Paracoccus denitrificans* |
| SBP00209 | American ginseng_1 | *Paracoccus* sp. Arc7-R13 |
| SBP00209 | American ginseng_1 | *Paracoccus* sp. Arc7-R13 |
| SBP00209 | American ginseng_1 | *Paracoccus* sp. BM15 |
| SBP00209 | American ginseng_1 | *Paracoccus* sp. BM15 |
| SBP00209 | American ginseng_1 | *Paracoccus* sp. CBA4604 |
| SBP00209 | American ginseng_1 | *Paracoccus* sp. CBA4604 |
| SBP00209 | American ginseng_1 | *Paracoccus* sp. SC2-6 |
| SBP00209 | American ginseng_1 | *Paracoccus* sp. SC2-6 |
| SBP00209 | American ginseng_1 | *Paracoccus yeei* |
| SBP00209 | American ginseng_1 | *Paracoccus yeei* |
| SBP00209 | American ginseng_1 | *Paracoccus zhejiangensis* |
| SBP00209 | American ginseng_1 | *Paracoccus zhejiangensis* |
| SBP00209 | American ginseng_1 | *Parageobacillus* genomosp. 1 |
| SBP00209 | American ginseng_1 | *Parageobacillus* genomosp. 1 |
| SBP00209 | American ginseng_1 | *Paraglaciecola psychrophila* |
| SBP00209 | American ginseng_1 | *Paraglaciecola psychrophila* |
| SBP00209 | American ginseng_1 | *Paraliobacillus* sp. X-1125 |
| SBP00209 | American ginseng_1 | *Paraliobacillus* sp. X-1125 |
| SBP00209 | American ginseng_1 | *Paraoerskovia marina* |
| SBP00209 | American ginseng_1 | *Paraoerskovia marina* |
| SBP00209 | American ginseng_1 | *Paraphotobacterium marinum* |
| SBP00209 | American ginseng_1 | *Paraphotobacterium marinum* |
| SBP00209 | American ginseng_1 | *Paraprevotella xylaniphila* |
| SBP00209 | American ginseng_1 | *Paraprevotella xylaniphila* |
| SBP00209 | American ginseng_1 | *Pararhodospirillum photometricum* |
| SBP00209 | American ginseng_1 | *Pararhodospirillum photometricum* |
| SBP00209 | American ginseng_1 | *Parascardovia denticolens* |
| SBP00209 | American ginseng_1 | *Parascardovia denticolens* |
| SBP00209 | American ginseng_1 | *Parvibaculum lavamentivorans* |
| SBP00209 | American ginseng_1 | *Parvibaculum lavamentivorans* |
| SBP00209 | American ginseng_1 | *Parvimonas micra* |
| SBP00209 | American ginseng_1 | *Parvimonas micra* |
| SBP00209 | American ginseng_1 | *Pasteurella multocida* |
| SBP00209 | American ginseng_1 | *Pasteurella multocida* |
| SBP00209 | American ginseng_1 | *Paucibacter* sp. KCTC 42545 |
| SBP00209 | American ginseng_1 | *Paucibacter* sp. KCTC 42545 |
| SBP00209 | American ginseng_1 | *Pectobacterium carotovorum* |
| SBP00209 | American ginseng_1 | *Pectobacterium carotovorum* |
| SBP00209 | American ginseng_1 | *Pectobacterium parmentieri* |
| SBP00209 | American ginseng_1 | *Pectobacterium parmentieri* |
| SBP00209 | American ginseng_1 | *Pectobacterium polaris* |

TABLE 3-continued

List of species identified in each metagenomic sample of each SBP Sample

| SBP ID | SBP Host Common Name | Genus sp. |
|---|---|---|
| SBP00209 | American ginseng_1 | Pectobacterium polaris |
| SBP00209 | American ginseng_1 | Pectobacterium wasabiae |
| SBP00209 | American ginseng_1 | Pectobacterium wasabiae |
| SBP00209 | American ginseng_1 | Pediococcus pentosaceus |
| SBP00209 | American ginseng_1 | Pediococcus pentosaceus |
| SBP00209 | American ginseng_1 | Pedobacter cryoconitis |
| SBP00209 | American ginseng_1 | Pedobacter cryoconitis |
| SBP00209 | American ginseng_1 | Pedobacter sp. G11 |
| SBP00209 | American ginseng_1 | Pedobacter sp. G11 |
| SBP00209 | American ginseng_1 | Pedobacter steynii |
| SBP00209 | American ginseng_1 | Pedobacter steynii |
| SBP00209 | American ginseng_1 | Pelagibaca abyssi |
| SBP00209 | American ginseng_1 | Pelagibaca abyssi |
| SBP00209 | American ginseng_1 | Pelagibacterium halotolerans |
| SBP00209 | American ginseng_1 | Pelagibacterium halotolerans |
| SBP00209 | American ginseng_1 | Pelobacter carbinolicus |
| SBP00209 | American ginseng_1 | Pelobacter carbinolicus |
| SBP00209 | American ginseng_1 | Pelobacter sp. SFB93 |
| SBP00209 | American ginseng_1 | Pelobacter sp. SFB93 |
| SBP00209 | American ginseng_1 | Pelodictyon phaeoclathratiforme |
| SBP00209 | American ginseng_1 | Pelodictyon phaeoclathratiforme |
| SBP00209 | American ginseng_1 | Pelolinea submarina |
| SBP00209 | American ginseng_1 | Pelolinea submarina |
| SBP00209 | American ginseng_1 | Pelosinus sp. UFO1 |
| SBP00209 | American ginseng_1 | Pelosinus sp. UFO1 |
| SBP00209 | American ginseng_1 | Persicobacter sp. JZB09 |
| SBP00209 | American ginseng_1 | Persicobacter sp. JZB09 |
| SBP00209 | American ginseng_1 | Petrotoga mobilis |
| SBP00209 | American ginseng_1 | Petrotoga mobilis |
| SBP00209 | American ginseng_1 | Phaeobacter gallaeciensis |
| SBP00209 | American ginseng_1 | Phaeobacter gallaeciensis |
| SBP00209 | American ginseng_1 | Phaeobacter inhibens |
| SBP00209 | American ginseng_1 | Phaeobacter inhibens |
| SBP00209 | American ginseng_1 | Phaeobacter piscinae |
| SBP00209 | American ginseng_1 | Phaeobacter piscinae |
| SBP00209 | American ginseng_1 | Phaeobacter porticola |
| SBP00209 | American ginseng_1 | Phaeobacter porticola |
| SBP00209 | American ginseng_1 | Phenylobacterium sp. HYN0004 |
| SBP00209 | American ginseng_1 | Phenylobacterium sp. HYN0004 |
| SBP00209 | American ginseng_1 | Phenylobacterium zucineum |
| SBP00209 | American ginseng_1 | Phenylobacterium zucineum |
| SBP00209 | American ginseng_1 | Photobacterium damselae |
| SBP00209 | American ginseng_1 | Photobacterium damselae |
| SBP00209 | American ginseng_1 | Photobacterium gaetbulicola |
| SBP00209 | American ginseng_1 | Photobacterium gaetbulicola |
| SBP00209 | American ginseng_1 | Photorhabdus asymbiotica |
| SBP00209 | American ginseng_1 | Photorhabdus asymbiotica |
| SBP00209 | American ginseng_1 | Photorhabdus laumondii |
| SBP00209 | American ginseng_1 | Photorhabdus laumondii |
| SBP00209 | American ginseng_1 | Phreatobacter cathodiphilus |
| SBP00209 | American ginseng_1 | Phreatobacter cathodiphilus |
| SBP00209 | American ginseng_1 | Phreatobacter stygius |
| SBP00209 | American ginseng_1 | Phreatobacter stygius |
| SBP00209 | American ginseng_1 | Phycicoccus dokdonensis |
| SBP00209 | American ginseng_1 | Phycicoccus dokdonensis |
| SBP00209 | American ginseng_1 | Phycisphaera mikurensis |
| SBP00209 | American ginseng_1 | Phycisphaera mikurensis |
| SBP00209 | American ginseng_1 | Phyllobacterium zundukense |
| SBP00209 | American ginseng_1 | Phyllobacterium zundukense |
| SBP00209 | American ginseng_1 | Phytobacter ursingii |
| SBP00209 | American ginseng_1 | Phytobacter ursingii |
| SBP00209 | American ginseng_1 | Pigmentiphaga sp. H8 |
| SBP00209 | American ginseng_1 | Pigmentiphaga sp. H8 |
| SBP00209 | American ginseng_1 | Pimelobacter simplex |
| SBP00209 | American ginseng_1 | Pimelobacter simplex |
| SBP00209 | American ginseng_1 | Pirellula staleyi |
| SBP00209 | American ginseng_1 | Pirellula staleyi |
| SBP00209 | American ginseng_1 | Planctomyces sp. SH-PL14 |
| SBP00209 | American ginseng_1 | Planctomyces sp. SH-PL14 |
| SBP00209 | American ginseng_1 | Planctomyces sp. SH-PL62 |
| SBP00209 | American ginseng_1 | Planctomyces sp. SH-PL62 |
| SBP00209 | American ginseng_1 | Planctopirus limnophila |
| SBP00209 | American ginseng_1 | Planctopirus limnophila |
| SBP00209 | American ginseng_1 | Planktothrix agardhii |
| SBP00209 | American ginseng_1 | Planktothrix agardhil |
| SBP00209 | American ginseng_1 | Planococcus antarcticus |

TABLE 3-continued

List of species identified in each metagenomic sample of each SBP Sample

| SBP ID | SBP Host Common Name | Genus sp. |
|---|---|---|
| SBP00209 | American ginseng_1 | *Planococcus antarcticus* |
| SBP00209 | American ginseng_1 | *Planococcus faecalis* |
| SBP00209 | American ginseng_1 | *Planococcus faecalis* |
| SBP00209 | American ginseng_1 | *Planococcus halocryophilus* |
| SBP00209 | American ginseng_1 | *Planococcus halocryophilus* |
| SBP00209 | American ginseng_1 | *Planococcus rifietoensis* |
| SBP00209 | American ginseng_1 | *Planococcus rifietoensis* |
| SBP00209 | American ginseng_1 | *Planococcus* sp. MB-3u-03 |
| SBP00209 | American ginseng_1 | *Planococcus* sp. MB-3u-03 |
| SBP00209 | American ginseng_1 | *Planococcus* sp. Y42 |
| SBP00209 | American ginseng_1 | *Planococcus* sp. Y42 |
| SBP00209 | American ginseng_1 | *Plantactinospora* sp. BB1 |
| SBP00209 | American ginseng_1 | *Plantactinospora* sp. BB1 |
| SBP00209 | American ginseng_1 | *Plantactinospora* sp. BC1 |
| SBP00209 | American ginseng_1 | *Plantactinospora* sp. BC1 |
| SBP00209 | American ginseng_1 | *Plantactinospora* sp. KBS50 |
| SBP00209 | American ginseng_1 | *Plantactinospora* sp. KBS50 |
| SBP00209 | American ginseng_1 | *Plantibacter flavus* |
| SBP00209 | American ginseng_1 | *Plantibacter flavus* |
| SBP00209 | American ginseng_1 | *Plantibacter* sp. |
| SBP00209 | American ginseng_1 | *Plantibacter* sp. |
| SBP00209 | American ginseng_1 | *Plantibacter* sp. PA-3-X8 |
| SBP00209 | American ginseng_1 | *Plantibacter* sp. PA-3-X8 |
| SBP00209 | American ginseng_1 | *Plautia stali* |
| SBP00209 | American ginseng_1 | *Plautia stali* |
| SBP00209 | American ginseng_1 | *Plautia stali symbiont* |
| SBP00209 | American ginseng_1 | *Plautia stali symbiont* |
| SBP00209 | American ginseng_1 | *Pleomorphomonas* sp. SM30 |
| SBP00209 | American ginseng_1 | *Pleamorphomonas* sp. SM30 |
| SBP00209 | American ginseng_1 | *Pleurocapsa minor* |
| SBP00209 | American ginseng_1 | *Pleurocapsa minor* |
| SBP00209 | American ginseng_1 | *Pluralibacter gergoviae* |
| SBP00209 | American ginseng_1 | *Pluralibacter gergoviae* |
| SBP00209 | American ginseng_1 | *Polaribacter reichenbachii* |
| SBP00209 | American ginseng_1 | *Polaribacter reichenbachii* |
| SBP00209 | American ginseng_1 | *Polaribacter* sp. KT 15 |
| SBP00209 | American ginseng_1 | *Polaribacter* sp. KT 15 |
| SBP00209 | American ginseng_1 | *Polaribacter* sp. KT25b |
| SBP00209 | American ginseng_1 | *Polaribacter* sp. KT25b |
| SBP00209 | American ginseng_1 | *Polaribacter* sp. SA4-10 |
| SBP00209 | American ginseng_1 | *Polaribacter* sp. SA4-10 |
| SBP00209 | American ginseng_1 | *Polaribacter* sp. SA4-12 |
| SBP00209 | American ginseng_1 | *Polaribacter* sp. SA4-12 |
| SBP00209 | American ginseng_1 | *Polaribacter vadi* |
| SBP00209 | American ginseng_1 | *Polaribacter vadi* |
| SBP00209 | American ginseng_1 | *Polaromonas naphthalenivorans* |
| SBP00209 | American ginseng_1 | *Polaromonas naphthalenivorans* |
| SBP00209 | American ginseng_1 | *Polaromonas* sp. JS666 |
| SBP00209 | American ginseng_1 | *Polaromonas* sp. JS666 |
| SBP00209 | American ginseng_1 | *Polaromonas* sp. SP1 |
| SBP00209 | American ginseng_1 | *Polaromonas* sp. SP1 |
| SBP00209 | American ginseng_1 | *Polymorphum gilvum* |
| SBP00209 | American ginseng_1 | *Polymorphum gilvum* |
| SBP00209 | American ginseng_1 | *Polynucleobacter acidiphobus* |
| SBP00209 | American ginseng_1 | *Polynucleobacter acidiphobus* |
| SBP00209 | American ginseng_1 | *Polynucleobacter asymbioticus* |
| SBP00209 | American ginseng_1 | *Polynucleobacter asymbioticus* |
| SBP00209 | American ginseng_1 | *Polynucleobacter duraquae* |
| SBP00209 | American ginseng_1 | *Polynucleobacter duraquae* |
| SBP00209 | American ginseng_1 | *Polynucleobacter necessarius* |
| SBP00209 | American ginseng_1 | *Polynucleobacter necessarius* |
| SBP00209 | American ginseng_1 | *Pontibacter actiniarum* |
| SBP00209 | American ginseng_1 | *Pontibacter actiniarum* |
| SBP00209 | American ginseng_1 | *Pontibacter akesuensis* |
| SBP00209 | American ginseng_1 | *Pontibacter akesuensis* |
| SBP00209 | American ginseng_1 | *Porphyrobacter* HT-58-2 |
| SBP00209 | American ginseng_1 | *Porphyrobacter* HT-58-2 |
| SBP00209 | American ginseng_1 | *Porphyrobacter neustonensis* |
| SBP00209 | American ginseng_1 | *Porphyrobacter neustonensis* |
| SBP00209 | American ginseng_1 | *Porphyrobacter* sp. CACIAM 03H1 |
| SBP00209 | American ginseng_1 | *Porphyrobacter* sp. CACIAM 03H1 |
| SBP00209 | American ginseng_1 | *Porphyrobacter* sp. LM 6 |
| SBP00209 | American ginseng_1 | *Porphyrobacter* sp. LM 6 |
| SBP00209 | American ginseng_1 | *Pragia fontium* |
| SBP00209 | American ginseng_1 | *Pragia fontium* |
| SBP00209 | American ginseng_1 | *Prauserella marina* |

TABLE 3-continued

List of species identified in each metagenomic sample of each SBP Sample

| SBP ID | SBP Host Common Name | Genus sp. |
|---|---|---|
| SBP00209 | American ginseng_1 | *Prauserella marina* |
| SBP00209 | American ginseng_1 | *Prevotella denticola* |
| SBP00209 | American ginseng_1 | *Prevotella denticola* |
| SBP00209 | American ginseng_1 | *Prevotella fusca* |
| SBP00209 | American ginseng_1 | *Prevotella fusca* |
| SBP00209 | American ginseng_1 | *Prevotella intermedia* |
| SBP00209 | American ginseng_1 | *Prevotella intermedia* |
| SBP00209 | American ginseng_1 | *Prevotella melaninogenica* |
| SBP00209 | American ginseng_1 | *Prevotella melaninogenica* |
| SBP00209 | American ginseng_1 | *Prochlorococcus marinus* |
| SBP00209 | American ginseng_1 | *Prochlorococcus marinus* |
| SBP00209 | American ginseng_1 | *Propionibacterium acidifaciens* |
| SBP00209 | American ginseng_1 | *Propionibacterium acidifaciens* |
| SBP00209 | American ginseng_1 | *Propionibacterium australiense* |
| SBP00209 | American ginseng_1 | *Propionibacterium australiense* |
| SBP00209 | American ginseng_1 | *Propionibacterium freudenreichii* |
| SBP00209 | American ginseng_1 | *Propionibacterium freudenreichii* |
| SBP00209 | American ginseng_1 | *Propionibacterium* sp. oral taxon 193 |
| SBP00209 | American ginseng_1 | *Propionibacterium* sp. oral taxon 193 |
| SBP00209 | American ginseng_1 | *Proteiniphilum saccharofermentans* |
| SBP00209 | American ginseng_1 | *Proteiniphilum saccharofermentans* |
| SBP00209 | American ginseng_1 | *Proteus hauseri* |
| SBP00209 | American ginseng_1 | *Proteus hauseri* |
| SBP00209 | American ginseng_1 | *Proteus mirabilis* |
| SBP00209 | American ginseng_1 | *Proteus mirabilis* |
| SBP00209 | American ginseng_1 | *Proteus vulgaris* |
| SBP00209 | American ginseng_1 | *Proteus vulgaris* |
| SBP00209 | American ginseng_1 | *Providencia alcalifaciens* |
| SBP00209 | American ginseng_1 | *Providencia alcalifaciens* |
| SBP00209 | American ginseng_1 | *Providencia rettgeri* |
| SBP00209 | American ginseng_1 | *Providencia rettgeri* |
| SBP00209 | American ginseng_1 | *Providencia rustigianii* |
| SBP00209 | American ginseng_1 | *Providencia rustigianii* |
| SBP00209 | American ginseng_1 | *Providencia sneebia* |
| SBP00209 | American ginseng_1 | *Providencia sneebia* |
| SBP00209 | American ginseng_1 | *Providencia stuartii* |
| SBP00209 | American ginseng_1 | *Providencia stuartii* |
| SBP00209 | American ginseng_1 | *Pseudanabaena* sp. ABRG5-3 |
| SBP00209 | American ginseng_1 | *Pseudanabaena* sp. ABRG5-3 |
| SBP00209 | American ginseng_1 | *Pseudanabaena* sp. PCC 7367 |
| SBP00209 | American ginseng_1 | *Pseudanabaena* sp. PCC 7367 |
| SBP00209 | American ginseng_1 | *Pseudarcicella* sp. HME7025 |
| SBP00209 | American ginseng_1 | *Pseudarcicella* sp. HME7025 |
| SBP00209 | American ginseng_1 | *Pseudarthrobacter chlorophenolicus* |
| SBP00209 | American ginseng_1 | *Pseudarthrobacter chlorophenolicus* |
| SBP00209 | American ginseng_1 | *Pseudarthrobacter equi* |
| SBP00209 | American ginseng_1 | *Pseudarthrobacter equi* |
| SBP00209 | American ginseng_1 | *Pseudarthrobacter phenanthrenivorans* |
| SBP00209 | American ginseng_1 | *Pseudarthrobacter phenanthrenivorans* |
| SBP00209 | American ginseng_1 | *Pseudarthrobacter sulfonivorans* |
| SBP00209 | American ginseng_1 | *Pseudarthrobacter sulfonivorans* |
| SBP00209 | American ginseng_1 | *Pseudoalteromonas agarivorans* |
| SBP00209 | American ginseng_1 | *Pseudoalteromonas agarivorans* |
| SBP00209 | American ginseng_1 | *Pseudoalteromonas arctica* |
| SBP00209 | American ginseng_1 | *Pseudoalteromonas arctica* |
| SBP00209 | American ginseng_1 | *Pseudoalteromonas atlantica* |
| SBP00209 | American ginseng_1 | *Pseudoalteromonas atlantica* |
| SBP00209 | American ginseng_1 | *Pseudoalteromonas donghaensis* |
| SBP00209 | American ginseng_1 | *Pseudoalteromonas donghaensis* |
| SBP00209 | American ginseng_1 | *Pseudoalteromonas luteoviolacea* |
| SBP00209 | American ginseng_1 | *Pseudoalteromonas luteoviolacea* |
| SBP00209 | American ginseng_1 | *Pseudoalteromonas phenolica* |
| SBP00209 | American ginseng_1 | *Pseudoalteromonas phenolica* |
| SBP00209 | American ginseng_1 | *Pseudoalteromonas piscicida* |
| SBP00209 | American ginseng_1 | *Pseudoalteromonas piscicida* |
| SBP00209 | American ginseng_1 | *Pseudoalteromonas* sp. 1_2015MBL_MicDiv |
| SBP00209 | American ginseng_1 | *Pseudoalteromonas* sp. 1_2015MBL_MicDiv |
| SBP00209 | American ginseng_1 | *Pseudoalteromonas* sp. DL-6 |
| SBP00209 | American ginseng_1 | *Pseudoalteromonas* sp. DL-6 |
| SBP00209 | American ginseng_1 | *Pseudoalteromonas* sp. R3 |
| SBP00209 | American ginseng_1 | *Pseudoalteromonas* sp. R3 |
| SBP00209 | American ginseng_1 | *Pseudoalteromonas tunicata* |
| SBP00209 | American ginseng_1 | *Pseudoalteromonas tunicata* |
| SBP00209 | American ginseng_1 | *Pseudoclostridium thermosuccinogenes* |
| SBP00209 | American ginseng_1 | *Pseudoclostridium thermosuccinogenes* |
| SBP00209 | American ginseng_1 | *Pseudodesulfovibrio indicus* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Pseudodesulfovibrio indicus* |
| SBP00209 | American ginseng_1 | *Pseudodesulfovibrio piezophilus* |
| SBP00209 | American ginseng_1 | *Pseudodesulfovibrio piezophilus* |
| SBP00209 | American ginseng_1 | *Pseudodesulfovibrio profundus* |
| SBP00209 | American ginseng_1 | *Pseudodesulfovibrio profundus* |
| SBP00209 | American ginseng_1 | *Pseudoflavitalea* sp. 5GH32-13 |
| SBP00209 | American ginseng_1 | *Pseudoflavitalea* sp. 5GH32-13 |
| SBP00209 | American ginseng_1 | *Pseudogulbenkiania* sp. NH88 |
| SBP00209 | American ginseng_1 | *Pseudogulbenkiania* sp. NH88 |
| SBP00209 | American ginseng_1 | *Pseudolabrys taiwanensis* |
| SBP00209 | American ginseng_1 | *Pseudolabrys taiwanensis* |
| SBP00209 | American ginseng_1 | *Pseudomonas aeruginosa* |
| SBP00209 | American ginseng_1 | *Pseudomonas aeruginosa* |
| SBP00209 | American ginseng_1 | *Pseudomonas agarici* |
| SBP00209 | American ginseng_1 | *Pseudomonas agarici* |
| SBP00209 | American ginseng_1 | *Pseudomonas alcaligenes* |
| SBP00209 | American ginseng_1 | *Pseudomonas alcaligenes* |
| SBP00209 | American ginseng_1 | *Pseudomonas alcaliphila* |
| SBP00209 | American ginseng_1 | *Pseudomonas alcaliphila* |
| SBP00209 | American ginseng_1 | *Pseudomonas alkylphenolica* |
| SBP00209 | American ginseng_1 | *Pseudomonas alkylphenolica* |
| SBP00209 | American ginseng_1 | *Pseudomonas antarctica* |
| SBP00209 | American ginseng_1 | *Pseudomonas antarctica* |
| SBP00209 | American ginseng_1 | *Pseudomonas arsenicoxydans* |
| SBP00209 | American ginseng_1 | *Pseudomonas arsenicoxydans* |
| SBP00209 | American ginseng_1 | *Pseudomonas asplenii* |
| SBP00209 | American ginseng_1 | *Pseudomonas asplenii* |
| SBP00209 | American ginseng_1 | *Pseudomonas azotoformans* |
| SBP00209 | American ginseng_1 | *Pseudomonas azotoformans* |
| SBP00209 | American ginseng_1 | *Pseudomonas balearica* |
| SBP00209 | American ginseng_1 | *Pseudomonas balearica* |
| SBP00209 | American ginseng_1 | *Pseudomonas brassicacearum* |
| SBP00209 | American ginseng_1 | *Pseudomonas brassicacearum* |
| SBP00209 | American ginseng_1 | *Pseudomonas brenneri* |
| SBP00209 | American ginseng_1 | *Pseudomonas brenneri* |
| SBP00209 | American ginseng_1 | *Pseudomonas cedrina* |
| SBP00209 | American ginseng_1 | *Pseudomonas cedrina* |
| SBP00209 | American ginseng_1 | *Pseudomonas chlororaphis* |
| SBP00209 | American ginseng_1 | *Pseudomonas chlororaphis* |
| SBP00209 | American ginseng_1 | *Pseudomonas cichorii* |
| SBP00209 | American ginseng_1 | *Pseudomonas cichorii* |
| SBP00209 | American ginseng_1 | *Pseudomonas citronellolis* |
| SBP00209 | American ginseng_1 | *Pseudomonas citronellolis* |
| SBP00209 | American ginseng_1 | *Pseudomonas corrugata* |
| SBP00209 | American ginseng_1 | *Pseudomonas corrugata* |
| SBP00209 | American ginseng_1 | *Pseudomonas cremoricolorata* |
| SBP00209 | American ginseng_1 | *Pseudomonas cremoricolorata* |
| SBP00209 | American ginseng_1 | *Pseudomonas entomophila* |
| SBP00209 | American ginseng_1 | *Pseudomonas entomophila* |
| SBP00209 | American ginseng_1 | *Pseudomonas extremaustralis* |
| SBP00209 | American ginseng_1 | *Pseudomonas extremaustralis* |
| SBP00209 | American ginseng_1 | *Pseudomonas extremorientalis* |
| SBP00209 | American ginseng_1 | *Pseudomonas extremorientalis* |
| SBP00209 | American ginseng_1 | *Pseudomonas fluorescens* |
| SBP00209 | American ginseng_1 | *Pseudomonas fluorescens* |
| SBP00209 | American ginseng_1 | *Pseudomonas fragi* |
| SBP00209 | American ginseng_1 | *Pseudomonas fragi* |
| SBP00209 | American ginseng_1 | *Pseudomonas frederiksbergensis* |
| SBP00209 | American ginseng_1 | *Pseudomonas frederiksbergensis* |
| SBP00209 | American ginseng_1 | *Pseudomonas fulva* |
| SBP00209 | American ginseng_1 | *Pseudomonas fulva* |
| SBP00209 | American ginseng_1 | *Pseudomonas furukawaii* |
| SBP00209 | American ginseng_1 | *Pseudomonas furukawaii* |
| SBP00209 | American ginseng_1 | *Pseudomonas fuscovaginae* |
| SBP00209 | American ginseng_1 | *Pseudomonas fuscovaginae* |
| SBP00209 | American ginseng_1 | *Pseudomonas granadensis* |
| SBP00209 | American ginseng_1 | *Pseudomonas granadensis* |
| SBP00209 | American ginseng_1 | *Pseudomonas guangdongensis* |
| SBP00209 | American ginseng_1 | *Pseudomonas guangdongensis* |
| SBP00209 | American ginseng_1 | *Pseudomonas knackmussii* |
| SBP00209 | American ginseng_1 | *Pseudomonas knackmussii* |
| SBP00209 | American ginseng_1 | *Pseudomonas koreensis* |
| SBP00209 | American ginseng_1 | *Pseudomonas koreensis* |
| SBP00209 | American ginseng_1 | *Pseudomonas kribbensis* |
| SBP00209 | American ginseng_1 | *Pseudomonas kribbensis* |
| SBP00209 | American ginseng_1 | *Pseudomonas libanensis* |

TABLE 3-continued

List of species identified in each metagenomic sample of each SBP Sample

| SBP ID | SBP Host Common Name | Genus sp. |
|---|---|---|
| SBP00209 | American ginseng_1 | *Pseudomonas libanensis* |
| SBP00209 | American ginseng_1 | *Pseudomonas lini* |
| SBP00209 | American ginseng_1 | *Pseudomonas lini* |
| SBP00209 | American ginseng_1 | *Pseudomonas litoralis* |
| SBP00209 | American ginseng_1 | *Pseudomonas litoralis* |
| SBP00209 | American ginseng_1 | *Pseudomonas lurida* |
| SBP00209 | American ginseng_1 | *Pseudomonas lurida* |
| SBP00209 | American ginseng_1 | *Pseudomonas mandelii* |
| SBP00209 | American ginseng_1 | *Pseudomonas mandelii* |
| SBP00209 | American ginseng_1 | *Pseudomonas mediterranea* |
| SBP00209 | American ginseng_1 | *Pseudomonas mediterranea* |
| SBP00209 | American ginseng_1 | *Pseudomonas mendocina* |
| SBP00209 | American ginseng_1 | *Pseudomonas mendocina* |
| SBP00209 | American ginseng_1 | *Pseudomonas monteilii* |
| SBP00209 | American ginseng_1 | *Pseudomonas monteilii* |
| SBP00209 | American ginseng_1 | *Pseudomonas moraviensis* |
| SBP00209 | American ginseng_1 | *Pseudomonas moraviensis* |
| SBP00209 | American ginseng_1 | *Pseudomonas mosseili* |
| SBP00209 | American ginseng_1 | *Pseudomonas mosselii* |
| SBP00209 | American ginseng_1 | *Pseudomonas mucidolens* |
| SBP00209 | American ginseng_1 | *Pseudomonas mucidolens* |
| SBP00209 | American ginseng_1 | *Pseudomonas orientalis* |
| SBP00209 | American ginseng_1 | *Pseudomonas orientalis* |
| SBP00209 | American ginseng_1 | *Pseudomonas oryzae* |
| SBP00209 | American ginseng_1 | *Pseudomonas oryzae* |
| SBP00209 | American ginseng_1 | *Pseudomonas oryzihabitans* |
| SBP00209 | American ginseng_1 | *Pseudomonas oryzihabitans* |
| SBP00209 | American ginseng_1 | *Pseudomonas palleroniana* |
| SBP00209 | American ginseng_1 | *Pseudomonas palleroniana* |
| SBP00209 | American ginseng_1 | *Pseudomonas parafulva* |
| SBP00209 | American ginseng_1 | *Pseudomonas parafulva* |
| SBP00209 | American ginseng_1 | *Pseudomonas phage* PaBG |
| SBP00209 | American ginseng_1 | *Pseudomonas phage* PaBG |
| SBP00209 | American ginseng_1 | *Pseudomonas plecoglossicida* |
| SBP00209 | American ginseng_1 | *Pseudomonas plecoglossicida* |
| SBP00209 | American ginseng_1 | *Pseudomonas poae* |
| SBP00209 | American ginseng_1 | *Pseudomonas poae* |
| SBP00209 | American ginseng_1 | *Pseudomonas pohangensis* |
| SBP00209 | American ginseng_1 | *Pseudomonas pohangensis* |
| SBP00209 | American ginseng_1 | *Pseudomonas prosekii* |
| SBP00209 | American ginseng_1 | *Pseudomonas prosekii* |
| SBP00209 | American ginseng_1 | *Pseudomonas protegens* |
| SBP00209 | American ginseng_1 | *Pseudomonas protegens* |
| SBP00209 | American ginseng_1 | *Pseudomonas psychrophila* |
| SBP00209 | American ginseng_1 | *Pseudomonas psychrophila* |
| SBP00209 | American ginseng_1 | *Pseudomonas psychrotolerans* |
| SBP00209 | American ginseng_1 | *Pseudomonas psychrotolerans* |
| SBP00209 | American ginseng_1 | *Pseudomonas putida* |
| SBP00209 | American ginseng_1 | *Pseudomonas putida* |
| SBP00209 | American ginseng_1 | *Pseudomonas reinekei* |
| SBP00209 | American ginseng_1 | *Pseudomonas reinekei* |
| SBP00209 | American ginseng_1 | *Pseudomonas resinovorans* |
| SBP00209 | American ginseng_1 | *Pseudomonas resinovorans* |
| SBP00209 | American ginseng_1 | *Pseudomonas rhizosphaerae* |
| SBP00209 | American ginseng_1 | *Pseudomonas rhizosphaerae* |
| SBP00209 | American ginseng_1 | *Pseudomonas rhodesiae* |
| SBP00209 | American ginseng_1 | *Pseudomonas rhodesiae* |
| SBP00209 | American ginseng_1 | *Pseudomonas sabulinigri* |
| SBP00209 | American ginseng_1 | *Pseudomonas sabulinigri* |
| SBP00209 | American ginseng_1 | *Pseudomonas salegens* |
| SBP00209 | American ginseng_1 | *Pseudomonas salegens* |
| SBP00209 | American ginseng_1 | *Pseudomonas saudiphocaensis* |
| SBP00209 | American ginseng_1 | *Pseudomonas saudiphocaensis* |
| SBP00209 | American ginseng_1 | *Pseudomonas savastanoi* |
| SBP00209 | American ginseng_1 | *Pseudomonas savastanoi* |
| SBP00209 | American ginseng_1 | *Pseudomonas sihuiensis* |
| SBP00209 | American ginseng_1 | *Pseudomonas sihuiensis* |
| SBP00209 | American ginseng_1 | *Pseudomonas silesiensis* |
| SBP00209 | American ginseng_1 | *Pseudomonas silesiensis* |
| SBP00209 | American ginseng_1 | *Pseudomonas simiae* |
| SBP00209 | American ginseng_1 | *Pseudomonas simiae* |
| SBP00209 | American ginseng_1 | *Pseudomonas soli* |
| SBP00209 | American ginseng_1 | *Pseudomonas soli* |
| SBP00209 | American ginseng_1 | *Pseudomonas sp.* |
| SBP00209 | American ginseng_1 | *Pseudomonas sp.* |
| SBP00209 | American ginseng_1 | *Pseudomonas sp.* 02C 26 |

TABLE 3-continued

List of species identified in each metagenomic sample of each SBP Sample

| SBP ID | SBP Host Common Name | Genus sp. |
|---|---|---|
| SBP00209 | American ginseng_1 | *Pseudomonas* sp. 02C 26 |
| SBP00209 | American ginseng_1 | *Pseudomonas* sp. 09C 129 |
| SBP00209 | American ginseng_1 | *Pseudomonas* sp. 09C 129 |
| SBP00209 | American ginseng_1 | *Pseudomonas* sp. 31-12 |
| SBP00209 | American ginseng_1 | *Pseudomonas* sp. 31-12 |
| SBP00209 | American ginseng_1 | *Pseudomonas* sp. 7SR1 |
| SBP00209 | American ginseng_1 | *Pseudomonas* sp. 7SR1 |
| SBP00209 | American ginseng_1 | *Pseudomonas* sp. A214 |
| SBP00209 | American ginseng_1 | *Pseudomonas* sp. A214 |
| SBP00209 | American ginseng_1 | *Pseudomonas* sp. ATCC 13867 |
| SBP00209 | American ginseng_1 | *Pseudomonas* sp. ATCC 13867 |
| SBP00209 | American ginseng_1 | *Pseudomonas* sp. B10 |
| SBP00209 | American ginseng_1 | *Pseudomonas* sp. B10 |
| SBP00209 | American ginseng_1 | *Pseudomonas* sp. CC6-YY-74 |
| SBP00209 | American ginseng_1 | *Pseudomonas* sp. CC6-YY-74 |
| SBP00209 | American ginseng_1 | *Pseudomonas* sp. CCOS 191 |
| SBP00209 | American ginseng_1 | *Pseudomonas* sp. CCOS 191 |
| SBP00209 | American ginseng_1 | *Pseudomonas* sp. CMR12a |
| SBP00209 | American ginseng_1 | *Pseudomonas* sp. CMR12a |
| SBP00209 | American ginseng_1 | *Pseudomonas* sp. CMR5c |
| SBP00209 | American ginseng_1 | *Pseudomonas* sp. CMR5c |
| SBP00209 | American ginseng_1 | *Pseudomonas* sp. DR 5-09 |
| SBP00209 | American ginseng_1 | *Pseudomonas* sp. DR 5-09 |
| SBP00209 | American ginseng_1 | *Pseudomonas* sp. DY-1 |
| SBP00209 | American ginseng_1 | *Pseudomonas* sp. DY-1 |
| SBP00209 | American ginseng_1 | *Pseudomonas* sp. FDAARGOS_380 |
| SBP00209 | American ginseng_1 | *Pseudomonas* sp. FDAARGOS_380 |
| SBP00209 | American ginseng_1 | *Pseudomonas* sp. FGI182 |
| SBP00209 | American ginseng_1 | *Pseudomonas* sp. FGI182 |
| SBP00209 | American ginseng_1 | *Pseudomonas* sp. GR 6-02 |
| SBP00209 | American ginseng_1 | *Pseudomonas* sp. GR 6-02 |
| SBP00209 | American ginseng_1 | *Pseudomonas* sp. HLS-6 |
| SBP00209 | American ginseng_1 | *Pseudomonas* sp. HLS-6 |
| SBP00209 | American ginseng_1 | *Pseudomonas* sp. K2W31S-8 |
| SBP00209 | American ginseng_1 | *Pseudomonas* sp. K2W31S-8 |
| SBP00209 | American ginseng_1 | *Pseudomonas* sp. LAB-08 |
| SBP00209 | American ginseng_1 | *Pseudomonas* sp. LAB-08 |
| SBP00209 | American ginseng_1 | *Pseudomonas* sp. LBUM920 |
| SBP00209 | American ginseng_1 | *Pseudomonas* sp. LBUM920 |
| SBP00209 | American ginseng_1 | *Pseudomonas* sp. Leaf58 |
| SBP00209 | American ginseng_1 | *Pseudomonas* sp. Leaf58 |
| SBP00209 | American ginseng_1 | *Pseudomonas* sp. LG1D9 |
| SBP00209 | American ginseng_1 | *Pseudomonas* sp. LG1D9 |
| SBP00209 | American ginseng_1 | *Pseudomonas* sp. LG1E9 |
| SBP00209 | American ginseng_1 | *Pseudomonas* sp. LG1E9 |
| SBP00209 | American ginseng_1 | *Pseudomonas* sp. LH1G9 |
| SBP00209 | American ginseng_1 | *Pseudomonas* sp. LH1G9 |
| SBP00209 | American ginseng_1 | *Pseudomonas* sp. LPH1 |
| SBP00209 | American ginseng_1 | *Pseudomonas* sp. LPH1 |
| SBP00209 | American ginseng_1 | *Pseudomonas* sp. LTJR-52 |
| SBP00209 | American ginseng_1 | *Pseudomonas* sp. LTJR-52 |
| SBP00209 | American ginseng_1 | *Pseudomonas* sp. Lz4W |
| SBP00209 | American ginseng_1 | *Pseudomonas* sp. Lz4W |
| SBP00209 | American ginseng_1 | *Pseudomonas* sp. M30-35 |
| SBP00209 | American ginseng_1 | *Pseudomonas* sp. M30-35 |
| SBP00209 | American ginseng_1 | *Pseudomonas* sp. MRSN12121 |
| SBP00209 | American ginseng_1 | *Pseudomonas* sp. MRSN12121 |
| SBP00209 | American ginseng_1 | *Pseudomonas* sp. MYb193 |
| SBP00209 | American ginseng_1 | *Pseudomonas* sp. MYb193 |
| SBP00209 | American ginseng_1 | *Pseudomonas* sp. NS1(2017) |
| SBP00209 | American ginseng_1 | *Pseudomonas* sp. NS1(2017) |
| SBP00209 | American ginseng_1 | *Pseudomonas* sp. Os17 |
| SBP00209 | American ginseng_1 | *Pseudomonas* sp. Os17 |
| SBP00209 | American ginseng_1 | *Pseudomonas* sp. PONIH3 |
| SBP00209 | American ginseng_1 | *Pseudomonas* sp. PONIH3 |
| SBP00209 | American ginseng_1 | *Pseudomonas* sp. R2A2 |
| SBP00209 | American ginseng_1 | *Pseudomonas* sp. R2A2 |
| SBP00209 | American ginseng_1 | *Pseudomonas* sp. R3-18-08 |
| SBP00209 | American ginseng_1 | *Pseudomonas* sp. R3-18-08 |
| SBP00209 | American ginseng_1 | *Pseudomonas* sp. R3-52-08 |
| SBP00209 | American ginseng_1 | *Pseudomonas* sp. R3-52-08 |
| SBP00209 | American ginseng_1 | *Pseudomonas* sp. R4-39-08 |
| SBP00209 | American ginseng_1 | *Pseudomonas* sp. R4-39-08 |
| SBP00209 | American ginseng_1 | *Pseudomonas* sp. R5-89-07 |
| SBP00209 | American ginseng_1 | *Pseudomonas* sp. R5-89-07 |
| SBP00209 | American ginseng_1 | *Pseudomonas* sp. RU47 |

TABLE 3-continued

List of species identified in each metagenomic sample of each SBP Sample

| SBP ID | SBP Host Common Name | Genus sp. |
|---|---|---|
| SBP00209 | American ginseng_1 | Pseudomonas sp. RU47 |
| SBP00209 | American ginseng_1 | Pseudomonas sp. S-6-2 |
| SBP00209 | American ginseng_1 | Pseudomonas sp. S-6-2 |
| SBP00209 | American ginseng_1 | Pseudomonas sp. S09G 359 |
| SBP00209 | American ginseng_1 | Pseudomonas sp. S09G 359 |
| SBP00209 | American ginseng_1 | Pseudomonas sp. s211(2017) |
| SBP00209 | American ginseng_1 | Pseudomonas sp. s211(2017) |
| SBP00209 | American ginseng_1 | Pseudomonas sp. SGAir0191 |
| SBP00209 | American ginseng_1 | Pseudomonas sp. SGAir0191 |
| SBP00209 | American ginseng_1 | Pseudomonas sp. St29 |
| SBP00209 | American ginseng_1 | Pseudomonas sp. St29 |
| SBP00209 | American ginseng_1 | Pseudomonas sp. StFLB209 |
| SBP00209 | American ginseng_1 | Pseudomonas sp. StFLB209 |
| SBP00209 | American ginseng_1 | Pseudomonas sp. TCU-HL1 |
| SBP00209 | American ginseng_1 | Pseudomonas sp. TCU-HL1 |
| SBP00209 | American ginseng_1 | Pseudomonas sp. TKP |
| SBP00209 | American ginseng_1 | Pseudomonas sp. TKP |
| SBP00209 | American ginseng_1 | Pseudomonas sp. URMO17WK12:I11 |
| SBP00209 | American ginseng_1 | Pseudomonas sp. URMO17WK12:I11 |
| SBP00209 | American ginseng_1 | Pseudomonas sp. UW4 |
| SBP00209 | American ginseng_1 | Pseudomonas sp. UW4 |
| SBP00209 | American ginseng_1 | Pseudomonas sp. Z003-0.4C(8344-21) |
| SBP00209 | American ginseng_1 | Pseudomonas sp. Z003-0.4C(8344-21) |
| SBP00209 | American ginseng_1 | Pseudomonas stutzeri |
| SBP00209 | American ginseng_1 | Pseudomonas stutzeri |
| SBP00209 | American ginseng_1 | Pseudomonas synxantha |
| SBP00209 | American ginseng_1 | Pseudomonas synxantha |
| SBP00209 | American ginseng_1 | Pseudomonas syringae |
| SBP00209 | American ginseng_1 | Pseudomonas syringae |
| SBP00209 | American ginseng_1 | Pseudomonas taetrolens |
| SBP00209 | American ginseng_1 | Pseudomonas taetrolens |
| SBP00209 | American ginseng_1 | Pseudomonas thivervalensis |
| SBP00209 | American ginseng_1 | Pseudomonas thivervalensis |
| SBP00209 | American ginseng_1 | Pseudomonas tolaasii |
| SBP00209 | American ginseng_1 | Pseudomonas tolaasii |
| SBP00209 | American ginseng_1 | Pseudomonas trivialis |
| SBP00209 | American ginseng_1 | Pseudomonas trivialis |
| SBP00209 | American ginseng_1 | Pseudomonas umsongensis |
| SBP00209 | American ginseng_1 | Pseudomonas umsongensis |
| SBP00209 | American ginseng_1 | Pseudomonas vancouverensis |
| SBP00209 | American ginseng_1 | Pseudomonas vancouverensis |
| SBP00209 | American ginseng_1 | Pseudomonas veronii |
| SBP00209 | American ginseng_1 | Pseudomonas veronii |
| SBP00209 | American ginseng_1 | Pseudomonas versuta |
| SBP00209 | American ginseng_1 | Pseudomonas versuta |
| SBP00209 | American ginseng_1 | Pseudomonas viridiflava |
| SBP00209 | American ginseng_1 | Pseudomonas viridiflava |
| SBP00209 | American ginseng_1 | Pseudomonas xanthomarina |
| SBP00209 | American ginseng_1 | Pseudomonas xanthomarina |
| SBP00209 | American ginseng_1 | Pseudomonas xinjiangensis |
| SBP00209 | American ginseng_1 | Pseudomonas xinjiangensis |
| SBP00209 | American ginseng_1 | Pseudomonas yamanorum |
| SBP00209 | American ginseng_1 | Pseudomonas yamanorum |
| SBP00209 | American ginseng_1 | Pseudonocardia autotrophica |
| SBP00209 | American ginseng_1 | Pseudonocardia autotrophica |
| SBP00209 | American ginseng_1 | Pseudonocardia dioxanivorans |
| SBP00209 | American ginseng_1 | Pseudonocardia dioxanivorans |
| SBP00209 | American ginseng_1 | Pseudonocardia sp. AL041005-10 |
| SBP00209 | American ginseng_1 | Pseudonocardia sp. AL041005-10 |
| SBP00209 | American ginseng_1 | Pseudonocardia sp. HH130629-09 |
| SBP00209 | American ginseng_1 | Pseudonocardia sp. HH130629-09 |
| SBP00209 | American ginseng_1 | Pseudonocardia sp. HH130630-07 |
| SBP00209 | American ginseng_1 | Pseudonocardia sp. HH130630-07 |
| SBP00209 | American ginseng_1 | Pseudopedobacter saltans |
| SBP00209 | American ginseng_1 | Pseudopedobacter saltans |
| SBP00209 | American ginseng_1 | Pseudopropionibacterium propionicum |
| SBP00209 | American ginseng_1 | Pseudopropionibacterium propionicum |
| SBP00209 | American ginseng_1 | Pseudorhodoplanes sinuspersici |
| SBP00209 | American ginseng_1 | Pseudorhodoplanes sinuspersici |
| SBP00209 | American ginseng_1 | Pseudovibrio sp. FO-BEG1 |
| SBP00209 | American ginseng_1 | Pseudovibrio sp. FO-BEG1 |
| SBP00209 | American ginseng_1 | Pseudoxanthomonas spadix |
| SBP00209 | American ginseng_1 | Pseudoxanthomonas spadix |
| SBP00209 | American ginseng_1 | Pseudoxanthomonas suwonensis |
| SBP00209 | American ginseng_1 | Pseudoxanthomonas suwonensis |
| SBP00209 | American ginseng_1 | Psychrobacter sp. P11G3 |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Psychrobacter* sp. P11G3 |
| SBP00209 | American ginseng_1 | *Psychrobacter* sp. PRwf-1 |
| SBP00209 | American ginseng_1 | *Psychrobacter* sp. PRwf-1 |
| SBP00209 | American ginseng_1 | *Psychrobacter urativorans* |
| SBP00209 | American ginseng_1 | *Psychrobacter urativorans* |
| SBP00209 | American ginseng_1 | *Psychroflexus torquis* |
| SBP00209 | American ginseng_1 | *Psychroflexus torquis* |
| SBP00209 | American ginseng_1 | *Psychromicrobium lacuslunae* |
| SBP00209 | American ginseng_1 | *Psychromicrobium lacuslunae* |
| SBP00209 | American ginseng_1 | *Psychromonas ingrahamii* |
| SBP00209 | American ginseng_1 | *Psychromonas ingrahamii* |
| SBP00209 | American ginseng_1 | *Psychromonas* sp. CNPT3 |
| SBP00209 | American ginseng_1 | *Psychromonas* sp. CNPT3 |
| SBP00209 | American ginseng_1 | *Pusillimonas* sp. T7-7 |
| SBP00209 | American ginseng_1 | *Pusillimonas* sp. T7-7 |
| SBP00209 | American ginseng_1 | *Pyrococcus furiosus* |
| SBP00209 | American ginseng_1 | *Pyrococcus furiosus* |
| SBP00209 | American ginseng_1 | *Qipengyuania sediminis* |
| SBP00209 | American ginseng_1 | *Qipengyuania sediminis* |
| SBP00209 | American ginseng_1 | *Rahnella aquatilis* |
| SBP00209 | American ginseng_1 | *Rahnella aquatilis* |
| SBP00209 | American ginseng_1 | *Rahnella* sp. ERMR1:05 |
| SBP00209 | American ginseng_1 | *Rahnella* sp. ERMR1:05 |
| SBP00209 | American ginseng_1 | *Rahnella* sp. Y9602 |
| SBP00209 | American ginseng_1 | *Rahnella* sp. Y9602 |
| SBP00209 | American ginseng_1 | *Ralstonia insidiosa* |
| SBP00209 | American ginseng_1 | *Ralstonia insidiosa* |
| SBP00209 | American ginseng_1 | *Ralstonia mannitolilytica* |
| SBP00209 | American ginseng_1 | *Ralstonia mannitolilytica* |
| SBP00209 | American ginseng_1 | *Ralstonia pickettii* |
| SBP00209 | American ginseng_1 | *Ralstonia pickettii* |
| SBP00209 | American ginseng_1 | *Ralstonia solanacearum* |
| SBP00209 | American ginseng_1 | *Ralstonia solanacearum* |
| SBP00209 | American ginseng_1 | *Ramlibacter tataouinensis* |
| SBP00209 | American ginseng_1 | *Ramlibacter tataouinensis* |
| SBP00209 | American ginseng_1 | *Raoultella ornithinolytica* |
| SBP00209 | American ginseng_1 | *Raoultella ornithinolytica* |
| SBP00209 | American ginseng_1 | *Raoultella planticola* |
| SBP00209 | American ginseng_1 | *Raoultella planticola* |
| SBP00209 | American ginseng_1 | *Raoultella terrigena* |
| SBP00209 | American ginseng_1 | *Raoultella terrigena* |
| SBP00209 | American ginseng_1 | *Rathayibacter festucae* |
| SBP00209 | American ginseng_1 | *Rathayibacter festucae* |
| SBP00209 | American ginseng_1 | *Rathayibacter iranicus* |
| SBP00209 | American ginseng_1 | *Rathayibacter iranicus* |
| SBP00209 | American ginseng_1 | *Rathayibacter rathayi* |
| SBP00209 | American ginseng_1 | *Rathayibacter rathayi* |
| SBP00209 | American ginseng_1 | *Rathayibacter toxicus* |
| SBP00209 | American ginseng_1 | *Rathayibacter toxicus* |
| SBP00209 | American ginseng_1 | *Rathayibacter tritici* |
| SBP00209 | American ginseng_1 | *Rathayibacter tritici* |
| SBP00209 | American ginseng_1 | *Reinekea forsetii* |
| SBP00209 | American ginseng_1 | *Reinekea forsetii* |
| SBP00209 | American ginseng_1 | *Rhizobacter gummiphilus* |
| SBP00209 | American ginseng_1 | *Rhizobacter gummiphilus* |
| SBP00209 | American ginseng_1 | *Rhizobium acidisoli* |
| SBP00209 | American ginseng_1 | *Rhizobium acidisoli* |
| SBP00209 | American ginseng_1 | *Rhizobium etli* |
| SBP00209 | American ginseng_1 | *Rhizobium etli* |
| SBP00209 | American ginseng_1 | *Rhizobium favelukesii* |
| SBP00209 | American ginseng_1 | *Rhizobium favelukesii* |
| SBP00209 | American ginseng_1 | *Rhizobium gallicum* |
| SBP00209 | American ginseng_1 | *Rhizobium gallicum* |
| SBP00209 | American ginseng_1 | *Rhizobium jaguaris* |
| SBP00209 | American ginseng_1 | *Rhizobium jaguaris* |
| SBP00209 | American ginseng_1 | *Rhizobium leguminosarum* |
| SBP00209 | American ginseng_1 | *Rhizobium leguminosarum* |
| SBP00209 | American ginseng_1 | *Rhizobium phaseoli* |
| SBP00209 | American ginseng_1 | *Rhizobium phaseoli* |
| SBP00209 | American ginseng_1 | *Rhizobium* sp. 11515TR |
| SBP00209 | American ginseng_1 | *Rhizobium* sp. 11515TR |
| SBP00209 | American ginseng_1 | *Rhizobium* sp. ACO-34A |
| SBP00209 | American ginseng_1 | *Rhizobium* sp. ACO-34A |
| SBP00209 | American ginseng_1 | *Rhizobium* sp. CIAT894 |
| SBP00209 | American ginseng_1 | *Rhizobium* sp. CIAT894 |
| SBP00209 | American ginseng_1 | *Rhizobium* sp. IE4771 |

TABLE 3-continued

List of species identified in each metagenomic sample of each SBP Sample

| SBP ID | SBP Host Common Name | Genus sp. |
|---|---|---|
| SBP00209 | American ginseng_1 | Rhizobium sp. IE4771 |
| SBP00209 | American ginseng_1 | Rhizobium sp. Kim5 |
| SBP00209 | American ginseng_1 | Rhizobium sp. Kim5 |
| SBP00209 | American ginseng_1 | Rhizobium sp. N324 |
| SBP00209 | American ginseng_1 | Rhizobium sp. N324 |
| SBP00209 | American ginseng_1 | Rhizobium sp. NT-26 |
| SBP00209 | American ginseng_1 | Rhizobium sp. NT-26 |
| SBP00209 | American ginseng_1 | Rhizobium sp. NXC14 |
| SBP00209 | American ginseng_1 | Rhizobium sp. NXC14 |
| SBP00209 | American ginseng_1 | Rhizobium sp. NXC24 |
| SBP00209 | American ginseng_1 | Rhizobium sp. NXC24 |
| SBP00209 | American ginseng_1 | Rhizobium tropici |
| SBP00209 | American ginseng_1 | Rhizobium tropici |
| SBP00209 | American ginseng_1 | Rhizorhabdus dicambivorans |
| SBP00209 | American ginseng_1 | Rhizarhabdus dicambivorans |
| SBP00209 | American ginseng_1 | Rhodanobacter denitrificans |
| SBP00209 | American ginseng_1 | Rhodanobacter denitrificans |
| SBP00209 | American ginseng_1 | Rhodanobacteraceae bacterium Dysh456 |
| SBP00209 | American ginseng_1 | Rhodanobacteraceae bacterium Dysh456 |
| SBP00209 | American ginseng_1 | Rhodobaca barguzinensis |
| SBP00209 | American ginseng_1 | Rhodobaca barguzinensis |
| SBP00209 | American ginseng_1 | Rhodobacter blasticus |
| SBP00209 | American ginseng_1 | Rhodobacter blasticus |
| SBP00209 | American ginseng_1 | Rhodobacter capsulatus |
| SBP00209 | American ginseng_1 | Rhodobacter capsulatus |
| SBP00209 | American ginseng_1 | Rhodobacter sp. CZR27 |
| SBP00209 | American ginseng_1 | Rhodobacter sp. CZR27 |
| SBP00209 | American ginseng_1 | Rhodobacter sp. LPB0142 |
| SBP00209 | American ginseng_1 | Rhodobacter sp. LPB0142 |
| SBP00209 | American ginseng_1 | Rhodobacter sphaeroides |
| SBP00209 | American ginseng_1 | Rhodobacter sphaeroides |
| SBP00209 | American ginseng_1 | Rhodobacteraceae bacterium BAR1 |
| SBP00209 | American ginseng_1 | Rhodobacteraceae bacterium BAR1 |
| SBP00209 | American ginseng_1 | Rhodobacteraceae bacterium QY30 |
| SBP00209 | American ginseng_1 | Rhodobacteraceae bacterium QY30 |
| SBP00209 | American ginseng_1 | Rhodobiaceae bacterium |
| SBP00209 | American ginseng_1 | Rhodobiaceae bacterium |
| SBP00209 | American ginseng_1 | Rhodococcus aetherivorans |
| SBP00209 | American ginseng_1 | Rhodococcus aetherivorans |
| SBP00209 | American ginseng_1 | Rhodococcus coprophilus |
| SBP00209 | American ginseng_1 | Rhodococcus coprophilus |
| SBP00209 | American ginseng_1 | Rhodococcus erythropolis |
| SBP00209 | American ginseng_1 | Rhodococcus erythropolis |
| SBP00209 | American ginseng_1 | Rhodococcus fascians |
| SBP00209 | American ginseng_1 | Rhodococcus fascians |
| SBP00209 | American ginseng_1 | Rhodococcus hoagii |
| SBP00209 | American ginseng_1 | Rhodococcus hoagii |
| SBP00209 | American ginseng_1 | Rhodococcus jostii |
| SBP00209 | American ginseng_1 | Rhodococcus jostii |
| SBP00209 | American ginseng_1 | Rhodococcus opacus |
| SBP00209 | American ginseng_1 | Rhodococcus opacus |
| SBP00209 | American ginseng_1 | Rhodococcus rhodochrous |
| SBP00209 | American ginseng_1 | Rhodococcus rhodochrous |
| SBP00209 | American ginseng_1 | Rhodococcus ruber |
| SBP00209 | American ginseng_1 | Rhodococcus ruber |
| SBP00209 | American ginseng_1 | Rhodococcus sp. 008 |
| SBP00209 | American ginseng_1 | Rhodococcus sp. 008 |
| SBP00209 | American ginseng_1 | Rhodococcus sp. B7740 |
| SBP00209 | American ginseng_1 | Rhodococcus sp. B7740 |
| SBP00209 | American ginseng_1 | Rhodococcus sp. BH4 |
| SBP00209 | American ginseng_1 | Rhodococcus sp. BH4 |
| SBP00209 | American ginseng_1 | Rhodococcus sp. H-CA8f |
| SBP00209 | American ginseng_1 | Rhodococcus sp. H-CA8f |
| SBP00209 | American ginseng_1 | Rhodococcus sp. MTM3W5.2 |
| SBP00209 | American ginseng_1 | Rhodococcus sp. MTM3W5.2 |
| SBP00209 | American ginseng_1 | Rhodococcus sp. NJ-530 |
| SBP00209 | American ginseng_1 | Rhodococcus sp. NJ-530 |
| SBP00209 | American ginseng_1 | Rhodococcus sp. P1Y |
| SBP00209 | American ginseng_1 | Rhodococcus sp. P1Y |
| SBP00209 | American ginseng_1 | Rhodococcus sp. PBTS 1 |
| SBP00209 | American ginseng_1 | Rhodococcus sp. PBTS 1 |
| SBP00209 | American ginseng_1 | Rhodococcus sp. S2-17 |
| SBP00209 | American ginseng_1 | Rhodococcus sp. S2-17 |
| SBP00209 | American ginseng_1 | Rhodococcus sp. WMMA185 |
| SBP00209 | American ginseng_1 | Rhodococcus sp. WMMA185 |
| SBP00209 | American ginseng_1 | Rhodococcus sp. X156 |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Rhodococcus* sp. X156 |
| SBP00209 | American ginseng_1 | *Rhodoferax antarcticus* |
| SBP00209 | American ginseng_1 | *Rhodoferax antarcticus* |
| SBP00209 | American ginseng_1 | *Rhodoferax ferrireducens* |
| SBP00209 | American ginseng_1 | *Rhodoferax ferrireducens* |
| SBP00209 | American ginseng_1 | *Rhodoferax koreense* |
| SBP00209 | American ginseng_1 | *Rhodoferax koreense* |
| SBP00209 | American ginseng_1 | *Rhodoferax saidenbachensis* |
| SBP00209 | American ginseng_1 | *Rhodoferax saidenbachensis* |
| SBP00209 | American ginseng_1 | *Rhodomicrobium vannielii* |
| SBP00209 | American ginseng_1 | *Rhodomicrobium vannielii* |
| SBP00209 | American ginseng_1 | *Rhodopirellula baltica* |
| SBP00209 | American ginseng_1 | *Rhodopirellula baltica* |
| SBP00209 | American ginseng_1 | *Rhodoplanes* sp. Z2-YC6860 |
| SBP00209 | American ginseng_1 | *Rhodoplanes* sp. Z2-YC6860 |
| SBP00209 | American ginseng_1 | *Rhodopseudomonas palustris* |
| SBP00209 | American ginseng_1 | *Rhodopseudomonas palustris* |
| SBP00209 | American ginseng_1 | *Rhodospirillum centenum* |
| SBP00209 | American ginseng_1 | *Rhodospirillum centenum* |
| SBP00209 | American ginseng_1 | *Rhodospirillum rubrum* |
| SBP00209 | American ginseng_1 | *Rhodospirillum rubrum* |
| SBP00209 | American ginseng_1 | *Rhodothermaceae bacterium* |
| SBP00209 | American ginseng_1 | *Rhodothermaceae bacterium* |
| SBP00209 | American ginseng_1 | *Rhodothermus marinus* |
| SBP00209 | American ginseng_1 | *Rhodothermus marinus* |
| SBP00209 | American ginseng_1 | *Rhodovulum* sp. MB263 |
| SBP00209 | American ginseng_1 | *Rhodovulum* sp. MB263 |
| SBP00209 | American ginseng_1 | *Rhodovulum* sp. P5 |
| SBP00209 | American ginseng_1 | *Rhodovulum* sp. P5 |
| SBP00209 | American ginseng_1 | *Rhodovulum sulfidophilum* |
| SBP00209 | American ginseng_1 | *Rhodovulum sulfidophilum* |
| SBP00209 | American ginseng_1 | *Rickettsia canadensis* |
| SBP00209 | American ginseng_1 | *Rickettsia canadensis* |
| SBP00209 | American ginseng_1 | *Rickettsia* endosymbiont of *Bemisia tabaci* |
| SBP00209 | American ginseng_1 | *Rickettsia* endosymbiont of *Bemisia tabaci* |
| SBP00209 | American ginseng_1 | *Rickettsia felis* |
| SBP00209 | American ginseng_1 | *Rickettsia felis* |
| SBP00209 | American ginseng_1 | *Rickettsia montanensis* |
| SBP00209 | American ginseng_1 | *Rickettsia montanensis* |
| SBP00209 | American ginseng_1 | *Rickettsiales bacterium* Ac37b |
| SBP00209 | American ginseng_1 | *Rickettsiales bacterium* Ac37b |
| SBP00209 | American ginseng_1 | *Rickettsiales* endosymbiont of *Stachyamoeba lipophora* |
| SBP00209 | American ginseng_1 | *Rickettsiales* endosymbiont of *Stachyamoeba lipophora* |
| SBP00209 | American ginseng_1 | *Riemerella anatipestifer* |
| SBP00209 | American ginseng_1 | *Riemerella anatipestifer* |
| SBP00209 | American ginseng_1 | *Rivularia* sp. PCC 7116 |
| SBP00209 | American ginseng_1 | *Rivularia* sp. PCC 7116 |
| SBP00209 | American ginseng_1 | *Robiginitalea biformata* |
| SBP00209 | American ginseng_1 | *Robiginitalea biformata* |
| SBP00209 | American ginseng_1 | *Roseateles depolymerans* |
| SBP00209 | American ginseng_1 | *Roseateles depolymerans* |
| SBP00209 | American ginseng_1 | *Roseburia hominis* |
| SBP00209 | American ginseng_1 | *Roseburia hominis* |
| SBP00209 | American ginseng_1 | *Roseburia intestinalis* |
| SBP00209 | American ginseng_1 | *Roseburia intestinalis* |
| SBP00209 | American ginseng_1 | *Roseibacterium elongatum* |
| SBP00209 | American ginseng_1 | *Roseibacterium elongatum* |
| SBP00209 | American ginseng_1 | *Roseiflexus castenholzii* |
| SBP00209 | American ginseng_1 | *Roseiflexus castenholzii* |
| SBP00209 | American ginseng_1 | *Roseiflexus* sp. RS-1 |
| SBP00209 | American ginseng_1 | *Roseiflexus* sp. RS-1 |
| SBP00209 | American ginseng_1 | *Roseitalea porphyridii* |
| SBP00209 | American ginseng_1 | *Roseitalea porphyridii* |
| SBP00209 | American ginseng_1 | *Roseobacter litoralis* |
| SBP00209 | American ginseng_1 | *Roseobacter litoralis* |
| SBP00209 | American ginseng_1 | *Roseomonas gilardii* |
| SBP00209 | American ginseng_1 | *Roseomonas gilardii* |
| SBP00209 | American ginseng_1 | *Roseomonas* sp. FDAARGOS_362 |
| SBP00209 | American ginseng_1 | *Roseomonas* sp. FDAARGOS_362 |
| SBP00209 | American ginseng_1 | *Roseovarius mucosus* |
| SBP00209 | American ginseng_1 | *Roseovarius mucosus* |
| SBP00209 | American ginseng_1 | *Rothia dentocariosa* |
| SBP00209 | American ginseng_1 | *Rothia dentocariosa* |
| SBP00209 | American ginseng_1 | *Rothia mucilaginosa* |
| SBP00209 | American ginseng_1 | *Rothia mucilaginosa* |
| SBP00209 | American ginseng_1 | *Rubinisphaera brasiliensis* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Rubinisphaera brasiliensis* |
| SBP00209 | American ginseng_1 | *Rubrivivax gelatinosus* |
| SBP00209 | American ginseng_1 | *Rubrivivax gelatinosus* |
| SBP00209 | American ginseng_1 | *Rubrobacter indicoceani* |
| SBP00209 | American ginseng_1 | *Rubrobacter indicoceani* |
| SBP00209 | American ginseng_1 | *Rubrobacter radiotolerans* |
| SBP00209 | American ginseng_1 | *Rubrobacter radiotolerans* |
| SBP00209 | American ginseng_1 | *Rubrobacter xylanophilus* |
| SBP00209 | American ginseng_1 | *Rubrobacter xylanophilus* |
| SBP00209 | American ginseng_1 | *Ruegeria pomeroyi* |
| SBP00209 | American ginseng_1 | *Ruegeria pomeroyi* |
| SBP00209 | American ginseng_1 | *Ruegeria* sp. NKC1-1 |
| SBP00209 | American ginseng_1 | *Ruegeria* sp. NKC1-1 |
| SBP00209 | American ginseng_1 | *Rufibacter* sp. DG15C |
| SBP00209 | American ginseng_1 | *Rufibacter* sp. DG15C |
| SBP00209 | American ginseng_1 | *Rufibacter* sp. DG31D |
| SBP00209 | American ginseng_1 | *Rufibacter* sp. DG31D |
| SBP00209 | American ginseng_1 | *Ruminococcus albus* |
| SBP00209 | American ginseng_1 | *Ruminococcus albus* |
| SBP00209 | American ginseng_1 | *Rummeliibacillus stabekisii* |
| SBP00209 | American ginseng_1 | *Rummeliibacillus stabekisii* |
| SBP00209 | American ginseng_1 | *Runella* sp. HYN0085 |
| SBP00209 | American ginseng_1 | *Runella* sp. HYN0085 |
| SBP00209 | American ginseng_1 | *Runella* sp. SP2 |
| SBP00209 | American ginseng_1 | *Runella* sp. SP2 |
| SBP00209 | American ginseng_1 | *Saccharolobus solfataricus* |
| SBP00209 | American ginseng_1 | *Saccharolobus solfataricus* |
| SBP00209 | American ginseng_1 | *Saccharomonospora azurea* |
| SBP00209 | American ginseng_1 | *Saccharomonospora azurea* |
| SBP00209 | American ginseng_1 | *Saccharomonospora cyanea* |
| SBP00209 | American ginseng_1 | *Saccharomonospora cyanea* |
| SBP00209 | American ginseng_1 | *Saccharomonospora glauca* |
| SBP00209 | American ginseng_1 | *Saccharomonospora glauca* |
| SBP00209 | American ginseng_1 | *Saccharomonospora marina* |
| SBP00209 | American ginseng_1 | *Saccharomonospora marina* |
| SBP00209 | American ginseng_1 | *Saccharomonospora viridis* |
| SBP00209 | American ginseng_1 | *Saccharomonospora viridis* |
| SBP00209 | American ginseng_1 | *Saccharopolyspora erythraea* |
| SBP00209 | American ginseng_1 | *Saccharopolyspora erythraea* |
| SBP00209 | American ginseng_1 | *Saccharothrix espanaensis* |
| SBP00209 | American ginseng_1 | *Saccharothrix espanaensis* |
| SBP00209 | American ginseng_1 | *Sagittula* sp. P11 |
| SBP00209 | American ginseng_1 | *Sagittula* sp. P11 |
| SBP00209 | American ginseng_1 | *Salegentibacter salegens* |
| SBP00209 | American ginseng_1 | *Salegentibacter salegens* |
| SBP00209 | American ginseng_1 | *Salimicrobium jeotgali* |
| SBP00209 | American ginseng_1 | *Salimicrobium jeotgali* |
| SBP00209 | American ginseng_1 | *Salinarchaeum* sp. Harcht-Bsk1 |
| SBP00209 | American ginseng_1 | *Salinarchaeum* sp. Harcht-Bsk1 |
| SBP00209 | American ginseng_1 | *Salinibacter ruber* |
| SBP00209 | American ginseng_1 | *Salinibacter ruber* |
| SBP00209 | American ginseng_1 | *Salinibacterium* sp. CGMCC 1.16371 |
| SBP00209 | American ginseng_1 | *Salinibacterium* sp. CGMCC 1.16371 |
| SBP00209 | American ginseng_1 | *Salinicoccus halodurans* |
| SBP00209 | American ginseng_1 | *Salinicoccus halodurans* |
| SBP00209 | American ginseng_1 | *Salinicola tamaricis* |
| SBP00209 | American ginseng_1 | *Salinicola tamaricis* |
| SBP00209 | American ginseng_1 | *Salinigranum rubrum* |
| SBP00209 | American ginseng_1 | *Salinigranum rubrum* |
| SBP00209 | American ginseng_1 | *Salinimonas lutimaris* |
| SBP00209 | American ginseng_1 | *Salinimonas lutimaris* |
| SBP00209 | American ginseng_1 | *Salinimonas* sp. HMF8227 |
| SBP00209 | American ginseng_1 | *Salinimonas* sp. HMF8227 |
| SBP00209 | American ginseng_1 | *Salinisphaera* sp. LB1 |
| SBP00209 | American ginseng_1 | *Salinisphaera* sp. LB1 |
| SBP00209 | American ginseng_1 | *Salinispora arenicola* |
| SBP00209 | American ginseng_1 | *Salinispora arenicola* |
| SBP00209 | American ginseng_1 | *Salinispora tropica* |
| SBP00209 | American ginseng_1 | *Salinispora tropica* |
| SBP00209 | American ginseng_1 | *Salinivirga cyanobacteriivorans* |
| SBP00209 | American ginseng_1 | *Salinivirga cyanobacteriivorans* |
| SBP00209 | American ginseng_1 | *Salipiger profundus* |
| SBP00209 | American ginseng_1 | *Salipiger profundus* |
| SBP00209 | American ginseng_1 | *Salmonella bongori* |
| SBP00209 | American ginseng_1 | *Salmonella bongori* |
| SBP00209 | American ginseng_1 | *Salmonella enterica* |

TABLE 3-continued

List of species identified in each metagenomic sample of each SBP Sample

| SBP ID | SBP Host Common Name | Genus sp. |
|---|---|---|
| SBP00209 | American ginseng_1 | *Salmonella enterica* |
| SBP00209 | American ginseng_1 | *Sandaracinus amylolyticus* |
| SBP00209 | American ginseng_1 | *Sandaracinus amylolyticus* |
| SBP00209 | American ginseng_1 | *Sanguibacter keddieii* |
| SBP00209 | American ginseng_1 | *Sanguibacter keddieii* |
| SBP00209 | American ginseng_1 | *Scardovia inopinata* |
| SBP00209 | American ginseng_1 | *Scardovia inopinata* |
| SBP00209 | American ginseng_1 | *Scytonema* sp. HK-05 |
| SBP00209 | American ginseng_1 | *Scytonema* sp. HK-05 |
| SBP00209 | American ginseng_1 | *Scytonema* sp. NIES-4073 |
| SBP00209 | American ginseng_1 | *Scytonema* sp. NIES-4073 |
| SBP00209 | American ginseng_1 | secondary endosymbiont of *Heteropsylla cubana* |
| SBP00209 | American ginseng_1 | secondary endosymbiont of *Heteropsylla cubana* |
| SBP00209 | American ginseng_1 | *Sedimenticola thiotaurini* |
| SBP00209 | American ginseng_1 | *Sedimenticola thiotaurini* |
| SBP00209 | American ginseng_1 | *Sedimentisphaera salicampi* |
| SBP00209 | American ginseng_1 | *Sedimentisphaera salicampi* |
| SBP00209 | American ginseng_1 | *Sedimentitalea* sp. W43 |
| SBP00209 | American ginseng_1 | *Sedimentitalea* sp. W43 |
| SBP00209 | American ginseng_1 | *Sediminicola* sp. YIK13 |
| SBP00209 | American ginseng_1 | *Sediminicola* sp. YIK13 |
| SBP00209 | American ginseng_1 | *Segniliparus rotundus* |
| SBP00209 | American ginseng_1 | *Segniliparus rotundus* |
| SBP00209 | American ginseng_1 | *Serinicoccus chungangensis* |
| SBP00209 | American ginseng_1 | *Serinicoccus chungangensis* |
| SBP00209 | American ginseng_1 | *Serinicoccus* sp. JLT9 |
| SBP00209 | American ginseng_1 | *Serinicoccus* sp. JLT9 |
| SBP00209 | American ginseng_1 | *Serpentinomonas mccroryi* |
| SBP00209 | American ginseng_1 | *Serpentinomonas mccroryi* |
| SBP00209 | American ginseng_1 | *Serpentinomonas raichei* |
| SBP00209 | American ginseng_1 | *Serpentinomonas raichei* |
| SBP00209 | American ginseng_1 | *Serratia fonticola* |
| SBP00209 | American ginseng_1 | *Serratia fonticola* |
| SBP00209 | American ginseng_1 | *Serratia liquefaciens* |
| SBP00209 | American ginseng_1 | *Serratia liquefaciens* |
| SBP00209 | American ginseng_1 | *Serratia marcescens* |
| SBP00209 | American ginseng_1 | *Serratia marcescens* |
| SBP00209 | American ginseng_1 | *Serratia odorifera* |
| SBP00209 | American ginseng_1 | *Serratia odorifera* |
| SBP00209 | American ginseng_1 | *Serratia plymuthica* |
| SBP00209 | American ginseng_1 | *Serratia plymuthica* |
| SBP00209 | American ginseng_1 | *Serratia proteamaculans* |
| SBP00209 | American ginseng_1 | *Serratia proteamaculans* |
| SBP00209 | American ginseng_1 | *Serratia quinivorans* |
| SBP00209 | American ginseng_1 | *Serratia quinivorans* |
| SBP00209 | American ginseng_1 | *Serratia rubidaea* |
| SBP00209 | American ginseng_1 | *Serratia rubidaea* |
| SBP00209 | American ginseng_1 | *Serratia* sp. |
| SBP00209 | American ginseng_1 | *Serratia* sp. |
| SBP00209 | American ginseng_1 | *Serratia* sp. ATCC 39006 |
| SBP00209 | American ginseng_1 | *Serratia* sp. ATCC 39006 |
| SBP00209 | American ginseng_1 | *Serratia* sp. FDAARGOS_506 |
| SBP00209 | American ginseng_1 | *Serratia* sp. FDAARGOS_506 |
| SBP00209 | American ginseng_1 | *Serratia* sp. FGI94 |
| SBP00209 | American ginseng_1 | *Serratia* sp. FGI94 |
| SBP00209 | American ginseng_1 | *Serratia* sp. FS14 |
| SBP00209 | American ginseng_1 | *Serratia* sp. FS14 |
| SBP00209 | American ginseng_1 | *Serratia* sp. P2ACOL2 |
| SBP00209 | American ginseng_1 | *Serratia* sp. P2ACOL2 |
| SBP00209 | American ginseng_1 | *Serratia* sp. YD25 |
| SBP00209 | American ginseng_1 | *Serratia* sp. YD25 |
| SBP00209 | American ginseng_1 | *Shewanella baltica* |
| SBP00209 | American ginseng_1 | *Shewanella baltica* |
| SBP00209 | American ginseng_1 | *Shewanella benthica* |
| SBP00209 | American ginseng_1 | *Shewanella benthica* |
| SBP00209 | American ginseng_1 | *Shewanella denitrificans* |
| SBP00209 | American ginseng_1 | *Shewanella denitrificans* |
| SBP00209 | American ginseng_1 | *Shewanella frigidimarina* |
| SBP00209 | American ginseng_1 | *Shewanella frigidimarina* |
| SBP00209 | American ginseng_1 | *Shewanella halifaxensis* |
| SBP00209 | American ginseng_1 | *Shewanella halifaxensis* |
| SBP00209 | American ginseng_1 | *Shewanella japonica* |
| SBP00209 | American ginseng_1 | *Shewanella japonica* |
| SBP00209 | American ginseng_1 | *Shewanella livingstonensis* |
| SBP00209 | American ginseng_1 | *Shewanella livingstonensis* |
| SBP00209 | American ginseng_1 | *Shewanella loihica* |

TABLE 3-continued

List of species identified in each metagenomic sample of each SBP Sample

| SBP ID | SBP Host Common Name | Genus sp. |
|---|---|---|
| SBP00209 | American ginseng_1 | Shewanella loihica |
| SBP00209 | American ginseng_1 | Shewanella pealeana |
| SBP00209 | American ginseng_1 | Shewanella pealeana |
| SBP00209 | American ginseng_1 | Shewanella piezotolerans |
| SBP00209 | American ginseng_1 | Shewanella piezotolerans |
| SBP00209 | American ginseng_1 | Shewanella putrefaciens |
| SBP00209 | American ginseng_1 | Shewanella putrefaciens |
| SBP00209 | American ginseng_1 | Shewanella sediminis |
| SBP00209 | American ginseng_1 | Shewanella sediminis |
| SBP00209 | American ginseng_1 | Shewanella sp. ANA-3 |
| SBP00209 | American ginseng_1 | Shewanella sp. ANA-3 |
| SBP00209 | American ginseng_1 | Shewanella sp. TH2012 |
| SBP00209 | American ginseng_1 | Shewanella sp. TH2012 |
| SBP00209 | American ginseng_1 | Shewanella spongiae |
| SBP00209 | American ginseng_1 | Shewanella spongiae |
| SBP00209 | American ginseng_1 | Shigella dysenteriae |
| SBP00209 | American ginseng_1 | Shigella dysenteriae |
| SBP00209 | American ginseng_1 | Shigella flexneri |
| SBP00209 | American ginseng_1 | Shigella flexneri |
| SBP00209 | American ginseng_1 | Shimwellia blattae |
| SBP00209 | American ginseng_1 | Shimwellia blattae |
| SBP00209 | American ginseng_1 | Shinella sp. HZN7 |
| SBP00209 | American ginseng_1 | Shinella sp. HZN7 |
| SBP00209 | American ginseng_1 | Sideroxydans lithotrophicus |
| SBP00209 | American ginseng_1 | Sideroxydans lithotrophicus |
| SBP00209 | American ginseng_1 | Silicimonas algicola |
| SBP00209 | American ginseng_1 | Silicimonas algicola |
| SBP00209 | American ginseng_1 | Simiduia agarivorans |
| SBP00209 | American ginseng_1 | Simiduia agarivorans |
| SBP00209 | American ginseng_1 | Simkania negevensis |
| SBP00209 | American ginseng_1 | Simkania negevensis |
| SBP00209 | American ginseng_1 | Simonsiella muelleri |
| SBP00209 | American ginseng_1 | Simonsiella muelleri |
| SBP00209 | American ginseng_1 | Simplicispira suum |
| SBP00209 | American ginseng_1 | Simplicispira suum |
| SBP00209 | American ginseng_1 | Singulisphaera acidiphila |
| SBP00209 | American ginseng_1 | Singulisphaera acidiphila |
| SBP00209 | American ginseng_1 | Siniperca chuatsi rhabdovirus |
| SBP00209 | American ginseng_1 | Siniperca chuatsi rhabdovirus |
| SBP00209 | American ginseng_1 | Sinomonas atrocyanea |
| SBP00209 | American ginseng_1 | Sinomonas atrocyanea |
| SBP00209 | American ginseng_1 | Sinorhizobium americanum |
| SBP00209 | American ginseng_1 | Sinorhizobium americanum |
| SBP00209 | American ginseng_1 | Sinorhizobium fredii |
| SBP00209 | American ginseng_1 | Sinorhizobium fredii |
| SBP00209 | American ginseng_1 | Sinorhizobium medicae |
| SBP00209 | American ginseng_1 | Sinorhizobium medicae |
| SBP00209 | American ginseng_1 | Sinorhizobium meliloti |
| SBP00209 | American ginseng_1 | Sinorhizobium meliloti |
| SBP00209 | American ginseng_1 | Sinorhizobium sp. RAC02 |
| SBP00209 | American ginseng_1 | Sinorhizobium sp. RAC02 |
| SBP00209 | American ginseng_1 | Skunkpox virus |
| SBP00209 | American ginseng_1 | Skunkpox virus |
| SBP00209 | American ginseng_1 | Slackia heliotrinireducens |
| SBP00209 | American ginseng_1 | Slackia heliotrinireducens |
| SBP00209 | American ginseng_1 | Sneathia amnii |
| SBP00209 | American ginseng_1 | Sneathia amnii |
| SBP00209 | American ginseng_1 | Snodgrassella alvi |
| SBP00209 | American ginseng_1 | Snodgrassella alvi |
| SBP00209 | American ginseng_1 | Sodalis glossinidius |
| SBP00209 | American ginseng_1 | Sodalis glossinidius |
| SBP00209 | American ginseng_1 | Solibacillus silvestris |
| SBP00209 | American ginseng_1 | Solibacillus silvestris |
| SBP00209 | American ginseng_1 | Solibacillus sp. R5-41 |
| SBP00209 | American ginseng_1 | Solibacillus sp. R5-41 |
| SBP00209 | American ginseng_1 | Solimonas sp. K1W22B-7 |
| SBP00209 | American ginseng_1 | Solimonas sp. K1W22B-7 |
| SBP00209 | American ginseng_1 | Solitalea canadensis |
| SBP00209 | American ginseng_1 | Solitalea canadensis |
| SBP00209 | American ginseng_1 | Sorangium cellulosum |
| SBP00209 | American ginseng_1 | Sorangium cellulosum |
| SBP00209 | American ginseng_1 | Sphaerobacter thermophilus |
| SBP00209 | American ginseng_1 | Sphaerobacter thermophilus |
| SBP00209 | American ginseng_1 | Sphaerochaeta pleomorpha |
| SBP00209 | American ginseng_1 | Sphaerochaeta pleomorpha |
| SBP00209 | American ginseng_1 | Sphaerospermopsis kisseleviana |

TABLE 3-continued

List of species identified in each metagenomic sample of each SBP Sample

| SBP ID | SBP Host Common Name | Genus sp. |
|---|---|---|
| SBP00209 | American ginseng_1 | *Sphaerospermopsis kisseleviana* |
| SBP00209 | American ginseng_1 | *Sphingobacteriaceae bacterium* GW460-11-11-14-LB5 |
| SBP00209 | American ginseng_1 | *Sphingobacteriaceae bacterium* GW460-11-11-14-LB5 |
| SBP00209 | American ginseng_1 | *Sphingobacterium daejeonense* |
| SBP00209 | American ginseng_1 | *Sphingobacterium daejeonense* |
| SBP00209 | American ginseng_1 | *Sphingobacterium psychroaquaticum* |
| SBP00209 | American ginseng_1 | *Sphingobacterium psychroaquaticum* |
| SBP00209 | American ginseng_1 | *Sphingobacterium* sp. 21 |
| SBP00209 | American ginseng_1 | *Sphingobacterium* sp. 21 |
| SBP00209 | American ginseng_1 | *Sphingobacterium* sp. B29 |
| SBP00209 | American ginseng_1 | *Sphingobacterium* sp. B29 |
| SBP00209 | American ginseng_1 | *Sphingobacterium* sp. G1-14 |
| SBP00209 | American ginseng_1 | *Sphingobacterium* sp. G1-14 |
| SBP00209 | American ginseng_1 | *Sphingobacterium* sp. ML3W |
| SBP00209 | American ginseng_1 | *Sphingobacterium* sp. ML3W |
| SBP00209 | American ginseng_1 | *Sphingobacterium thalpophilum* |
| SBP00209 | American ginseng_1 | *Sphingobacterium thalpophilum* |
| SBP00209 | American ginseng_1 | *Sphingobium amiense* |
| SBP00209 | American ginseng_1 | *Sphingobium amiense* |
| SBP00209 | American ginseng_1 | *Sphingobium baderi* |
| SBP00209 | American ginseng_1 | *Sphingobium baderi* |
| SBP00209 | American ginseng_1 | *Sphingobium chlorophenolicum* |
| SBP00209 | American ginseng_1 | *Sphingobium chlorophenolicum* |
| SBP00209 | American ginseng_1 | *Sphingobium cloacae* |
| SBP00209 | American ginseng_1 | *Sphingobium cloacae* |
| SBP00209 | American ginseng_1 | *Sphingobium fuliginis* |
| SBP00209 | American ginseng_1 | *Sphingobium fuliginis* |
| SBP00209 | American ginseng_1 | *Sphingobium herbicidovorans* |
| SBP00209 | American ginseng_1 | *Sphingobium herbicidovorans* |
| SBP00209 | American ginseng_1 | *Sphingobium hydrophobicum* |
| SBP00209 | American ginseng_1 | *Sphingobium hydrophobicum* |
| SBP00209 | American ginseng_1 | *Sphingobium indicum* |
| SBP00209 | American ginseng_1 | *Sphingobium indicum* |
| SBP00209 | American ginseng_1 | *Sphingobium japonicum* |
| SBP00209 | American ginseng_1 | *Sphingobium japonicum* |
| SBP00209 | American ginseng_1 | *Sphingobium* sp. EP60837 |
| SBP00209 | American ginseng_1 | *Sphingobium* sp. EP60837 |
| SBP00209 | American ginseng_1 | *Sphingobium* sp. MI1205 |
| SBP00209 | American ginseng_1 | *Sphingobium* sp. MI1205 |
| SBP00209 | American ginseng_1 | *Sphingobium* sp. RAC03 |
| SBP00209 | American ginseng_1 | *Sphingobium* sp. RAC03 |
| SBP00209 | American ginseng_1 | *Sphingobium* sp. SCG-1 |
| SBP00209 | American ginseng_1 | *Sphingobium* sp. SCG-1 |
| SBP00209 | American ginseng_1 | *Sphingobium* sp. SYK-6 |
| SBP00209 | American ginseng_1 | *Sphingobium* sp. SYK-6 |
| SBP00209 | American ginseng_1 | *Sphingobium* sp. TKS |
| SBP00209 | American ginseng_1 | *Sphingobium* sp. TKS |
| SBP00209 | American ginseng_1 | *Sphingobium* sp. YBL2 |
| SBP00209 | American ginseng_1 | *Sphingobium* sp. YBL2 |
| SBP00209 | American ginseng_1 | *Sphingobium* sp. YG1 |
| SBP00209 | American ginseng_1 | *Sphingobium* sp. YG1 |
| SBP00209 | American ginseng_1 | *Sphingobium yanoikuyae* |
| SBP00209 | American ginseng_1 | *Sphingobium yanoikuyae* |
| SBP00209 | American ginseng_1 | *Sphingomonas indica* |
| SBP00209 | American ginseng_1 | *Sphingomonas indica* |
| SBP00209 | American ginseng_1 | *Sphingomonas koreensis* |
| SBP00209 | American ginseng_1 | *Sphingomonas koreensis* |
| SBP00209 | American ginseng_1 | *Sphingomonas melonis* |
| SBP00209 | American ginseng_1 | *Sphingomonas melonis* |
| SBP00209 | American ginseng_1 | *Sphingomonas panacis* |
| SBP00209 | American ginseng_1 | *Sphingomonas panacis* |
| SBP00209 | American ginseng_1 | *Sphingomonas paucimobilis* |
| SBP00209 | American ginseng_1 | *Sphingomonas paucimobilis* |
| SBP00209 | American ginseng_1 | *Sphingomonas sanxanigenens* |
| SBP00209 | American ginseng_1 | *Sphingomonas sanxanigenens* |
| SBP00209 | American ginseng_1 | *Sphingomonas* sp. AAP5 |
| SBP00209 | American ginseng_1 | *Sphingomonas* sp. AAP5 |
| SBP00209 | American ginseng_1 | *Sphingomonas* sp. C8-2 |
| SBP00209 | American ginseng_1 | *Sphingomonas* sp. C8-2 |
| SBP00209 | American ginseng_1 | *Sphingomonas* sp. Cra20 |
| SBP00209 | American ginseng_1 | *Sphingomonas* sp. Cra20 |
| SBP00209 | American ginseng_1 | *Sphingomonas* sp. FARSPH |
| SBP00209 | American ginseng_1 | *Sphingomonas* sp. FARSPH |
| SBP00209 | American ginseng_1 | *Sphingomonas* sp. JJ-A5 |
| SBP00209 | American ginseng_1 | *Sphingomonas* sp. JJ-A5 |
| SBP00209 | American ginseng_1 | *Sphingomonas* sp. KC8 |

TABLE 3-continued

List of species identified in each metagenomic sample of each SBP Sample

| SBP ID | SBP Host Common Name | Genus sp. |
|---|---|---|
| SBP00209 | American ginseng_1 | Sphingomonas sp. KC8 |
| SBP00209 | American ginseng_1 | Sphingomonas sp. LK11 |
| SBP00209 | American ginseng_1 | Sphingomonas sp. LK11 |
| SBP00209 | American ginseng_1 | Sphingomonas sp. LM7 |
| SBP00209 | American ginseng_1 | Sphingomonas sp. LM7 |
| SBP00209 | American ginseng_1 | Sphingomonas sp. MM-1 |
| SBP00209 | American ginseng_1 | Sphingomonas sp. MM-1 |
| SBP00209 | American ginseng_1 | Sphingomonas sp. NIC1 |
| SBP00209 | American ginseng_1 | Sphingomonas sp. NIC1 |
| SBP00209 | American ginseng_1 | Sphingomonas sp. YZ-8 |
| SBP00209 | American ginseng_1 | Sphingomonas sp. YZ-8 |
| SBP00209 | American ginseng_1 | Sphingomonas taxi |
| SBP00209 | American ginseng_1 | Sphingomonas taxi |
| SBP00209 | American ginseng_1 | Sphingomonas wittichii |
| SBP00209 | American ginseng_1 | Sphingomonas wittichii |
| SBP00209 | American ginseng_1 | Sphingopyxis alaskensis |
| SBP00209 | American ginseng_1 | Sphingopyxis alaskensis |
| SBP00209 | American ginseng_1 | Sphingopyxis fribergensis |
| SBP00209 | American ginseng_1 | Sphingopyxis fribergensis |
| SBP00209 | American ginseng_1 | Sphingopyxis granuli |
| SBP00209 | American ginseng_1 | Sphingopyxis granuli |
| SBP00209 | American ginseng_1 | Sphingopyxis macrogoltabida |
| SBP00209 | American ginseng_1 | Sphingopyxis macrogoltabida |
| SBP00209 | American ginseng_1 | Sphingopyxis sp. 113P3 |
| SBP00209 | American ginseng_1 | Sphingopyxis sp. 113P3 |
| SBP00209 | American ginseng_1 | Sphingopyxis sp. EG6 |
| SBP00209 | American ginseng_1 | Sphingopyxis sp. EG6 |
| SBP00209 | American ginseng_1 | Sphingopyxis sp. FD7 |
| SBP00209 | American ginseng_1 | Sphingopyxis sp. FD7 |
| SBP00209 | American ginseng_1 | Sphingopyxis sp. MG |
| SBP00209 | American ginseng_1 | Sphingopyxis sp. MG |
| SBP00209 | American ginseng_1 | Sphingopyxis sp. QXT-31 |
| SBP00209 | American ginseng_1 | Sphingopyxis sp. QXT-31 |
| SBP00209 | American ginseng_1 | Sphingopyxis sp. WS5A3p |
| SBP00209 | American ginseng_1 | Sphingopyxis sp. WS5A3p |
| SBP00209 | American ginseng_1 | Sphingorhabdus sp. Alg231-15 |
| SBP00209 | American ginseng_1 | Sphingorhabdus sp. Alg231-15 |
| SBP00209 | American ginseng_1 | Sphingorhabdus sp. M41 |
| SBP00209 | American ginseng_1 | Sphingorhabdus sp. M41 |
| SBP00209 | American ginseng_1 | Sphingorhabdus sp. YGSMI21 |
| SBP00209 | American ginseng_1 | Sphingorhabdus sp. YGSMI21 |
| SBP00209 | American ginseng_1 | Sphingosinicella microcystinivorans |
| SBP00209 | American ginseng_1 | Sphingosinicella microcystinivorans |
| SBP00209 | American ginseng_1 | Sphingosinicella sp. BN140058 |
| SBP00209 | American ginseng_1 | Sphingosinicella sp. BN140058 |
| SBP00209 | American ginseng_1 | Spiroplasma chrysopicola |
| SBP00209 | American ginseng_1 | Spiroplasma chrysopicola |
| SBP00209 | American ginseng_1 | Spiroplasma citri |
| SBP00209 | American ginseng_1 | Spiroplasma citri |
| SBP00209 | American ginseng_1 | Spiroplasma eriocheiris |
| SBP00209 | American ginseng_1 | Spiroplasma eriocheiris |
| SBP00209 | American ginseng_1 | Spiroplasma gladiatoris |
| SBP00209 | American ginseng_1 | Spiroplasma gladiatoris |
| SBP00209 | American ginseng_1 | Spiroplasma litorale |
| SBP00209 | American ginseng_1 | Spiroplasma litorale |
| SBP00209 | American ginseng_1 | Spiroplasma monobiae |
| SBP00209 | American ginseng_1 | Spiroplasma monobiae |
| SBP00209 | American ginseng_1 | Spiroplasma sabaudiense |
| SBP00209 | American ginseng_1 | Spiroplasma sabaudiense |
| SBP00209 | American ginseng_1 | Spiroplasma turonicum |
| SBP00209 | American ginseng_1 | Spiroplasma turonicum |
| SBP00209 | American ginseng_1 | Spirosoma aerolatum |
| SBP00209 | American ginseng_1 | Spirosoma aerolatum |
| SBP00209 | American ginseng_1 | Spirosoma montaniterrae |
| SBP00209 | American ginseng_1 | Spirosoma montaniterrae |
| SBP00209 | American ginseng_1 | Spirosoma pollinicola |
| SBP00209 | American ginseng_1 | Spirosoma pollinicola |
| SBP00209 | American ginseng_1 | Sporosarcina pasteurii |
| SBP00209 | American ginseng_1 | Sporosarcina pasteurii |
| SBP00209 | American ginseng_1 | Sporosarcina psychrophila |
| SBP00209 | American ginseng_1 | Sporosarcina psychrophila |
| SBP00209 | American ginseng_1 | Sporosarcina sp. P33 |
| SBP00209 | American ginseng_1 | Sporosarcina sp. P33 |
| SBP00209 | American ginseng_1 | Sporosarcina ureae |
| SBP00209 | American ginseng_1 | Sporosarcina ureae |
| SBP00209 | American ginseng_1 | Stackebrandtia nassauensis |

TABLE 3-continued

List of species identified in each metagenomic sample of each SBP Sample

| SBP ID | SBP Host Common Name | Genus sp. |
|---|---|---|
| SBP00209 | American ginseng_1 | Stackebrandtia nassauensis |
| SBP00209 | American ginseng_1 | Stanieria cyanosphaera |
| SBP00209 | American ginseng_1 | Stanieria cyanosphaera |
| SBP00209 | American ginseng_1 | Staphylococcus agnetis |
| SBP00209 | American ginseng_1 | Staphylococcus agnetis |
| SBP00209 | American ginseng_1 | Staphylococcus arlettae |
| SBP00209 | American ginseng_1 | Staphylococcus arlettae |
| SBP00209 | American ginseng_1 | Staphylococcus aureus |
| SBP00209 | American ginseng_1 | Staphylococcus aureus |
| SBP00209 | American ginseng_1 | Staphylococcus capitis |
| SBP00209 | American ginseng_1 | Staphylococcus capitis |
| SBP00209 | American ginseng_1 | Staphylococcus cohnii |
| SBP00209 | American ginseng_1 | Staphylococcus cohnii |
| SBP00209 | American ginseng_1 | Staphylococcus delphini |
| SBP00209 | American ginseng_1 | Staphylococcus delphini |
| SBP00209 | American ginseng_1 | Staphylococcus epidermidis |
| SBP00209 | American ginseng_1 | Staphylococcus epidermidis |
| SBP00209 | American ginseng_1 | Staphylococcus equorum |
| SBP00209 | American ginseng_1 | Staphylococcus equorum |
| SBP00209 | American ginseng_1 | Staphylococcus haemolyticus |
| SBP00209 | American ginseng_1 | Staphylococcus haemolyticus |
| SBP00209 | American ginseng_1 | Staphylococcus hominis |
| SBP00209 | American ginseng_1 | Staphylococcus hominis |
| SBP00209 | American ginseng_1 | Staphylococcus hyicus |
| SBP00209 | American ginseng_1 | Staphylococcus hyicus |
| SBP00209 | American ginseng_1 | Staphylococcus kloosii |
| SBP00209 | American ginseng_1 | Staphylococcus kloosii |
| SBP00209 | American ginseng_1 | Staphylococcus lugdunensis |
| SBP00209 | American ginseng_1 | Staphylococcus lugdunensis |
| SBP00209 | American ginseng_1 | Staphylococcus lutrae |
| SBP00209 | American ginseng_1 | Staphylococcus lutrae |
| SBP00209 | American ginseng_1 | Staphylococcus nepalensis |
| SBP00209 | American ginseng_1 | Staphylococcus nepalensis |
| SBP00209 | American ginseng_1 | Staphylococcus pasteuri |
| SBP00209 | American ginseng_1 | Staphylococcus pasteuri |
| SBP00209 | American ginseng_1 | Staphylococcus saprophyticus |
| SBP00209 | American ginseng_1 | Staphylococcus saprophyticus |
| SBP00209 | American ginseng_1 | Staphylococcus schleiferi |
| SBP00209 | American ginseng_1 | Staphylococcus schleiferi |
| SBP00209 | American ginseng_1 | Staphylococcus sciuri |
| SBP00209 | American ginseng_1 | Staphylococcus sciuri |
| SBP00209 | American ginseng_1 | Staphylococcus simulans |
| SBP00209 | American ginseng_1 | Staphylococcus simulans |
| SBP00209 | American ginseng_1 | Staphylococcus sp. M0911 |
| SBP00209 | American ginseng_1 | Staphylococcus sp. M0911 |
| SBP00209 | American ginseng_1 | Staphylococcus succinus |
| SBP00209 | American ginseng_1 | Staphylococcus succinus |
| SBP00209 | American ginseng_1 | Stappia sp. ES.058 |
| SBP00209 | American ginseng_1 | Stappia sp. ES.058 |
| SBP00209 | American ginseng_1 | Starkeya novella |
| SBP00209 | American ginseng_1 | Starkeya novella |
| SBP00209 | American ginseng_1 | Stella humosa |
| SBP00209 | American ginseng_1 | Stella humosa |
| SBP00209 | American ginseng_1 | Stella vacuolata |
| SBP00209 | American ginseng_1 | Stella vacuolata |
| SBP00209 | American ginseng_1 | Stenotrophomonas acidaminiphila |
| SBP00209 | American ginseng_1 | Stenotrophomonas acidaminiphila |
| SBP00209 | American ginseng_1 | Stenotrophomonas maltophilia |
| SBP00209 | American ginseng_1 | Stenotrophomonas maltophilia |
| SBP00209 | American ginseng_1 | Stenotrophomonas rhizophila |
| SBP00209 | American ginseng_1 | Stenotrophomonas rhizophila |
| SBP00209 | American ginseng_1 | Stenotrophomonas sp. |
| SBP00209 | American ginseng_1 | Stenotrophomonas sp. |
| SBP00209 | American ginseng_1 | Stenotrophomonas sp. ESTM1D_MKCIP4_1 |
| SBP00209 | American ginseng_1 | Stenotrophomonas sp. ESTM1D_MKCIP4_1 |
| SBP00209 | American ginseng_1 | Stenotrophomonas sp. G4 |
| SBP00209 | American ginseng_1 | Stenotrophomonas sp. G4 |
| SBP00209 | American ginseng_1 | Stenotrophomonas sp. LM091 |
| SBP00209 | American ginseng_1 | Stenotrophomonas sp. LM091 |
| SBP00209 | American ginseng_1 | Stenotrophomonas sp. MYb57 |
| SBP00209 | American ginseng_1 | Stenotrophomonas sp. MYb57 |
| SBP00209 | American ginseng_1 | Stenotrophomonas sp. Pemsol |
| SBP00209 | American ginseng_1 | Stenotrophomonas sp. Pemsol |
| SBP00209 | American ginseng_1 | Stenotrophomonas sp. SAU14A_NAIMI4_5 |
| SBP00209 | American ginseng_1 | Stenotrophomonas sp. SAU14A_NAIMI4_5 |
| SBP00209 | American ginseng_1 | Stenotrophomonas sp. SAU14A_NAIMI4_8 |

TABLE 3-continued

List of species identified in each metagenomic sample of each SBP Sample

| SBP ID | SBP Host Common Name | Genus sp. |
|---|---|---|
| SBP00209 | American ginseng_1 | Stenotrophomonas sp. SAU14A_NAIMI4_8 |
| SBP00209 | American ginseng_1 | Stenotrophomonas sp. WZN-1 |
| SBP00209 | American ginseng_1 | Stenotrophomonas sp. WZN-1 |
| SBP00209 | American ginseng_1 | Stenotrophomonas sp. YAU14A_MKIMI4_1 |
| SBP00209 | American ginseng_1 | Stenotrophomonas sp. YAU14A_MKIMI4_1 |
| SBP00209 | American ginseng_1 | Stenotrophomonas sp. YAU14D1_LEIMI4_1 |
| SBP00209 | American ginseng_1 | Stenotrophomonas sp. YAU14D1_LEIMI4_1 |
| SBP00209 | American ginseng_1 | Stenotrophomonas sp. ZAC14A_NAIMI4_1 |
| SBP00209 | American ginseng_1 | Stenotrophomonas sp. ZAC14A_NAIMI4_1 |
| SBP00209 | American ginseng_1 | Stenotrophomonas sp. ZAC14D2_NAIMI4_6 |
| SBP00209 | American ginseng_1 | Stenotrophomonas sp. ZAC14D2_NAIMI4_6 |
| SBP00209 | American ginseng_1 | Stenotrophomonas sp. ZAC14D2_NAIMI4_7 |
| SBP00209 | American ginseng_1 | Stenotrophomonas sp. ZAC14D2_NAIMI4_7 |
| SBP00209 | American ginseng_1 | Steroidobacter denitrificans |
| SBP00209 | American ginseng_1 | Steroidobacter denitrificans |
| SBP00209 | American ginseng_1 | Sterolibacteriaceae bacterium J5B |
| SBP00209 | American ginseng_1 | Sterolibacteriaceae bacterium J5B |
| SBP00209 | American ginseng_1 | Stigmatella aurantiaca |
| SBP00209 | American ginseng_1 | Stigmatella aurantiaca |
| SBP00209 | American ginseng_1 | Streptacidiphilus sp. DSM 106435 |
| SBP00209 | American ginseng_1 | Streptacidiphilus sp. DSM 106435 |
| SBP00209 | American ginseng_1 | Streptococcus agalactiae |
| SBP00209 | American ginseng_1 | Streptococcus agalactiae |
| SBP00209 | American ginseng_1 | Streptococcus canis |
| SBP00209 | American ginseng_1 | Streptococcus canis |
| SBP00209 | American ginseng_1 | Streptococcus cristatus |
| SBP00209 | American ginseng_1 | Streptococcus cristatus |
| SBP00209 | American ginseng_1 | Streptococcus equi |
| SBP00209 | American ginseng_1 | Streptococcus equi |
| SBP00209 | American ginseng_1 | Streptococcus equinus |
| SBP00209 | American ginseng_1 | Streptococcus equinus |
| SBP00209 | American ginseng_1 | Streptococcus ferus |
| SBP00209 | American ginseng_1 | Streptococcus ferus |
| SBP00209 | American ginseng_1 | Streptococcus gallolyticus |
| SBP00209 | American ginseng_1 | Streptococcus gallolyticus |
| SBP00209 | American ginseng_1 | Streptococcus gordonii |
| SBP00209 | American ginseng_1 | Streptococcus gordonii |
| SBP00209 | American ginseng_1 | Streptococcus halotolerans |
| SBP00209 | American ginseng_1 | Streptococcus halotolerans |
| SBP00209 | American ginseng_1 | Streptococcus mitis |
| SBP00209 | American ginseng_1 | Streptococcus mitis |
| SBP00209 | American ginseng_1 | Streptococcus oralis |
| SBP00209 | American ginseng_1 | Streptococcus oralis |
| SBP00209 | American ginseng_1 | Streptococcus parasanguinis |
| SBP00209 | American ginseng_1 | Streptococcus parasanguinis |
| SBP00209 | American ginseng_1 | Streptococcus parauberis |
| SBP00209 | American ginseng_1 | Streptococcus parauberis |
| SBP00209 | American ginseng_1 | Streptococcus pneumoniae |
| SBP00209 | American ginseng_1 | Streptococcus pneumoniae |
| SBP00209 | American ginseng_1 | Streptococcus pyogenes |
| SBP00209 | American ginseng_1 | Streptococcus pyogenes |
| SBP00209 | American ginseng_1 | Streptococcus sanguinis |
| SBP00209 | American ginseng_1 | Streptococcus sanguinis |
| SBP00209 | American ginseng_1 | Streptococcus sobrinus |
| SBP00209 | American ginseng_1 | Streptococcus sobrinus |
| SBP00209 | American ginseng_1 | Streptococcus suis |
| SBP00209 | American ginseng_1 | Streptococcus suis |
| SBP00Z09 | American ginseng_1 | Streptococcus thermophilus |
| SBP00209 | American ginseng_1 | Streptococcus thermophilus |
| SBP00209 | American ginseng_1 | Streptomyces actuosus |
| SBP00209 | American ginseng_1 | Streptomyces actuosus |
| SBP00209 | American ginseng_1 | Streptomyces albireticuli |
| SBP00209 | American ginseng_1 | Streptomyces albireticuli |
| SBP00209 | American ginseng_1 | Streptomyces alboflavus |
| SBP00209 | American ginseng_1 | Streptomyces alboflavus |
| SBP00209 | American ginseng_1 | Streptomyces albulus |
| SBP00209 | American ginseng_1 | Streptomyces albulus |
| SBP00209 | American ginseng_1 | Streptomyces albus |
| SBP00209 | American ginseng_1 | Streptomyces albus |
| SBP00209 | American ginseng_1 | Streptomyces ambofaciens |
| SBP00209 | American ginseng_1 | Streptomyces ambofaciens |
| SBP00209 | American ginseng_1 | Streptomyces antibioticus |
| SBP00209 | American ginseng_1 | Streptomyces antibioticus |
| SBP00209 | American ginseng_1 | Streptomyces anulatus |
| SBP00209 | American ginseng_1 | Streptomyces anulatus |
| SBP00209 | American ginseng_1 | Streptomyces asterosporus |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Streptomyces asterosporus* |
| SBP00209 | American ginseng_1 | *Streptomyces atratus* |
| SBP00209 | American ginseng_1 | *Streptomyces atratus* |
| SBP00209 | American ginseng_1 | *Streptomyces autolyticus* |
| SBP00209 | American ginseng_1 | *Streptomyces autolyticus* |
| SBP00209 | American ginseng_1 | *Streptomyces avermitilis* |
| SBP00209 | American ginseng_1 | *Streptomyces avermitilis* |
| SBP00209 | American ginseng_1 | *Streptomyces bingchenggensis* |
| SBP00209 | American ginseng_1 | *Streptomyces bingchenggensis* |
| SBP00209 | American ginseng_1 | *Streptomyces cattleya* |
| SBP00209 | American ginseng_1 | *Streptomyces cattleya* |
| SBP00209 | American ginseng_1 | *Streptomyces chartreusis* |
| SBP00209 | American ginseng_1 | *Streptomyces chartreusis* |
| SBP00209 | American ginseng_1 | *Streptomyces clavuligerus* |
| SBP00209 | American ginseng_1 | *Streptomyces clavuligerus* |
| SBP00209 | American ginseng_1 | *Streptomyces collinus* |
| SBP00209 | American ginseng_1 | *Streptomyces collinus* |
| SBP00209 | American ginseng_1 | *Streptomyces cyaneogriseus* |
| SBP00209 | American ginseng_1 | *Streptomyces cyaneogriseus* |
| SBP00209 | American ginseng_1 | *Streptomyces davaonensis* |
| SBP00209 | American ginseng_1 | *Streptomyces davaonensis* |
| SBP00209 | American ginseng_1 | *Streptomyces dengpaensis* |
| SBP00209 | American ginseng_1 | *Streptomyces dengpaensis* |
| SBP00209 | American ginseng_1 | *Streptomyces exfoliatus* |
| SBP00209 | American ginseng_1 | *Streptomyces exfoliatus* |
| SBP00209 | American ginseng_1 | *Streptomyces formicae* |
| SBP00209 | American ginseng_1 | *Streptomyces formicae* |
| SBP00209 | American ginseng_1 | *Streptomyces fulvissimus* |
| SBP00209 | American ginseng_1 | *Streptomyces fulvissimus* |
| SBP00209 | American ginseng_1 | *Streptomyces fungicidicus* |
| SBP00209 | American ginseng_1 | *Streptomyces fungicidicus* |
| SBP00209 | American ginseng_1 | *Streptomyces gilvosporeus* |
| SBP00209 | American ginseng_1 | *Streptomyces gilvosporeus* |
| SBP00209 | American ginseng_1 | *Streptomyces glaucescens* |
| SBP00209 | American ginseng_1 | *Streptomyces glaucescens* |
| SBP00209 | American ginseng_1 | *Streptomyces globisporus* |
| SBP00209 | American ginseng_1 | *Streptomyces globisporus* |
| SBP00209 | American ginseng_1 | *Streptomyces globosus* |
| SBP00209 | American ginseng_1 | *Streptomyces globosus* |
| SBP00209 | American ginseng_1 | *Streptomyces griseochromogenes* |
| SBP00209 | American ginseng_1 | *Streptomyces griseochromogenes* |
| SBP00209 | American ginseng_1 | *Streptomyces griseorubiginosus* |
| SBP00209 | American ginseng_1 | *Streptomyces griseorubiginosus* |
| SBP00209 | American ginseng_1 | *Streptomyces griseoviridis* |
| SBP00209 | American ginseng_1 | *Streptomyces griseoviridis* |
| SBP00209 | American ginseng_1 | *Streptomyces griseus* |
| SBP00209 | American ginseng_1 | *Streptomyces griseus* |
| SBP00209 | American ginseng_1 | *Streptomyces hundungensis* |
| SBP00209 | American ginseng_1 | *Streptomyces hundungensis* |
| SBP00209 | American ginseng_1 | *Streptomyces hygroscopicus* |
| SBP00209 | American ginseng_1 | *Streptomyces hygroscopicus* |
| SBP00209 | American ginseng_1 | *Streptomyces katrae* |
| SBP00209 | American ginseng_1 | *Streptomyces katrae* |
| SBP00209 | American ginseng_1 | *Streptomyces koyangensis* |
| SBP00209 | American ginseng_1 | *Streptomyces koyangensis* |
| SBP00209 | American ginseng_1 | *Streptomyces lavendulae* |
| SBP00209 | American ginseng_1 | *Streptomyces lavendulae* |
| SBP00209 | American ginseng_1 | *Streptomyces leeuwenhoekii* |
| SBP00209 | American ginseng_1 | *Streptomyces leeuwenhoekii* |
| SBP00209 | American ginseng_1 | *Streptomyces lincolnensis* |
| SBP00209 | American ginseng_1 | *Streptomyces lincolnensis* |
| SBP00209 | American ginseng_1 | *Streptomyces lunaelactis* |
| SBP00209 | American ginseng_1 | *Streptomyces lunaelactis* |
| SBP00209 | American ginseng_1 | *Streptomyces luteoverticillatus* |
| SBP00209 | American ginseng_1 | *Streptomyces luteoverticillatus* |
| SBP00209 | American ginseng_1 | *Streptomyces lydicus* |
| SBP00209 | American ginseng_1 | *Streptomyces lydicus* |
| SBP00209 | American ginseng_1 | *Streptomyces nigra* |
| SBP00209 | American ginseng_1 | *Streptomyces nigra* |
| SBP00209 | American ginseng_1 | *Streptomyces niveus* |
| SBP00209 | American ginseng_1 | *Streptomyces niveus* |
| SBP00209 | American ginseng_1 | *Streptomyces nodosus* |
| SBP00209 | American ginseng_1 | *Streptomyces nodosus* |
| SBP00209 | American ginseng_1 | *Streptomyces noursei* |
| SBP00209 | American ginseng_1 | *Streptomyces noursei* |
| SBP00209 | American ginseng_1 | *Streptomyces olivaceus* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Streptomyces olivaceus* |
| SBP00209 | American ginseng_1 | *Streptomyces olivoreticuli* |
| SBP00209 | American ginseng_1 | *Streptomyces olivoreticuli* |
| SBP00209 | American ginseng_1 | *Streptomyces pactum* |
| SBP00209 | American ginseng_1 | *Streptomyces pactum* |
| SBP00209 | American ginseng_1 | *Streptomyces parvulus* |
| SBP00209 | American ginseng_1 | *Streptomyces parvulus* |
| SBP00209 | American ginseng_1 | *Streptomyces peucetius* |
| SBP00209 | American ginseng_1 | *Streptomyces peucetius* |
| SBP00209 | American ginseng_1 | *Streptomyces pluripotens* |
| SBP00209 | American ginseng_1 | *Streptomyces pluripotens* |
| SBP00209 | American ginseng_1 | *Streptomyces pristinaespiralis* |
| SBP00209 | American ginseng_1 | *Streptomyces pristinaespiralis* |
| SBP00209 | American ginseng_1 | *Streptomyces puniciscabiei* |
| SBP00209 | American ginseng_1 | *Streptomyces puniciscabiei* |
| SBP00209 | American ginseng_1 | *Streptomyces qaidamensis* |
| SBP00209 | American ginseng_1 | *Streptomyces qaidamensis* |
| SBP00209 | American ginseng_1 | *Streptomyces reticuli* |
| SBP00209 | American ginseng_1 | *Streptomyces reticuli* |
| SBP00209 | American ginseng_1 | *Streptomyces rimosus* |
| SBP00209 | American ginseng_1 | *Streptomyces rimosus* |
| SBP00209 | American ginseng_1 | *Streptomyces roseochromogenus* |
| SBP00209 | American ginseng_1 | *Streptomyces roseochromogenus* |
| SBP00209 | American ginseng_1 | *Streptomyces rubrolavendulae* |
| SBP00209 | American ginseng_1 | *Streptomyces rubrolavendulae* |
| SBP00209 | American ginseng_1 | *Streptomyces scabiei* |
| SBP00209 | American ginseng_1 | *Streptomyces scabiei* |
| SBP00209 | American ginseng_1 | *Streptomyces seoulensis* |
| SBP00209 | American ginseng_1 | *Streptomyces seoulensis* |
| SBP00209 | American ginseng_1 | *Streptomyces* sp. 2323.1 |
| SBP00209 | American ginseng_1 | *Streptomyces* sp. 2323.1 |
| SBP00209 | American ginseng_1 | *Streptomyces* sp. 3211 |
| SBP00209 | American ginseng_1 | *Streptomyces* sp. 3211 |
| SBP00209 | American ginseng_1 | *Streptomyces* sp. 3214.6 |
| SBP00209 | American ginseng_1 | *Streptomyces* sp. 3214.6 |
| SBP00209 | American ginseng_1 | *Streptomyces* sp. 4F |
| SBP00209 | American ginseng_1 | *Streptomyces* sp. 4F |
| SBP00209 | American ginseng_1 | *Streptomyces* sp. 769 |
| SBP00209 | American ginseng_1 | *Streptomyces* sp. 769 |
| SBP00209 | American ginseng_1 | *Streptomyces* sp. ADI95-16 |
| SBP00209 | American ginseng_1 | *Streptomyces* sp. ADI95-16 |
| SBP00209 | American ginseng_1 | *Streptomyces* sp. CB09001 |
| SBP00209 | American ginseng_1 | *Streptomyces* sp. CB09001 |
| SBP00209 | American ginseng_1 | *Streptomyces* sp. CCM_MD2014 |
| SBP00209 | American ginseng_1 | *Streptomyces* sp. CCM_MD2014 |
| SBP00209 | American ginseng_1 | *Streptomyces* sp. CdTB01 |
| SBP00209 | American ginseng_1 | *Streptomyces* sp. CdTB01 |
| SBP00209 | American ginseng_1 | *Streptomyces* sp. CMB-StM0423 |
| SBP00209 | American ginseng_1 | *Streptomyces* sp. CMB-StM0423 |
| SBP00209 | American ginseng_1 | *Streptomyces* sp. CNQ-509 |
| SBP00209 | American ginseng_1 | *Streptomyces* sp. CNQ-509 |
| SBP00209 | American ginseng_1 | *Streptomyces* sp. DUT11 |
| SBP00209 | American ginseng_1 | *Streptomyces* sp. DUT11 |
| SBP00209 | American ginseng_1 | *Streptomyces* sp. ETH9427 |
| SBP00209 | American ginseng_1 | *Streptomyces* sp. ETH9427 |
| SBP00209 | American ginseng_1 | *Streptomyces* sp. F12 |
| SBP00209 | American ginseng_1 | *Streptomyces* sp. F12 |
| SBP00209 | American ginseng_1 | *Streptomyces* sp. fd1-xmd |
| SBP00209 | American ginseng_1 | *Streptomyces* sp. fd1-xmd |
| SBP00209 | American ginseng_1 | *Streptomyces* sp. Go-475 |
| SBP00209 | American ginseng_1 | *Streptomyces* sp. Go-475 |
| SBP00209 | American ginseng_1 | *Streptomyces* sp. GSSD-12 |
| SBP00209 | American ginseng_1 | *Streptomyces* sp. GSSD-12 |
| SBP00209 | American ginseng_1 | *Streptomyces* sp. HNM0039 |
| SBP00209 | American ginseng_1 | *Streptomyces* sp. HNM0039 |
| SBP00209 | American ginseng_1 | *Streptomyces* sp. KPB2 |
| SBP00209 | American ginseng_1 | *Streptomyces* sp. KPB2 |
| SBP00209 | American ginseng_1 | *Streptomyces* sp. M2 |
| SBP00209 | American ginseng_1 | *Streptomyces* sp. M2 |
| SBP00209 | American ginseng_1 | *Streptomyces* sp. M56 |
| SBP00209 | American ginseng_1 | *Streptomyces* sp. M56 |
| SBP00209 | American ginseng_1 | *Streptomyces* sp. Mg1 |
| SBP00209 | American ginseng_1 | *Streptomyces* sp. Mg1 |
| SBP00209 | American ginseng_1 | *Streptomyces* sp. MK45 |
| SBP00209 | American ginseng_1 | *Streptomyces* sp. MK45 |
| SBP00209 | American ginseng_1 | *Streptomyces* sp. NEAU-S7GS2 |

TABLE 3-continued

List of species identified in each metagenomic sample of each SBP Sample

| SBP ID | SBP Host Common Name | Genus sp. |
|---|---|---|
| SBP00209 | American ginseng_1 | *Streptomyces* sp. NEAU-S7GS2 |
| SBP00209 | American ginseng_1 | *Streptomyces* sp. P3 |
| SBP00209 | American ginseng_1 | *Streptomyces* sp. P3 |
| SBP00209 | American ginseng_1 | *Streptomyces* sp. RTd22 |
| SBP00209 | American ginseng_1 | *Streptomyces* sp. RTd22 |
| SBP00209 | American ginseng_1 | *Streptomyces* sp. S063 |
| SBP00209 | American ginseng_1 | *Streptomyces* sp. S063 |
| SBP00209 | American ginseng_1 | *Streptomyces* sp. SAT1 |
| SBP00209 | American ginseng_1 | *Streptomyces* sp. SAT1 |
| SBP00209 | American ginseng_1 | *Streptomyces* sp. SCSIO 03032 |
| SBP00209 | American ginseng_1 | *Streptomyces* sp. SCSIO 03032 |
| SBP00209 | American ginseng_1 | *Streptomyces* sp. SGAir0924 |
| SBP00209 | American ginseng_1 | *Streptomyces* sp. SGAir0924 |
| SBP00209 | American ginseng_1 | *Streptomyces* sp. Sge12 |
| SBP00209 | American ginseng_1 | *Streptomyces* sp. Sge12 |
| SBP00209 | American ginseng_1 | *Streptomyces* sp. SirexAA-E |
| SBP00209 | American ginseng_1 | *Streptomyces* sp. SirexAA-E |
| SBP00209 | American ginseng_1 | *Streptomyces* sp. SM18 |
| SBP00209 | American ginseng_1 | *Streptomyces* sp. SM18 |
| SBP00209 | American ginseng_1 | *Streptomyces* sp. TLI_053 |
| SBP00209 | American ginseng_1 | *Streptomyces* sp. TLI_053 |
| SBP00209 | American ginseng_1 | *Streptomyces* sp. TN58 |
| SBP00209 | American ginseng_1 | *Streptomyces* sp. TN58 |
| SBP00209 | American ginseng_1 | *Streptomyces* sp. Tue 6075 |
| SBP00209 | American ginseng_1 | *Streptomyces* sp. Tue 6075 |
| SBP00209 | American ginseng_1 | *Streptomyces* sp. W1SF4 |
| SBP00209 | American ginseng_1 | *Streptomyces* sp. W1SF4 |
| SBP00209 | American ginseng_1 | *Streptomyces* sp. WAC 01438 |
| SBP00209 | American ginseng_1 | *Streptomyces* sp. WAC 01438 |
| SBP00209 | American ginseng_1 | *Streptomyces* sp. WAC 01529 |
| SBP00209 | American ginseng_1 | *Streptomyces* sp. WAC 01529 |
| SBP00209 | American ginseng_1 | *Streptomyces* sp. WAC 06738 |
| SBP00209 | American ginseng_1 | *Streptomyces* sp. WAC 06738 |
| SBP00209 | American ginseng_1 | *Streptomyces* sp. WAC00288 |
| SBP00209 | American ginseng_1 | *Streptomyces* sp. WAC00288 |
| SBP00209 | American ginseng_1 | *Streptomyces* sp. YIM 121038 |
| SBP00209 | American ginseng_1 | *Streptomyces* sp. YIM 121038 |
| SBP00209 | American ginseng_1 | *Streptomyces* sp. Z022 |
| SBP00209 | American ginseng_1 | *Streptomyces* sp. Z022 |
| SBP00209 | American ginseng_1 | *Streptomyces* sp. ZFG47 |
| SBP00209 | American ginseng_1 | *Streptomyces* sp. ZFG47 |
| SBP00209 | American ginseng_1 | *Streptomyces spongiicola* |
| SBP00209 | American ginseng_1 | *Streptomyces spongiicola* |
| SBP00209 | American ginseng_1 | *Streptomyces venezuelae* |
| SBP00209 | American ginseng_1 | *Streptomyces venezuelae* |
| SBP00209 | American ginseng_1 | *Streptomyces vietnamensis* |
| SBP00209 | American ginseng_1 | *Streptomyces vietnamensis* |
| SBP00209 | American ginseng_1 | *Streptomyces violaceoruber* |
| SBP00209 | American ginseng_1 | *Streptomyces violaceoruber* |
| SBP00209 | American ginseng_1 | *Streptomyces violaceusniger* |
| SBP00209 | American ginseng_1 | *Streptomyces violaceusniger* |
| SBP00209 | American ginseng_1 | *Streptomyces xiamenensis* |
| SBP00209 | American ginseng_1 | *Streptomyces xiamenensis* |
| SBP00209 | American ginseng_1 | *Streptomyces xinghaiensis* |
| SBP00209 | American ginseng_1 | *Streptomyces xinghaiensis* |
| SBP00209 | American ginseng_1 | *Streptosporangium roseum* |
| SBP00209 | American ginseng_1 | *Streptosporangium roseum* |
| SBP00209 | American ginseng_1 | *Streptosporangium* sp. 'caverna' |
| SBP00209 | American ginseng_1 | *Streptosporangium* sp. 'caverna' |
| SBP00209 | American ginseng_1 | *Sulfitobacter pseudonitzschiae* |
| SBP00209 | American ginseng_1 | *Sulfitobacter pseudonitzschiae* |
| SBP00209 | American ginseng_1 | *Sulfitobacter* sp. AM1-D1 |
| SBP00209 | American ginseng_1 | *Sulfitobacter* sp. AM1-D1 |
| SBP00209 | American ginseng_1 | *Sulfitobacter* sp. D7 |
| SBP00209 | American ginseng_1 | *Sulfitobacter* sp. D7 |
| SBP00209 | American ginseng_1 | *Sulfitobacter* sp. JL08 |
| SBP00209 | American ginseng_1 | *Sulfitobacter* sp. JL08 |
| SBP00209 | American ginseng_1 | *Sulfitobacter* sp. SK012 |
| SBP00209 | American ginseng_1 | *Sulfitobacter* sp. SK012 |
| SBP00209 | American ginseng_1 | *Sulfitobacter* sp. SK025 |
| SBP00209 | American ginseng_1 | *Sulfitobacter* sp. SK025 |
| SBP00209 | American ginseng_1 | *Sulfolobus islandicus* |
| SBP00209 | American ginseng_1 | *Sulfolobus islandicus* |
| SBP00209 | American ginseng_1 | *Sulfuricaulis limicola* |
| SBP00209 | American ginseng_1 | *Sulfuricaulis limicola* |
| SBP00209 | American ginseng_1 | *Sulfuricella denitrificans* |

TABLE 3-continued

List of species identified in each metagenomic sample of each SBP Sample

| SBP ID | SBP Host Common Name | Genus sp. |
|---|---|---|
| SBP00209 | American ginseng_1 | *Sulfuricella denitrificans* |
| SBP00209 | American ginseng_1 | *Sulfuriferula* sp. AH1 |
| SBP00209 | American ginseng_1 | *Sulfuriferula* sp. AH1 |
| SBP00209 | American ginseng_1 | *Sulfurifustis variabilis* |
| SBP00209 | American ginseng_1 | *Sulfurifustis variabilis* |
| SBP00209 | American ginseng_1 | *Sulfurihydrogenibium* sp. YO3AOP1 |
| SBP00209 | American ginseng_1 | *Sulfurihydrogenibium* sp. YO3AOP1 |
| SBP00209 | American ginseng_1 | *Sulfurimonas gotlandica* |
| SBP00209 | American ginseng_1 | *Sulfurimonas gotlandica* |
| SBP00209 | American ginseng_1 | *Sulfuritalea hydrogenivorans* |
| SBP00209 | American ginseng_1 | *Sulfuritalea hydrogenivorans* |
| SBP00209 | American ginseng_1 | *Sulfuritortus calidifontis* |
| SBP00209 | American ginseng_1 | *Sulfuritortus calidifontis* |
| SBP00209 | American ginseng_1 | *Sulfurospirillum* sp. JPD-1 |
| SBP00209 | American ginseng_1 | *Sulfurospirillum* sp. JPD-1 |
| SBP00209 | American ginseng_1 | *Sulfurospirillum* sp. UCH001 |
| SBP00209 | American ginseng_1 | *Sulfurospirillum* sp. UCH001 |
| SBP00209 | American ginseng_1 | *Sutterella megalosphaeroides* |
| SBP00209 | American ginseng_1 | *Sutterella megalosphaeroides* |
| SBP00209 | American ginseng_1 | *Symbiobacterium thermophilum* |
| SBP00209 | American ginseng_1 | *Symbiobacterium thermophilum* |
| SBP00209 | American ginseng_1 | *Synechococcus phage* ACG-2014g |
| SBP00209 | American ginseng_1 | *Synechococcus phage* ACG-2014g |
| SBP00209 | American ginseng_1 | *Synechococcus* sp. CB0101 |
| SBP00209 | American ginseng_1 | *Synechococcus* sp. CB0101 |
| SBP00209 | American ginseng_1 | *Synechococcus* sp. CC9605 |
| SBP00209 | American ginseng_1 | *Synechococcus* sp. CC9605 |
| SBP00209 | American ginseng_1 | *Synechococcus* sp. KORDI-100 |
| SBP00209 | American ginseng_1 | *Synechococcus* sp. KORDI-100 |
| SBP00209 | American ginseng_1 | *Synechococcus* sp. PCC 7502 |
| SBP00209 | American ginseng_1 | *Synechococcus* sp. PCC 7502 |
| SBP00209 | American ginseng_1 | *Synechococcus* sp. WH 8101 |
| SBP00209 | American ginseng_1 | *Synechococcus* sp. WH 8101 |
| SBP00209 | American ginseng_1 | *Syntrophobotulus glycolicus* |
| SBP00209 | American ginseng_1 | *Syntrophobotulus glycolicus* |
| SBP00209 | American ginseng_1 | *Syntrophomonas wolfei* |
| SBP00209 | American ginseng_1 | *Syntrophomonas wolfei* |
| SBP00209 | American ginseng_1 | *Tabrizicola* sp. K13M18 |
| SBP00209 | American ginseng_1 | *Tabrizicola* sp. K13M18 |
| SBP00209 | American ginseng_1 | Tacheng tick virus 8 |
| SBP00209 | American ginseng_1 | Tacheng tick virus 8 |
| SBP00209 | American ginseng_1 | *Tamlana* sp. UJ94 |
| SBP00209 | American ginseng_1 | *Tamlana* sp. UJ94 |
| SBP00209 | American ginseng_1 | *Tannerella* sp. oral taxon HOT-286 |
| SBP00209 | American ginseng_1 | *Tannerella* sp. oral taxon HOT-286 |
| SBP00209 | American ginseng_1 | Taterapox virus |
| SBP00209 | American ginseng_1 | Taterapox virus |
| SBP00209 | American ginseng_1 | *Tateyamaria omphalii* |
| SBP00209 | American ginseng_1 | *Tateyamaria omphalii* |
| SBP00209 | American ginseng_1 | *Tatlockia micdadei* |
| SBP00209 | American ginseng_1 | *Tatlockia micdadei* |
| SBP00209 | American ginseng_1 | *Tatumella citrea* |
| SBP00209 | American ginseng_1 | *Tatumella citrea* |
| SBP00209 | American ginseng_1 | *Tatumella ptyseos* |
| SBP00209 | American ginseng_1 | *Tatumella ptyseos* |
| SBP00209 | American ginseng_1 | *Taylorella equigenitalis* |
| SBP00209 | American ginseng_1 | *Taylorella equigenitalis* |
| SBP00209 | American ginseng_1 | *Tenacibaculum jejuense* |
| SBP00209 | American ginseng_1 | *Tenacibaculum jejuense* |
| SBP00209 | American ginseng_1 | *Tenacibaculum maritimum* |
| SBP00209 | American ginseng_1 | *Tenacibaculum maritimum* |
| SBP00209 | American ginseng_1 | *Tenacibaculum mesophilum* |
| SBP00209 | American ginseng_1 | *Tenacibaculum mesophilum* |
| SBP00209 | American ginseng_1 | *Tenacibaculum* sp. DSM 106434 |
| SBP00209 | American ginseng_1 | *Tenacibaculum* sp. DSM 106434 |
| SBP00209 | American ginseng_1 | *Tenacibaculum* sp. SZ-18 |
| SBP00209 | American ginseng_1 | *Tenacibaculum* sp. SZ-18 |
| SBP00209 | American ginseng_1 | Tenericutes bacterium MO-XQ |
| SBP00209 | American ginseng_1 | Tenericutes bacterium MO-XQ |
| SBP00209 | American ginseng_1 | *Terribacillus goriensis* |
| SBP00209 | American ginseng_1 | *Terribacillus goriensis* |
| SBP00209 | American ginseng_1 | *Terriglobus roseus* |
| SBP00209 | American ginseng_1 | *Terriglobus roseus* |
| SBP00209 | American ginseng_1 | *Terriglobus saanensis* |
| SBP00209 | American ginseng_1 | *Terriglobus saanensis* |
| SBP00209 | American ginseng_1 | *Tessaracoccus aquimaris* |

TABLE 3-continued

List of species identified in each metagenomic sample of each SBP Sample

| SBP ID | SBP Host Common Name | Genus sp. |
|---|---|---|
| SBP00209 | American ginseng_1 | Tessaracoccus aquimaris |
| SBP00209 | American ginseng_1 | Tessaracoccus flavescens |
| SBP00209 | American ginseng_1 | Tessaracoccus flavescens |
| SBP00209 | American ginseng_1 | Tessaracoccus flavus |
| SBP00209 | American ginseng_1 | Tessaracoccus flavus |
| SBP00209 | American ginseng_1 | Tessaracoccus sp. Marseille-P5995 |
| SBP00209 | American ginseng_1 | Tessaracoccus sp. Marseille-P5995 |
| SBP00209 | American ginseng_1 | Tessaracoccus sp. T2.5-30 |
| SBP00209 | American ginseng_1 | Tessaracoccus sp. T2.5-30 |
| SBP00209 | American ginseng_1 | Tetragenococcus halophilus |
| SBP00209 | American ginseng_1 | Tetragenococcus halophilus |
| SBP00209 | American ginseng_1 | Tetragenococcus osmophilus |
| SBP00209 | American ginseng_1 | Tetragenococcus osmophilus |
| SBP00209 | American ginseng_1 | Thalassococcus sp. S3 |
| SBP00209 | American ginseng_1 | Thalassococcus sp. S3 |
| SBP00209 | American ginseng_1 | Thalassococcus sp. SH-1 |
| SBP00209 | American ginseng_1 | Thalassococcus sp. SH-1 |
| SBP00209 | American ginseng_1 | Thalassolituus oleivorans |
| SBP00209 | American ginseng_1 | Thalassolituus oleivorans |
| SBP00209 | American ginseng_1 | Thalassospira indica |
| SBP00209 | American ginseng_1 | Thalassospira indica |
| SBP00209 | American ginseng_1 | Thalassospira marina |
| SBP00209 | American ginseng_1 | Thalassospira marina |
| SBP00209 | American ginseng_1 | Thalassospira xiamenensis |
| SBP00209 | American ginseng_1 | Thalassospira xiamenensis |
| SBP00209 | American ginseng_1 | Thalassotalea crassostreae |
| SBP00209 | American ginseng_1 | Thalassotalea crassostreae |
| SBP00209 | American ginseng_1 | Thauera aromatica |
| SBP00209 | American ginseng_1 | Thauera aromatica |
| SBP00209 | American ginseng_1 | Thauera chlorobenzoica |
| SBP00209 | American ginseng_1 | Thauera chlorobenzoica |
| SBP00209 | American ginseng_1 | Thauera humireducens |
| SBP00209 | American ginseng_1 | Thauera humireducens |
| SBP00209 | American ginseng_1 | Thauera sp. K11 |
| SBP00209 | American ginseng_1 | Thauera sp. K11 |
| SBP00209 | American ginseng_1 | Thauera sp. MZ1T |
| SBP00209 | American ginseng_1 | Thauera sp. MZ1T |
| SBP00209 | American ginseng_1 | Thermaerobacter marianensis |
| SBP00209 | American ginseng_1 | Thermaerobacter marianensis |
| SBP00209 | American ginseng_1 | Thermanaerovibrio velox |
| SBP00209 | American ginseng_1 | Thermanaerovibrio velox |
| SBP00209 | American ginseng_1 | Thermoanaerobacterales bacterium SK-G1 |
| SBP00209 | American ginseng_1 | Thermoanaerobacterales bacterium SK-G1 |
| SBP00209 | American ginseng_1 | Thermoanaerobacterium sp. RBIITD |
| SBP00209 | American ginseng_1 | Thermoanaerobacterium sp. RBIITD |
| SBP00209 | American ginseng_1 | Thermoanaerobacterium xylanolyticum |
| SBP00209 | American ginseng_1 | Thermoanaerobacterium xylanolyticum |
| SBP00209 | American ginseng_1 | Thermobacillus composti |
| SBP00209 | American ginseng_1 | Thermobacillus composti |
| SBP00209 | American ginseng_1 | Thermobifida fusca |
| SBP00209 | American ginseng_1 | Thermobifida fusca |
| SBP00209 | American ginseng_1 | Thermobispora bispora |
| SBP00209 | American ginseng_1 | Thermobispora bispora |
| SBP00209 | American ginseng_1 | Thermococcus barophilus |
| SBP00209 | American ginseng_1 | Thermococcus barophilus |
| SBP00209 | American ginseng_1 | Thermococcus cleftensis |
| SBP00209 | American ginseng_1 | Thermococcus cleftensis |
| SBP00209 | American ginseng_1 | Thermococcus onnurineus |
| SBP00209 | American ginseng_1 | Thermococcus onnurineus |
| SBP00209 | American ginseng_1 | Thermococcus pacificus |
| SBP00209 | American ginseng_1 | Thermococcus pacificus |
| SBP00209 | American ginseng_1 | Thermococcus sibiricus |
| SBP00209 | American ginseng_1 | Thermococcus sibiricus |
| SBP00209 | American ginseng_1 | Thermodesulfobacterium geofontis |
| SBP00209 | American ginseng_1 | Thermodesulfobacterium geofontis |
| SBP00209 | American ginseng_1 | Thermodesulfobium narugense |
| SBP00209 | American ginseng_1 | Thermodesulfobium narugense |
| SBP00209 | American ginseng_1 | Thermogutta terrifontis |
| SBP00209 | American ginseng_1 | Thermogutta terrifontis |
| SBP00209 | American ginseng_1 | Thermomonas sp. SY21 |
| SBP00209 | American ginseng_1 | Thermomonas sp. SY21 |
| SBP00209 | American ginseng_1 | Thermomonospora curvata |
| SBP00209 | American ginseng_1 | Thermomonospora curvata |
| SBP00209 | American ginseng_1 | Thermosipho melanesiensis |
| SBP00209 | American ginseng_1 | Thermosipho melanesiensis |
| SBP00209 | American ginseng_1 | Thermus oshimai |

TABLE 3-continued

List of species identified in each metagenomic sample of each SBP Sample

| SBP ID | SBP Host Common Name | Genus sp. |
|---|---|---|
| SBP00209 | American ginseng_1 | *Thermus oshimai* |
| SBP00209 | American ginseng_1 | *Thermus* sp. CCB_US3_UF1 |
| SBP00209 | American ginseng_1 | *Thermus* sp. CCB_US3_UF1 |
| SBP00209 | American ginseng_1 | *Thermus thermophilus* |
| SBP00209 | American ginseng_1 | *Thermus thermophilus* |
| SBP00209 | American ginseng_1 | *Thioalkalivibrio nitratireducens* |
| SBP00209 | American ginseng_1 | *Thioalkalivibrio nitratireducens* |
| SBP00209 | American ginseng_1 | *Thioalkalivibrio paradoxus* |
| SBP00209 | American ginseng_1 | *Thioalkalivibrio paradoxus* |
| SBP00209 | American ginseng_1 | *Thioalkalivibrio* sp. K90mix |
| SBP00209 | American ginseng_1 | *Thioalkalivibrio* sp. K90mix |
| SBP00209 | American ginseng_1 | *Thioalkalivibrio sulfidiphilus* |
| SBP00209 | American ginseng_1 | *Thioalkalivibrio sulfidiphilus* |
| SBP00209 | American ginseng_1 | *Thiobacillus denitrificans* |
| SBP00209 | American ginseng_1 | *Thiobacillus denitrificans* |
| SBP00209 | American ginseng_1 | *Thioclava nitratireducens* |
| SBP00209 | American ginseng_1 | *Thioclava nitratireducens* |
| SBP00209 | American ginseng_1 | *Thiocystis violascens* |
| SBP00209 | American ginseng_1 | *Thiocystis violascens* |
| SBP00209 | American ginseng_1 | *Thioflavicoccus mobilis* |
| SBP00209 | American ginseng_1 | *Thioflavicoccus mobilis* |
| SBP00209 | American ginseng_1 | *Thiohalobacter thiocyanaticus* |
| SBP00209 | American ginseng_1 | *Thiohalobacter thiocyanaticus* |
| SBP00209 | American ginseng_1 | *Thiomicrorhabdus* sp. HaS4 |
| SBP00209 | American ginseng_1 | *Thiomicrorhabdus* sp. HaS4 |
| SBP00209 | American ginseng_1 | *Thiomicrospira aerophila* |
| SBP00209 | American ginseng_1 | *Thiomicrospira aerophila* |
| SBP00209 | American ginseng_1 | *Thiomicrospira cyclica* |
| SBP00209 | American ginseng_1 | *Thiomicrospira cyclica* |
| SBP00209 | American ginseng_1 | *Thiomonas arsenitoxydans* |
| SBP00209 | American ginseng_1 | *Thiomonas arsenitoxydans* |
| SBP00209 | American ginseng_1 | *Thiomonas intermedia* |
| SBP00209 | American ginseng_1 | *Thiomonas intermedia* |
| SBP00209 | American ginseng_1 | *Thiomonas* sp. X19 |
| SBP00209 | American ginseng_1 | *Thiomonas* sp. X19 |
| SBP00209 | American ginseng_1 | *Thioploca ingrica* |
| SBP00209 | American ginseng_1 | *Thioploca ingrica* |
| SBP00209 | American ginseng_1 | *Tistrella mobilis* |
| SBP00209 | American ginseng_1 | *Tistrella mobilis* |
| SBP00209 | American ginseng_1 | TM7 phylum sp. oral taxon 488 |
| SBP00209 | American ginseng_1 | TM7 phylum sp. oral taxon 488 |
| SBP00209 | American ginseng_1 | *Tolumonas auensis* |
| SBP00209 | American ginseng_1 | *Tolumonas auensis* |
| SBP00209 | American ginseng_1 | Tomato chlorotic spot tospovirus |
| SBP00209 | American ginseng_1 | Tomato chlorotic spot tospovirus |
| SBP00209 | American ginseng_1 | *Treponema azotonutricium* |
| SBP00209 | American ginseng_1 | *Treponema azotonutricium* |
| SBP00209 | American ginseng_1 | *Treponema denticola* |
| SBP00209 | American ginseng_1 | *Treponema denticola* |
| SBP00209 | American ginseng_1 | *Trichodesmium erythraeum* |
| SBP00209 | American ginseng_1 | *Trichodesmium erythraeum* |
| SBP00209 | American ginseng_1 | *Trichormus azollae* |
| SBP00209 | American ginseng_1 | *Trichormus azollae* |
| SBP00209 | American ginseng_1 | *Truepera radiovictrix* |
| SBP00209 | American ginseng_1 | *Truepera radiovictrix* |
| SBP00209 | American ginseng_1 | *Trueperella pyogenes* |
| SBP00209 | American ginseng_1 | *Trueperella pyogenes* |
| SBP00209 | American ginseng_1 | *Tsukamurella paurometabola* |
| SBP00209 | American ginseng_1 | *Tsukamurella paurometabola* |
| SBP00209 | American ginseng_1 | *Tsukamurella tyrosinosolvens* |
| SBP00209 | American ginseng_1 | *Tsukamurella tyrosinosolvens* |
| SBP00209 | American ginseng_1 | *Tumebacillus avium* |
| SBP00209 | American ginseng_1 | *Tumebacillus avium* |
| SBP00209 | American ginseng_1 | *Turicibacter* sp. H121 |
| SBP00209 | American ginseng_1 | *Turicibacter* sp. H121 |
| SBP00209 | American ginseng_1 | *Turneriella parva* |
| SBP00209 | American ginseng_1 | *Turneriella parva* |
| SBP00209 | American ginseng_1 | *Variibacter gotjawalensis* |
| SBP00209 | American ginseng_1 | *Variibacter gotjawalensis* |
| SBP00209 | American ginseng_1 | *Variovorax boronicumulans* |
| SBP00209 | American ginseng_1 | *Variovorax boronicumulans* |
| SBP00209 | American ginseng_1 | *Variovorax paradoxus* |
| SBP00209 | American ginseng_1 | *Variovorax paradoxus* |
| SBP00209 | American ginseng_1 | *Variovorax* sp. HW608 |
| SBP00209 | American ginseng_1 | *Variovorax* sp. HW608 |
| SBP00209 | American ginseng_1 | *Variovorax* sp. PAMC 28711 |

TABLE 3-continued

List of species identified in each metagenomic sample of each SBP Sample

| SBP ID | SBP Host Common Name | Genus sp. |
|---|---|---|
| SBP00209 | American ginseng_1 | *Variovorax* sp. PAMC 28711 |
| SBP00209 | American ginseng_1 | *Variovorax* sp. PMC12 |
| SBP00209 | American ginseng_1 | *Variovorax* sp. PMC12 |
| SBP00209 | American ginseng_1 | *Veillonella dispar* |
| SBP00209 | American ginseng_1 | *Veillonella dispar* |
| SBP00209 | American ginseng_1 | *Veillonella parvula* |
| SBP00209 | American ginseng_1 | *Veillonella parvula* |
| SBP00209 | American ginseng_1 | *Verminephrobacter eiseniae* |
| SBP00209 | American ginseng_1 | *Verminephrobacter eiseniae* |
| SBP00209 | American ginseng_1 | *Verrucomicrobia bacterium* IMCC26134 |
| SBP00209 | American ginseng_1 | *Verrucomicrobia bacterium* IMCC26134 |
| SBP00209 | American ginseng_1 | *Verrucomicrobium* sp. GAS474 |
| SBP00209 | American ginseng_1 | *Verrucomicrobium* sp. GAS474 |
| SBP00209 | American ginseng_1 | *Verrucomicrobium spinosum* |
| SBP00209 | American ginseng_1 | *Verrucomicrobium spinosum* |
| SBP00209 | American ginseng_1 | *Verrucosispora maris* |
| SBP00209 | American ginseng_1 | *Verrucosispora maris* |
| SBP00209 | American ginseng_1 | *Vibrio alginolyticus* |
| SBP00209 | American ginseng_1 | *Vibrio alginolyticus* |
| SBP00209 | American ginseng_1 | *Vibrio anguillarum* |
| SBP00209 | American ginseng_1 | *Vibrio anguillarum* |
| SBP00209 | American ginseng_1 | *Vibrio aphrogenes* |
| SBP00209 | American ginseng_1 | *Vibrio aphrogenes* |
| SBP00209 | American ginseng_1 | *Vibrio azureus* |
| SBP00209 | American ginseng_1 | *Vibrio azureus* |
| SBP00209 | American ginseng_1 | *Vibrio breoganii* |
| SBP00209 | American ginseng_1 | *Vibrio breoganii* |
| SBP00209 | American ginseng_1 | *Vibrio campbellii* |
| SBP00209 | American ginseng_1 | *Vibrio campbellii* |
| SBP00209 | American ginseng_1 | *Vibrio casei* |
| SBP00209 | American ginseng_1 | *Vibrio casei* |
| SBP00209 | American ginseng_1 | *Vibrio cholerae* |
| SBP00209 | American ginseng_1 | *Vibrio cholerae* |
| SBP00209 | American ginseng_1 | *Vibrio coralliilyticus* |
| SBP00209 | American ginseng_1 | *Vibrio coralliilyticus* |
| SBP00209 | American ginseng_1 | *Vibrio fluvialis* |
| SBP00209 | American ginseng_1 | *Vibrio fluvialis* |
| SBP00209 | American ginseng_1 | *Vibrio furnissii* |
| SBP00209 | American ginseng_1 | *Vibrio furnissii* |
| SBP00209 | American ginseng_1 | *Vibrio harveyi* |
| SBP00209 | American ginseng_1 | *Vibrio harveyi* |
| SBP00209 | American ginseng_1 | *Vibrio mediterranei* |
| SBP00209 | American ginseng_1 | *Vibrio mediterranei* |
| SBP00209 | American ginseng_1 | *Vibrio mimicus* |
| SBP00209 | American ginseng_1 | *Vibrio mimicus* |
| SBP00209 | American ginseng_1 | *Vibrio natriegens* |
| SBP00209 | American ginseng_1 | *Vibrio natriegens* |
| SBP00209 | American ginseng_1 | *Vibrio nigripulchritudo* |
| SBP00209 | American ginseng_1 | *Vibrio nigripulchritudo* |
| SBP00209 | American ginseng_1 | *Vibrio owensii* |
| SBP00209 | American ginseng_1 | *Vibrio owensii* |
| SBP00209 | American ginseng_1 | *Vibrio parahaemolyticus* |
| SBP00209 | American ginseng_1 | *Vibrio parahaemolyticus* |
| SBP00209 | American ginseng_1 | *Vibrio scophthalmi* |
| SBP00209 | American ginseng_1 | *Vibrio scophthalmi* |
| SBP00209 | American ginseng_1 | *Vibrio* sp. dhg |
| SBP00209 | American ginseng_1 | *Vibrio* sp. dhg |
| SBP00209 | American ginseng_1 | *Vibrio* sp. EJY3 |
| SBP00209 | American ginseng_1 | *Vibrio* sp. EJY3 |
| SBP00209 | American ginseng_1 | *Vibrio* sp. HBUAS61001 |
| SBP00209 | American ginseng_1 | *Vibrio* sp. HBUAS61001 |
| SBP00209 | American ginseng_1 | *Vibrio tasmaniensis* |
| SBP00209 | American ginseng_1 | *Vibrio tasmaniensis* |
| SBP00209 | American ginseng_1 | *Vibrio tritonius* |
| SBP00209 | American ginseng_1 | *Vibrio tritonius* |
| SBP00209 | American ginseng_1 | *Vibrio vulnificus* |
| SBP00209 | American ginseng_1 | *Vibrio vulnificus* |
| SBP00209 | American ginseng_1 | *Victivallales bacterium* CCUG 44730 |
| SBP00209 | American ginseng_1 | *Victivallales bacterium* CCUG 44730 |
| SBP00209 | American ginseng_1 | *Virgibacillus halodenitrificans* |
| SBP00209 | American ginseng_1 | *Virgibacillus halodenitrificans* |
| SBP00209 | American ginseng_1 | *Virgibacillus necropolis* |
| SBP00209 | American ginseng_1 | *Virgibacillus necropolis* |
| SBP00209 | American ginseng_1 | *Virgibacillus phasianinus* |
| SBP00209 | American ginseng_1 | *Virgibacillus phasianinus* |
| SBP00209 | American ginseng_1 | *Virgibacillus* sp. 6R |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Virgibacillus* sp. 6R |
| SBP00209 | American ginseng_1 | *Virgibacillus* sp. Bac332 |
| SBP00209 | American ginseng_1 | *Virgibacillus* sp. Bac332 |
| SBP00209 | American ginseng_1 | *Vitreoscilla filiformis* |
| SBP00209 | American ginseng_1 | *Vitreoscilla filiformis* |
| SBP00209 | American ginseng_1 | *Vogesella* sp. LIG4 |
| SBP00209 | American ginseng_1 | *Vogesella* sp. LIG4 |
| SBP00209 | American ginseng_1 | *Vulcanisaeta distributa* |
| SBP00209 | American ginseng_1 | *Vulcanisaeta distributa* |
| SBP00209 | American ginseng_1 | *Vulgatibacter incomptus* |
| SBP00209 | American ginseng_1 | *Vulgatibacter incomptus* |
| SBP00209 | American ginseng_1 | *Weeksella virosa* |
| SBP00209 | American ginseng_1 | *Weeksella virosa* |
| SBP00209 | American ginseng_1 | *Weissella cibaria* |
| SBP00209 | American ginseng_1 | *Weissella cibaria* |
| SBP00209 | American ginseng_1 | *Weissella jogaejeotgali* |
| SBP00209 | American ginseng_1 | *Weissella jogaejeotgali* |
| SBP00209 | American ginseng_1 | *Wenyingzhuangia fucanilytica* |
| SBP00209 | American ginseng_1 | *Wenyingzhuangia fucanilytica* |
| SBP00209 | American ginseng_1 | *Wenzhouxiangella marina* |
| SBP00209 | American ginseng_1 | *Wenzhouxiangella marina* |
| SBP00209 | American ginseng_1 | *Wigglesworthia glossinidia* |
| SBP00209 | American ginseng_1 | *Wigglesworthia glossinidia* |
| SBP00209 | American ginseng_1 | *Winogradskyella* sp. PC-19 |
| SBP00209 | American ginseng_1 | *Winogradskyella* sp. PC-19 |
| SBP00209 | American ginseng_1 | *Winogradskyella* sp. PG-2 |
| SBP00209 | American ginseng_1 | *Winogradskyella* sp. PG-2 |
| SBP00209 | American ginseng_1 | *Winogradskyella* sp. RHA_55 |
| SBP00209 | American ginseng_1 | *Winogradskyella* sp. RHA_55 |
| SBP00209 | American ginseng_1 | Wuhan nido-like virus 1 |
| SBP00209 | American ginseng_1 | Wuhan nido-like virus 1 |
| SBP00209 | American ginseng_1 | *Xanthobacter autotrophicus* |
| SBP00209 | American ginseng_1 | *Xanthobacter autotrophicus* |
| SBP00209 | American ginseng_1 | *Xanthomonas albilineans* |
| SBP00209 | American ginseng_1 | *Xanthomonas albilineans* |
| SBP00209 | American ginseng_1 | *Xanthomonas arboricola* |
| SBP00209 | American ginseng_1 | *Xanthomonas arboricola* |
| SBP00209 | American ginseng_1 | *Xanthomonas campestris* |
| SBP00209 | American ginseng_1 | *Xanthomonas campestris* |
| SBP00209 | American ginseng_1 | *Xanthomonas cassavae* |
| SBP00209 | American ginseng_1 | *Xanthomonas cassavae* |
| SBP00209 | American ginseng_1 | *Xanthomonas citri* |
| SBP00209 | American ginseng_1 | *Xanthomonas citri* |
| SBP00209 | American ginseng_1 | *Xanthomonas euvesicatoria* |
| SBP00209 | American ginseng_1 | *Xanthomonas euvesicatoria* |
| SBP00209 | American ginseng_1 | *Xanthomonas fragariae* |
| SBP00209 | American ginseng_1 | *Xanthomonas fragariae* |
| SBP00209 | American ginseng_1 | *Xanthomonas gardneri* |
| SBP00209 | American ginseng_1 | *Xanthomonas gardneri* |
| SBP00209 | American ginseng_1 | *Xanthomonas hortorum* |
| SBP00209 | American ginseng_1 | *Xanthomonas hortorum* |
| SBP00209 | American ginseng_1 | *Xanthomonas oryzae* |
| SBP00209 | American ginseng_1 | *Xanthomonas oryzae* |
| SBP00209 | American ginseng_1 | *Xanthomonas perforans* |
| SBP00209 | American ginseng_1 | *Xanthomonas perforans* |
| SBP00209 | American ginseng_1 | *Xanthomonas phaseoli* |
| SBP00209 | American ginseng_1 | *Xanthomonas phaseoli* |
| SBP00209 | American ginseng_1 | *Xanthomonas sacchari* |
| SBP00209 | American ginseng_1 | *Xanthomonas sacchari* |
| SBP00209 | American ginseng_1 | *Xanthomonas translucens* |

TABLE 3-continued

List of species identified in each metagenomic sample of each SBP Sample

| SBP ID | SBP Host Common Name | Genus sp. |
| --- | --- | --- |
| SBP00209 | American ginseng_1 | *Xanthomonas translucens* |
| SBP00209 | American ginseng_1 | *Xanthomonas vasicola* |
| SBP00209 | American ginseng_1 | *Xanthomonas vasicola* |
| SBP00209 | American ginseng_1 | *Xanthomonas vesicatoria* |
| SBP00209 | American ginseng_1 | *Xanthomonas vesicatoria* |
| SBP00209 | American ginseng_1 | *Xenorhabdus bovienii* |
| SBP00209 | American ginseng_1 | *Xenorhabdus bovienii* |
| SBP00209 | American ginseng_1 | *Xenorhabdus doucetiae* |
| SBP00209 | American ginseng_1 | *Xenorhabdus doucetiae* |
| SBP00209 | American ginseng_1 | *Xenorhabdus nematophila* |
| SBP00209 | American ginseng_1 | *Xenorhabdus nematophila* |
| SBP00209 | American ginseng_1 | *Xylanimonas cellulosilytica* |
| SBP00209 | American ginseng_1 | *Xylanimonas cellulosilytica* |
| SBP00209 | American ginseng_1 | *Xylella fastidiosa* |
| SBP00209 | American ginseng_1 | *Xylella fastidiosa* |
| SBP00209 | American ginseng_1 | *Xylella taiwanensis* |
| SBP00209 | American ginseng_1 | *Xylella taiwanensis* |
| SBP00209 | American ginseng_1 | *Yangia pacifica* |
| SBP00209 | American ginseng_1 | *Yangia pacifica* |
| SBP00209 | American ginseng_1 | *Yangia* sp. CCB-MM3 |
| SBP00209 | American ginseng_1 | *Yangia* sp. CCB-MM3 |
| SBP00209 | American ginseng_1 | *Yersinia aleksiciae* |
| SBP00209 | American ginseng_1 | *Yersinia aleksiciae* |
| SBP00209 | American ginseng_1 | *Yersinia enterocolitica* |
| SBP00209 | American ginseng_1 | *Yersinia enterocolitica* |
| SBP00209 | American ginseng_1 | *Yersinia pseudotuberculosis* |
| SBP00209 | American ginseng_1 | *Yersinia pseudotuberculosis* |
| SBP00209 | American ginseng_1 | *Yersinia rohdei* |
| SBP00209 | American ginseng_1 | *Yersinia rohdei* |
| SBP00209 | American ginseng_1 | Yokapox virus |
| SBP00209 | American ginseng_1 | Yokapox virus |
| SBP00209 | American ginseng_1 | *Zhihengliuella* sp. ISTPL4 |
| SBP00209 | American ginseng_1 | *Zhihengliuella* sp. ISTPL4 |
| SBP00209 | American ginseng_1 | *Zobellella denitrificans* |
| SBP00209 | American ginseng_1 | *Zobellella denitrificans* |
| SBP00209 | American ginseng_1 | *Zobellia galactanivorans* |
| SBP00209 | American ginseng_1 | *Zobellia galactanivorans* |
| SBP00209 | American ginseng_1 | *Zoogloeaceae bacterium* Par-f-2 |
| SBP00209 | American ginseng_1 | *Zoogloeaceae bacterium* Par-f-2 |
| SBP00209 | American ginseng_1 | *Zunongwangia profunda* |
| SBP00209 | American ginseng_1 | *Zunongwangia profunda* |

Lengthy table referenced here

US12016891-20240625-T00001

Please refer to the end of the specification for access instructions.

Lengthy table referenced here

US12016891-20240625-T00002

Please refer to the end of the specification for access instructions.

Lengthy table referenced here

US12016891-20240625-T00003

Please refer to the end of the specification for access instructions.

Lengthy table referenced here

US12016891-20240625-T00004

Please refer to the end of the specification for access instructions.

Lengthy table referenced here

US12016891-20240625-T00005

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US12016891B2). An electronic copy of the table will also be available from the USPTO upon request and payment of the fee set forth in 37 CFR 1.19(b)(3).

SEQUENCE LISTING (910 sequences)

SEQ ID NO: 1 - DNA, 604 bp, Pantoea sp.
  source 1..604: mol_type = genomic DNA
tgcagtcggacggtagcacagagagcttgctctcgggtgacagtgggggacgggtgagtaatgtctggggatctgcccgatagagggggataaccactggaaacggtggctaataccgcataacgtcgcaagaccaaagagggggaccttcgggcctctcactatcggatgaacccacatgggattagctagtaggcggggtaatggcccacctaggcgacaatccctatctggtctgagaggatgaccacccacactggaactgagacacggtccanactcctacgggaggcagcagtggggaatattgcacaatgggcgcaagcctgatgcacccatgccgcgtgtatgaaaaaagccttcgggttgtaaagtactttcaccggggaggaaggcgatgcggttaataaccccgtcgattgacgttacccgcagaaaaaacaccggctaactccgtgccaccagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgta

SEQ ID NO: 2 - DNA, 952 bp, Clostridium perfringens
  source 1..952: mol_type = genomic DNA
tgcagtcgagcgatgaagtttccttcgggaaacggattagcggcggacgggtgagtaacacgtgggtaacctgcctcatagagtggaatagccttccgaaaggaagattaataccgcataatgttgaaagatggcatcatcattcaaccaaaggagcaatccgctatgagatggacccgcggcgcattagctagttggtggggtaacggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgaggaatcccttcgggga

SEQ ID NO: 3 - DNA, 937 bp, Clostridium perfringens
  source 1..937: mol_type = genomic DNA
tgcagtcgagcgatgaagtttccttcgggaaacggattagcggcggacgggtgagtaacacgtgggtaacctgcctcatagagtggaatagccttccgaaaggaagattaataccgcataatgttgaaagatggcatcatcattcaaccaaaggagcaatccgctatgagatggacccgcggcgcattagctagttggtggggtaacggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgag

SEQ ID NO: 4 - DNA, 953 bp, Clostridium perfringens
  source 1..953: mol_type = genomic DNA
tgcagtcgagcgatgaagtttccttcgggaaacggattagcggcggacgggtgagtaacacgtgggtaacctgcctcatagagtggaatagccttccgaaaggaagattaataccgcataatgttgaaagatggcatcatcattcaaccaaaggagcaatccgctatgagatggacccgcggcgcattagctagttggtggggtaacggcctaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggttttcggatcgtaaagctctgtctttggggaagataatgacggtacccaaggaggaagccacggctaactacgtgccagcagccgcggtaatacgtaggtggcgagcgttatccggatttactgggcgtaaagggagcgtaggcggatgattaagtgggatgtgaaatacccgggctcaacttgggtgctgcattccaaactggttatctagagtgcaggagaggagagtggaattcctagtgtagcggtgaaatgcgtagagattaggaagaacaccagtggcgaaggcgactctctggactgtaactgacgctgaggctcgaaagcgtggggagcaaacaggattagataccctggtagtccacgccgtaaacgatgaatactaggtgtgggggtttcaacacctccgtgccgccgctaacgcattaagtattccgcctggggagtacggtcgcaagattaaaactcaaaggaattgacggggacccgcacaagtagcggagcatgtggtttaattcgaagcaacgcgaagaaccttacctacacttgacatcccttgcattactcttaatcgaggaaatcccttcgggga

SEQ ID NO: 5 - DNA, 904 bp, Clostridioides mangenotii
  source 1..904: mol_type = genomic DNA
tgcagtcgagcgaaccccttcgggggagagcggcggacgggtgagtaacgcgtgggtaacctaccctgtacacacggataacataccgaaaggtatactaatacgtgatgacatatcggacaggcatctgtcagatatcaaaggtcagccggtacaggatggacccgcgtctgattagctagttggtgagataaaagctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggttttcggatcgtaaaactctgtcctcaaggaagataatgacggtacttgaggaggaagccccggctaactacgtgccagcagccgcggtaatacgtagggggctagcgttatccggatttactgggcgtaaagggtgcgtaggcggtctttcaagtcagaagttaaattctacggctcaaccgtagccagcttttgaaactggaagacttgagtgcaggagaggagagtagaattcctagtgtagcggtgaaatgcgtagatattaggaggaataccagtagcgaaggcggctctctggactgtaactgacgctgaggcacgaaagcgtggggagcgaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccc

SEQ ID NO: 6 - DNA, 975 bp, Leuconostoc pseudomesenteroides
  source 1..975: mol_type = genomic DNA
gcncagtcgaaaggtgcttgcacctttcaagtgagtggcgaacgggtgagtaacacgtggacaacctgcctcaaggctggggataacatttggaaacagatgctaataccgaataaaactcagtgtcgcatgacacaaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtacgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaacactangtgttaggaggtttccgcctcttagtgccgaagctaacgcattaagtgttccgcctggggagtacgaccgcanggttgaaactcaaaggaattgacggggacccgcacaagcggtggagcatgtggtttaattcgaagcaacgcgaagaaccttaccaggtcttgacatcctttgaagcttttagagatagaagtgttctcttcg

SEQ ID NO: 7 - DNA, 935 bp, Micrococcus luteus
  source 1..935: mol_type = genomic DNA
tgcagtcgaacgatgaagctcagcttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgta

SEQ ID NO: 8 - DNA, 950 bp, Pediococcus pentosaceus
  source 1..950: mol_type = genomic DNA
gtcgaacgaacttccgttaattgattatgacgtacttgtactgattgagattttaacacgaagtgagtggcgaacgggtgagtaacacgtgggtaacctgcccagaagtaggggataacacctggaaacagatgctaataccgtataacagagaaaaccgcatggttttcttttaaaagatggctctgctatcacttctggatggacccgcggcgtattagctagttggtgaggcaaaggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaa

SEQ ID NO: 9 - DNA, 625 bp, Pseudomonas fluorescens
  source 1..625: mol_type = genomic DNA
tgcaagtcgagcggtagagagaagcttgcttctcttgagagcggcggacgggtgagtaaagcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgt

SEQ ID NO: 10 - DNA, 919 bp, Pseudomonas putida
  source 1..919: mol_type = genomic DNA
gtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcanggttaaaactcaaatgaattgacgggggcccgcacaagcggtggagcatgtggtttaattcgaagcaacgcgaagaaccttacc

SEQ ID NO: 11 - DNA, 988 bp, Bacillus velezensis
  source 1..988: mol_type = genomic DNA
gtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcaga

SEQ ID NO: 12 - DNA, 692 bp, Enterobacter cloacae
  source 1..692: mol_type = genomic DNA
ggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgacagggttaataaccctgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctanagtcttgtagaggggggtagaattccaggtgtagcggtgaaatgcgtanagatctggaggaataccggtggcgaaggcggccccctggacaaagactgacgctca

SEQ ID NO: 13 - DNA, 790 bp, Exiguobacterium acetylicum
  source 1..790: mol_type = genomic DNA
tgcagtcgagcgcaggaaactgacggaactcttcggagggaaggcagcggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtgaggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggtaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgcta

SEQ ID NO: 14 - DNA, 975 bp, Exiguobacterium acetylicum
  source 1..975: mol_type = genomic DNA
tgcagtcgagcgcagganctgacggaactcttcggagggaaggcagcggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtgaggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggtaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtnnggagcaaacaggattagataccctggtagtccacgccgtaaacgatgagtgctangtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttga

SEQ ID NO: 15 - DNA, 923 bp, Pseudomonas putida
  source 1..923: mol_type = genomic DNA
tgcagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacc

SEQ ID NO: 16 - DNA, 977 bp, Sporosarcina aquimarina
  source 1..977: mol_type = genomic DNA
tgcagtcgagcgaatcaataggagcttgctccttgagattagcggcggacgggtgagtaacacgtgggcaacctgccctgcagatggggataactccgggaaaccggggctaataccgaataatcagttccttcgcatgaggggactctgaaagacggtttcggctgtcactgcaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgcgagggaagaacacgtacgggagtaactgcccgtaccttgacggtacctcgtcagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgccttt

SEQ ID NO: 17 - DNA, 949 bp, Achromobacter sp.
  source 1..949: mol_type = genomic DNA
tgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaa

SEQ ID NO: 18 - DNA, 902 bp, Paenibacillus polymyxa
  source 1..902: mol_type = genomic DNA
ataacctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttacc

SEQ ID NO: 19 - DNA, 934 bp, Bacillus cereus
  source 1..934: mol_type = genomic DNA
gtcgagcgatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttacc

SEQ ID NO: 20 - DNA, 757 bp, Leuconostoc miyukkimchii
  source 1..757: mol_type = genomic DNA
ggtgcttgcacctttcaagtgagtggcgaacgggtgagtaacacgtggataacctgcctcaaggctggggataacatttggaaacagatgctaataccgaataaaacttcatcttgcatgagaagaagttaaaaggcgctacggcgtcacctagagatggatccgcggtgcattagttagttggtggggtaaaggcttaccaagacgatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaaaggcattggaaactggtcaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacacta

SEQ ID NO: 21 - DNA, 920 bp, Brevibacillus laterosporus
  source 1..920: mol_type = genomic DNA
gtcgagcgagggtcttcggaccctagcggcggacgggtgagtaacacgtaggcaacctgcctgtaagactgggataacatagggaaacttatgctaataccggatagggttttgcttcgcctgaagcgaaacggaaagatggcgcaagctatcacttacagatgggcctgcggcgcattagctagttggtgaggtaatggctcaccaaggcaacgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgctatttaaataaggtagcaccttgacggtacctaacgagaaagccacggctaactacgtgccagcagccgcggtaatacgtaggtggcaagcgttgtccggaattattgggcgtaaagcgcgcgcaggtggctatgtaagtctgatgttaaagcccgaggctcaacctcggttcgcattggaaactgtgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgctaggtgttaggggtttcaatacccttagtgccgcagctaacgcaataagcactccgcctggggagtacgctcgcaagagtgaaactcaaaggaattgacgggggcccgcacaagcggtggagcatgtggtttaattcgaagcaacgcgaagaaccttacc

SEQ ID NO: 22 - DNA, 947 bp, Rahnella inusitata
  source 1..947: mol_type = genomic DNA
ggagagcttgctctctgggtgacgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcgttgtagttaatagctgcagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgctagagatagctta

SEQ ID NO: 23 - DNA, 968 bp, Rahnella sp.
  source 1..968: mol_type = genomic DNA
tgcaagtcgagcggcagcgggaagtagcttgctactttgccggcgagcggcggacgggtgagtaatgtctgggaaactgcctgatggagggggataactactggaaacggtagctaataccgcatgacctcgaaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgagcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagctta

SEQ ID NO: 24 - DNA, 856 bp, Micrococcus luteus
  source 1..856: mol_type = genomic DNA
atgaagcccagcttgctgggtggattagtggcgaacgggtgagtaacacgtgagtaacctgcccttaactctgggataagcctgggaaactgggtctaataccggataggagcgcctaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcgga

SEQ ID NO: 25 - DNA, 942 bp, Leuconostoc mesenteroides
  source 1..942: mol_type = genomic DNA
gtgagtggctgacgggtgagtaactcgtggagtaccggcgtcgcggctggggataacatttggaaacagatgctaataccgaataaaacttagtgtcgcatgacaaaaagttaaaaggcgcttcggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaataggaaatgattttagtttgacggtaccataccagaaagggacggctaaatacgtgccagcagccgcggtaatacgtatgtcccgagcgttatccggatttattgggcgtaaagcgagcgcagacggtttattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagctttagagatagaagtgttctctt

SEQ ID NO: 26 - DNA, 364 bp, Pichia membranifaciens
  source 1..364: mol_type = genomic DNA
ctgtgtgggcgcacaaaacacctaaacctggagtatacacacgtcaacaaaagatctaaaagaataaaactttcaacaacggatctcttggttctcgcatcgatgaagagcgcagcgaaatgcgatacctagtgtgaattgcagccatcgtgaatcatcgagttcttgaacgcacattgcgcccgtcggtattccggcgggcatgcctgtctgagcgtcgtttccttcttgtgcaccggggtctttgcagatcctctctgcgcanagctggccgtgccactgggccggccgaaaagaaacgttgcggacaaaacgaactacatcgggacgctttggccgccgagcgaaaaaaaaaaccccattg

SEQ ID NO: 27 - DNA, 927 bp, Clostridium sp.
  source 1..927: mol_type = genomic DNA
tcgagcgagggagttccttcgggaacaacctagcggcggacgggtgagtaacacgtgggcaacctgcctcgtagagggggatagccctccgaaaggaggattaataccccataatattgatttatcgcatgatagattaattaaaggagtaatccgctacgagatgggcccgcggcgcattagctagttggtgaggtaacggctcaccaaggccacgatgcgtagccgacctgagagggtgatcggccacattgggactgagacacggcccagactcctacgggaggcagcagtggggaatattgcacaatgggcgaaagcctgatgcagcaacgccgcgtgagtgaagaaggccttcgggttgtaaagctctgtcttcagggacgataatgacggtacctgaggaggaagccacggctaactacgtgccagcagccgcggtaatacgtaggtggcaagcgttgtccggatttactgggcgtaaagggagcgtaggcggatacttaagtgggatgtgaaatacccgggctcaacccgggtgctgcattccaaactgggtatctagagtgcaggagaggaaagtggaattcctagtgtagcggtgaaatgcgtagagattaggaagaacaccagtggcgaaggcgactttctggactgtaactgacgctgaggctcgaaagcgtggggagcaaacaggattagataccctggtagtccacgccgtaaacgatggatactaggtgtgggaggtaccaaccttccgtgccgccgttaacacaataagtatcccgcctggggagtacggtcgcaagattaaaactcaaaggaattgacgggggcccgcacaagcagcggagcatgtggtttaattcgaagcaacgcgaagaaccttacctagacttgacatctcctgaattacctttaata

SEQ ID NO: 28 - DNA, 942 bp, Clostridium thiosulfatireducens
  source 1..942: mol_type = genomic DNA
cccttcggggtgaattagcggcggacgggtgagtaacacgtgggtaacctgccttatagagggggatagccttccgaaaggaagattaataccgcatgaaatgtttttatcgcatggtagaaacatcaaaggagtaatccgctataagatggacccgcggcgcattagctagttggtgaggtaacggcccaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgttttctgggacgataatgacggtaccagaggaggaagccacggctaactacgtgccagcagccgcggtaatacgtaggtggcaagcgttgtccggatttactgggcgtaaaggatgcgtaggcggatgtttaagtgagatgtgaaatacccgagctcaacttgggtgctgcatttcaaactggatatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattgacgggggcccgcacaagcagcggagcatgtggtttaattcgaagcaacgcgaagaaccttacctagacttgacatctcctgaattacccttaatcggggaagcccttcggggcaggaagacag

SEQ ID NO: 29 - DNA, 981 bp, Clostridium sartagoforme
  source 1..981: mol_type = genomic DNA
ggttagctcacgaactttgggtattgccaactctcatggtgtgacgggcggtgtgtacaaggcccgggaacgtattcaccgcgacattctgattcgcgattactagcaactccagcttcatgtaggcgagtttcagcctacaatccgaactgagacaagtttttaagtttagctccaccttgcggtattgcatctttttgtacttgccattgtagcacgtgtgtagccctagacataaggggcatgatgatttgacgtcatccccaccttcctcccggttaacccgggcagtcttgctagagtgctcaacttaatggtagcaactaacaataagggttgcgctcgttgcgggacttaacccaacatctcacgacacgagctgacgacaaccatgcaccacctgtcttcctgtccccgaagggacttcctcgattaagagtaattcaggagatgtcaagtctaggtaaggttcttcgcgttgcttcgaattaaaccacatgctccgctgcttgtgcgggcccccgtcaattcctttgagttttaatcttgcgaccgtactccccaggcggaatacttaatgcgtttgcggcggcacagaggtcatgacaacccctacacctagtattcatcgtttacggcgtggactaccagggtatctaatcctgtttgctccccacgctttcgagcctcagcgtcagttacagtccagagagtcgccttcgccactggtgttcttcctaatctctacgcatttcaccgctacactaggaattccactctcctctcctgcactctagacttccagtttgaaatgcagcacccaagttgagcccgggtatttcacatctcacttaaaaatccgcctacgctccctttacgcccagtaaatccggacaacgctcgccacctacgtattaccgcggctgctggcacgtagttagccgtggcttcctcctcaggtaccgtcattatcgtccctga

SEQ ID NO: 30 - DNA, 949 bp, Paraclostridium bifermentans
  source 1..949: mol_type = genomic DNA
tgcagtcgagcgatctcttcggagagagcggcggacgggtgagtaacgcgtgggtaacctgccctgtacacacggataacataccgaaaggtatactaatacgggataacatataaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggaattactgggcgtaaagggtgcgtaggtggttttttaagtcagaagtgaaaggctacggctcaaccgtagtaagcttttgaaactagagaacttgagtgcaggagaggagagtagaattcctagtgtagcggtgaaatgcgtagatattaggaggaataccagtagcgaaggcggctctctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctgggaagtacgctcgcaagagtgaaactcaaaggaattgacggggacccgcacaagtagcggagcatgtggtttaattcgaagcaacgcgaagaaccttacctaagcttgacatcccactgacctctccctaatcggagatttcccttcggggacagtggtgac

SEQ ID NO: 31 - DNA, 942 bp, Micrococcus aloeverae
  source 1..942: mol_type = genomic DNA
tgcaagtcgaacgatgaagcccagcttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagata

SEQ ID NO: 32 - DNA, 869 bp, Pseudoclavibacter helvolus
  source 1..869: mol_type = genomic DNA
tgcagtcgaacgatgaagcccagcttgctgggtggattagtggcgaacgggtgagtaacacgtgagcaacgtgcccataactctgggataacctccggaaacggtggctaatactggatatctaacacgatcgcatggtctgtgtttggaaagattttttggttatggatcggctcacggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgtggtaggggagattggaattcctggtgtagcggtggaatgcgcagatatcaggaggaacaccgatggcgaaggcagatctctgggccattactgacgctgaggagcgaaagcatggggagcgaacaggattagataccctggtagtccatgccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcgga

SEQ ID NO: 33 - DNA, 958 bp, Hafnia sp.
  source 1..958: mol_type = genomic DNA
gccctcccgaaggttaagctacctacttcttttgcaacccactcccatggtgtgacgggcggtgtgtacaaggcccgggaacgtattcaccgtagcattctgatctacgattactagcgattccgacttcatggagtcgagttgcagactccaatccggactacgacatactttatgaggtccgcttgctctcgcgagtttgcttctctttgtatatgccattgtagcacgtgtgtagccctactcgtaagggccatgatgacttgacgtcatccccaccttcctccggtttatcaccggcagtctcctttgagttcccgacattactcgctggcaacaaaggataagggttgcgctcgttgcgggacttaacccaacatttcacaacacgagctgacgacagccatgcagcacctgtctcacggttcccgaaggcactaagctatctctagcgaattccgtggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacagcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactctagcttgccagtttcaaatgcagttcccaagttaagctcggggatttcacatctgacttaacaaaccgcctgcgtgcgctttacgcccagtaattccgattaacgcttgcaccctccgtattaccgcggctgctggcacggagttagccg

SEQ ID NO: 34 - DNA, 757 bp, Enterobacter sp.
  source 1..757: mol_type = genomic DNA
tgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgta

SEQ ID NO: 35 - DNA, 234 bp, Enterobacter asburiae
  source 1..234: mol_type = genomic DNA
gtctgggaaactgtgtgagggagggggagaactactgtgaacggtagctaataccccatatagtctcaaaaccccagagggggaccttctggcctcttgccatctcatgtgcccccatgggattatctattatgtggggtaatgggtctcctatgcgacaatccctctctgggctgagaggatgaccccccccactgtgactgagacacggtccccactcctacaggaggcgcc

SEQ ID NO: 36 - DNA, 951 bp, Enterobacter asburiae
  source 1..951: mol_type = genomic DNA
tgcagtcgagcggtagcacagagagcttgctctcgggtgacgagcggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcatcaaggttaataaccttggtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttt

SEQ ID NO: 37 - DNA, 864 bp, Kocuria indica
  source 1..864: mol_type = genomic DNA
gctgaagcttggtgcttgcactgggtggatgagtggcgaacgggtgagtaatacgtgagtaacctgcccttgactctgggataagcctgggaaactgggtctaatactggatatgacctcctgtcgcatggtggggggtggaaagggtttgtactggttgtggatgggctcacggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaactcctggtgtagcggtgaaatgcgcagatatcaggaagaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcgga

SEQ ID NO: 38 - DNA, 969 bp, Micrococcus yunnanensis
  source 1..969: mol_type = genomic DNA
cttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacggtttcccctttggggcgggttcacaggtggtgcatgggttgtcgtcagc

SEQ ID NO: 39 - DNA, 1011 bp, Plantibacter flavus
  source 1..1011: mol_type = genomic DNA
tgcagtcgaacgatgaagcccagcttgctgggtggattagtggcgaacgggtgagtaacacgtgagtaacctgcccttgactctgggataagcgttggaaacgacgtctaataccggatacgagcttccaccgcatggtgagttgctggaaagaattttggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacagtggtgcatggttgtcgtcagctcgtgtcgtgagatgttgggtt

SEQ ID NO: 40 - DNA, 938 bp, Bacillus subtilis
  source 1..938: mol_type = genomic DNA
tgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttacc

SEQ ID NO: 41 - DNA, 938 bp, Bacillus mojavensis
  source 1..938: mol_type = genomic DNA
tgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggttccttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttacc

SEQ ID NO: 42 - DNA, 743 bp, Paenibacillus polymyxa
  source 1..743: mol_type = genomic DNA
caacctagcggcggacgggtgagtaacacgtaggcaacctgcccacaagacagggataactaccggaaacggtagctaatacccgatacatccttttcctgcatgggagaaggaggaaagacggagcaatctgtcacttgtggatgggcctgcggcgcattagctagttggtggggtaaaggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtcttgtagagtaactgctacaagagtgacggtacctgagaagaaagccccggctaactacgtgccagcagccgcggtaatacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgcta

SEQ ID NO: 43 - DNA, 969 bp, Lactobacillus brevis
  source 1..969: mol_type = genomic DNA
agcttccgttgaatgacgtgcttgcactgatttcaacaatgaagcgagtggcgaactggtgagtaacacgtggggaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttcaagggttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatctta

SEQ ID NO: 44 - DNA, 912 bp, Sporobolomyces ruberrimus
  source 1..912: mol_type = genomic DNA
ggtgtccatttacttggacccgaacttctcaattctaactttgtgcatctgtattatggcgagcagtcttcggattgtgagccttcacttataaacactagtctatgaatgtaaaatttttataacaaataaaaactttcaacaacggatctcttggctctcgcatcgatgaagaacgcagcgaaatgcgatacgtaatgtgaattgcagaattcagtgaatcatcgaatctttgaacgcatcttgcgctctctggtattccggagagcatgtctgtttgagtgtcatgaattcttcaacccaatcttttcttgtaatcgattggtgtttggattttgagcgctgctggcttcggcctagctcgttcgtaatacattagcatccctaatacaagtttggattgacttggcgtaatagactattcgctaaggattcggtggaaacatcgagccaacttcattaaggaagctcctaatttaaaagtctaccttttgattagatctcaaatcaggcaggattacccgctgaacttaagcatatcaataagcggaggaaaagaaactaacaaggattcccctagtagcggcgagcgaagcgggaaaagctcaaatttgtaatctggcgtcttcgacgtccgagttgtaatctcgagaagtgttttccgtgatagaccgcatacaagtctcttggaacagagcgtcatagtggtgagaacccagtacacgatgcggatgcctattactttgtgatacactttcgaagagtcgagttgtttgggaatgcagctcaaattgggtggtaaattccatctaaagctaaatattggcgagagaccgatagcgaacaagtaccgtgagggaaagatgaaaagcactttggaaagagagttaacagtacgtgaaattgttggaa

SEQ ID NO: 45 - DNA, 808 bp, Holtermanniella takashimae
  source 1..808: mol_type = genomic DNA
gagctggcttcggccgctctgatctatacacacctgtgaactgttggccttcgggtctttaattacaactgtgacgaacgtaaattattataacaaataaaacttttaacaacggatctcttggctctcgcatcgatgaagaacgcagcgaaatgcgataagtaatgtgaattgcagaattcagtgaatcatcgaatctttgaacgcaccttgcgcccgttggtattccgacgggcatgcctgtttgagtgtcgtgaacaacctcaaccttgattggttttaccatcaaggcttggacttgggtgttgctgctgcaaagtggctcgccttaaaactattagctggacttgtctatgacttggttcgactcgatgtaataagtattcatcggggacagggttaaacctggccaaggcttgatgccgtctgcttctaatcatgttctcactatgagacgctactttactgtgtggcctcaaatcaggtaggattacccgctgaacttaagcatatcaataagcggaggaaaagaaactaacaaggattcccctagtaacggcgagtgaagcgggatgagctcaaatttgtaatctggtggactcagttcatccgaattgtaatctatagaaaagttttccgcgctggaccgtgtctaagtcccttggaacagggtgtcagagagggtgagaatcccgtgcttgatacgaccaccagtgctatgtgatactttttcaacgagtcgagttgtttgggaatgcagctcaaaatgggtggtaaattccatctaaagctaaatattggcgagaga

SEQ ID NO: 46 - DNA, 907 bp, Aureobasidium sp.
  source 1..907: mol_type = genomic DNA
gcgcccgacctccaccctttgttgttaaaactaccttgttgctttggcgggaccgctcggttccgagccgctggggattcgtcccaggcgagcgcccgccagagttaaaccaaactcttgttattaaaccggtcgtctgagttaaaattttgaataaatcaaaactttcaacaacggatctcttggttctcgcatcgatgaagaacgcagcgaaatgcgataagtaatgtgaattgcagaattcagtgaatcatcgaatctttgaacgcacattgcgccccttggtattccgaggggcatgcctgttcgagcgtcattacaccactcaagctatgcttggtattgggtgtcgtccttagttgggcgcgccttaaagacctcggcgaggccactccggctttaggcgtagtagaatttattcgaacgtctgtcaaaggagaggaactctgccgattgaaacctttatttttctaggttgacctcggatcaggtagggatacccgctgaacttaagcatatcaataagcggaggaaaagaaaccaacagggattgccctagtaacggcgagtgaagcggcaacagctcaaatttgaaagctagccttcgggttcgcattgtaatttgtagaggatgctttgggtaaaacgccagtctaagttccttggaacaggacgtcatagagggtgagaatcccgtatgtgactggaaatgttaacctatgtaaagctccttcgacgagtcgagttgtttgggaatgcagctctaaatgggaggtaaatttcttctaaagctaaatattggcgagagaccgatagcgcacaagtagagtgatcgaaagatgaaaagcactttggaaagagagttaaaaagcacgtgaaattgttgaaagggaagcgcttgcaatca

SEQ ID NO: 47 - DNA, 949 bp, Yarrowia lipolytica
  source 1..949: mol_type = genomic DNA
ctaattaacgtatcatctcatccaattataactatcaacaacggatctcttggctctcacatcgatgaagaacgcagcgaaccgcgatattttttgtgacttgcagatgtgaatcatcaatctttgaacgcacattgcgcggtatggtattccgtaccgcacggatggaagagcgtgttccctttgggatcgcactgctttcttgaaatgaatctattacttcaatatcatccatttcacctctttcatccgagattacccgctgaacttaagcatatcaataagcggaggaaaagaaaccaacagggattgcctcagtaacggcgagtgaagcggcaaaagctcaaatttgaaaccctcgggattgtaatttgaagatctggcattggagaaagctaacccaagttacttggaatagtacgtcatagagggtgacaaccccgtctggctaaccgttctccatgtattgccttatcaaagagtcgagttgtttgggaatgcagctcaaagtgggtggtaaactccatctaaagctaaatactggtgagagaccgatagcgaacaagtactgtgaaggaaaggtgaaaagaactttgaaaagagagtgaaatagtatgtgaaattgttgatagggaaggaaatgagtggagagtggttgaggtttcagttgtccttcgggatgatgtactgccaacgccgagtcattgtcagcgagacaggggttataaacgggttacacttgtgtttctcacctaacccctccactgccgacaacgacataatccacccatttcacccgtcttgaaacacggaccaaggagtctaatggatatgtgagtgttagggtgctaaccccagcgcgcaatgaaagtgaatgattcgttcagaatcgaccgaacttgatttttatgacagttttgagtaaacacatccattgggacccgaaaga

SEQ ID NO: 48 - DNA, 1219 bp, Lactobacillus paracasei
  source 1..1219: mol_type = genomic DNA
acacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctccttt

SEQ ID NO: 49 - DNA, 1546 bp, Lactococcus garvieae
  source 1..1546: mol_type = genomic DNA
aatgagagtttgatcctggctcaggacgaacgctggcggcgtgcctaatacatgcaagtcgagcgatgattaaagatagcttgctatttttatgaagagcggcgaacgggtgagtaacgcgtgggaaatctgccgagtagcgggggacaacgtttggaaacgaacgctaataccgcataacaatgagaatcgcatgattcttatttaaaagaagcaattgcttcactacttgatgatcccgcgttgtattagctagttggtagtgtaaaggactaccaaggcgatgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaaactctgttgttagagaagaacgttaagtagagtggaaaattacttaagtgacggtatctaaccagaaagggacggctaactacgtgccagcagccgcggtaatacgtaggtcccaagcgttgtccggatttattgggcgtaaagcgagcgcaggtggtttcttaagtctgatgtaaaaggcagtggctcaaccattgtgtgcattggaaactgggagacttgagtgcaggagaggagagtggaattccatgtgtagcggtgaaatgcgtagatatatggaggaacaccggaggcgaaagcggctctctggcctgtaactgacactgaggctcgaaagcgtggggagcaaacaggattagataccctggtagtccacgccgtaaacgatgagtgctagctgtagggagctataagttctctgtagcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgatatccttagagataaggagttccttcgggacacgggatacaggtggtgcatggttgtcgtcagctcgtgtcgtgagatgttgggttaagtcccgcaacgagcgcaacccttattactagttgccatcattaagttgggcactctagtgagactgccggtgataaaccggaggaaggtggggatgacgtcaaatcatcatgccccttatgacctgggctacacacgtgctacaatggatggtacaacgagtcgccaacccgcgagggtgcgctaatctcttaaaaccattctcagttcggattgcaggctgcaactcgcctgcatgaagtcggaatcgctagtaatcgcggatcagcacgccgcggtgaatacgttcccgggccttgtacacaccgcccgtcacaccacggaagttgggagtacccaaagtaggttgcctaaccgcaaggagggcgcttcctaaggtaagaccgatgactggggtgaagtcgtaacaaggtagccgtatcggaaggtgcggctggatcacctccttt

SEQ ID NO: 50 - DNA, 1546 bp, Lactococcus garvieae; identical to SEQ ID NO: 49
  source 1..1546: mol_type = genomic DNA

SEQ ID NO: 51 - DNA, 619 bp, Weissella cibaria
  source 1..619: mol_type = genomic DNA
gatttgaagagcttgctcagatatgacgatggacattgcaaagagtggcgaacgggtgagtaacacgtgggaaacctacctcttagcaggggataacatttggaaacagatgctaataccgtataacaatagcaaccgcatggttgctacttaaaagatggttctgctatcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagagg

SEQ ID NO: 52 - DNA, 988 bp, Debaryomyces hansenii
  source 1..988: mol_type = genomic DNA
aacttttgctttggtctggactagaaatagtttgggccagaggttactaaactaaacttcaatatttatattgaattgttatttatttaattgtcaatttgttgattaaattcaaaaaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaaccttcgggtttggtattgagtgatactcttagtcgaactaggcgtttgcttgaaatgtattggcatgagtggtactggatagtgctatatgactttcaatgtattaggtttatccaactcgttgaatagtttaatggtatatttctcggtattctaggctcggccttacaatataacaaacaagtttgacctcaaatcaggtaggattacccgctgaacttaagcatatcaataagcggaggaaaagaaaccaacagggattgccttagtaacggcgagtgaagcggcaaaagctcaaatttgaaatctggcaccttcggtgtccgagttgtaatttgaagaaggtaactttggagttggctcttgtctatgttccttggaacaggacgtcacagagggtgagaatcccgtgcgatgagatgcccaattctatgtaaagtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaagggaaagggcttgagatcagacttggtattttgcgatcctttccttcttggttgggttcctcgcagcttactgggncagcatcggtttggatgg

SEQ ID NO: 53 - DNA, 1388 bp, Lactobacillus paracasei
  source 1..1388: mol_type = genomic DNA
tgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctccttt

SEQ ID NO: 54 - DNA, 1263 bp, Lactobacillus plantarum
  source 1..1263: mol_type = genomic DNA
tttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatgg

SEQ ID NO: 55 - DNA, 1415 bp, Pichia kudriavzevii
  source 1..1415: mol_type = genomic DNA
tccgtaggtgaacctgcggaaggatcattactgtgatttagtactacactgcgtgagcggaacgaaaacaacaacacctaaaatgtggaatatagcatatagtcgacaagagaaatctacgaaaaacaaacaaaactttcaacaacggatctcttggttctcgcatcgatgaagagcgcagcgaaatgcgatacctagtgtgaattgcagccatcgtgaatcatcgagttcttgaacgcacattgcgcccctcggcattccggggggcatgcctgtttgagcgtcgtttccatcttgcgcgtgcgcagagttgggggagcggagcggacgacgtgtaaagagcgtcggagctgcgactcgcctgaaagggagcgaagctggccgagcgaactagactttttttcagggacgcttggcggccgagagcgagtgttgcgagacaacaaaaagctcgacctcaaatcaggtaggaatacccgctgaacttaagcatatcaataagcggaggaaaagaaaccaacagggattgcctcagtagcggcgagtgaagcggcaagagctcagatttgaaatcgtgctttgcggcacgagttgtagattgcaggttggagtctgtgtggaaggcggtgtccaagtcccttggaacagggcgcccaggagggtgagagccccgtgggatgccggcggaagcagtgaggcccttctgacgagtcgagttgtttgggaatgcagctccaagcgggtggtaaattccatctaaggctaaatactggcgagagaccgatagcgaacaagtactgtgaaggaaagatgaaaagcactttgaaaagagagtgaaacagcacgtgaaattgttgaaagggaagggtattgcgcccgacatggggattgcgcaccgctgcctctcgtgggcggcgctctgggctttccctgggccagcatcggttcttgctgcaggagaaggggttctggaacgtggctcttcggagtgttatagccagggccagatgctgcgtgcggggaccgaggactgcggccgtgtaggtcacggatgctggcagaacggcgcaacaccgcccgtcttgaaacatggaccaaggagtctaacgtctatgcgagtgtttgggtgtgaaacccgtacgcgtaatgaaagtgaacgtaggtcggaccccctgccctcggggaggggagcacgatcgaccgatcccgatgtttatcggaaggatttgagtaggagcatagctgttgggacccgaaagatggtgaactatgcctgaatagggtgaagccagaggaaactctggtggaggctcgtagcggttctgacgtgcaaatcgatcgtcgaatttgggtataggggcgaaagactaatcgaaccatctagtagctggttcctgccgaagtttccctcagga

SEQ ID NO: 56 - DNA, 817 bp, Kocuria rhizophila
  source 1..817: mol_type = genomic DNA
gctgaagcttggtgcttgcactgggtggatgagtggcgaacgggtgagtaatacgtgagtaacctgcccttgactctgggataagcctgggaaactgggtctaatactggatacgacatgtcaccgcatggtggtgtgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgca

SEQ ID NO: 57 - DNA, 487 bp, Pseudomonas koreensis
  source 1..487: mol_type = genomic DNA
attcagcggcggacgggtgagtaatgcctaggaatctgcctggtagtgggggacaacgtttcgaaaggaacgctaataccgcatacgtcctacgggagaaagcaagggaccttcaggccttgcgctatcanatgagcctaagtcggattagctagttggtgaggtaatggctcaccaaggcgacgatccgtaactggtctganaggatgatcagtcacactggaactgagacacggaccagactcctacgggaggcagcagtggggaatattggacaatgggcgaaagcctgatccagccatgccgcgtgtgtgaagaaggtcttcggattgtaaagcactttaagttgggaggaaggggagtagattaatactctgcagttttgacgttaccgacagaataagcaccggctaactctgtgccagcagccgcggtaatacagagggtgcaagcgttaatcggaattactgggcgtaaagcgcgcgta

SEQ ID NO: 58 - DNA, 858 bp, Bacillus subtilis
  source 1..858: mol_type = genomic DNA
tgcagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttaggggtttccgccccttagtgctgcagctaacgcattaagcactccgcctggggagtacggtcgcaagactga

SEQ ID NO: 59 - DNA, 846 bp, Paenibacillus sp.
  source 1..846: mol_type = genomic DNA
tgcagtcgagcggacttgatgagaagcttgcttctctgatagttagcggcggacgggtgagtaacacgtaggcaacctgcctgtaagactgggataactaccggaaacggtagctaataccggatagctggttttctcgcatgagagaatcatgaaagacggagcaatctgtcacttacggatgggcctgcggcgcattagctagttggtgaggtaatggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttagagagtaactgctctaagagtgacggtacctgagaagaaagccccggctaactacgtgccagcagccgcggtaatacgtagggggcaagcgttgtccggaattattgggcgtaaagcgcgcgcaggcggctatgtaagtctggtgtataacctcggggctcaaccccgggtcgcactggaaactgtgtagcttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagta

SEQ ID NO: 60 - DNA, 876 bp, Bacillus megaterium
  source 1..876: mol_type = genomic DNA
tgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattga

SEQ ID NO: 61 - DNA, 927 bp, Priesta endophytica
  source 1..927: mol_type = genomic DNA
tgcagtcgagcggagttttgaaaagcttgcttttcaaaacttagcggcggacgggtgagtaacacgtgggcaacctgcccttgagacggggataactccgggaaaccggagctaataccggataacacatatcttcgcatgaggatatgttagaaggtggcttttagctaccactcaaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtatctgttgaataagcaggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaactcaaaggaattgacggggacccgcacaagcggtggagcatgtggtttaattcgaagcacgcga

SEQ ID NO: 62 - DNA, 610 bp, Brevibacterium frigoritolerans
  source 1..610: mol_type = genomic DNA
tgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccaaactcctacgggaggcagcagtagggaatcttccgcaatggacgaaagtctgacggagcaacgccgcgtgaacgaaaaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgca

SEQ ID NO: 63 - DNA, 612 bp, Bacillus paralicheniformis
  source 1..612: mol_type = genomic DNA
tgcagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcaacgatgcgtagccgacctgaaagggtgatcggccacactgggactgaaacacggcccaaactcctacgggaggcagcagtagggaatcttccgcaatggacgaaagtctgacggagcaacgccgcgtgagtgatgaaggttttcggatcgtaaaactctgttgttagggaagaacaagtaccgttcaaatagggcggtaccttgacggtacctaaccaaaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgca

SEQ ID NO: 64 - DNA, 858 bp, Brevibacterium frigoritolerans
  source 1..858: mol_type = genomic DNA
tgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctga

SEQ ID NO: 65 - DNA, 333 bp, Bacillus drentensis
  source 1..333: mol_type = genomic DNA
tagcggcggacgggtgagtaacacgtgggcaacctgcctgtaagactgggataacaccgggaaaccggtgctaataccggataatccttttcctctcatgaggaaaagctgaaaggcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttc

SEQ ID NO: 66 - DNA, 906 bp, Brevibacterium frigoritolerans
  source 1..906: mol_type = genomic DNA
gggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcga

SEQ ID NO: 67 - DNA, 766 bp, Brevibacillus laterosporus
  source 1..766: mol_type = genomic DNA
tgcaagtcgagcgagggtcttcggaccctagcggcggacgggtgagtaacacgtaggcaacctgcctgtaagactgggataacatagggaaacttatgctaataccggatagggttttgcttcgcctgaagcgaaacggaaagatggcgcaagctatcacttacagatgggcctgcggcgcattagctagttggtgaggtaatggctcaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgctatttaaataaggtagcaccttgacggtacctaacgagaaagccacggctaactacgtgccagcagccgcggtaatacgtaggtggcaagcgttgtccggaattattgggcgtaaagcgcgcgcaggtggctatgtaagtctgatgttaaagcccgaggctcaacctcggttcgcattggaaactgtgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgct

SEQ ID NO: 68 - DNA, 830 bp, Pseudomonas rhodesiae
  source 1..830: mol_type = genomic DNA
tgcagtcgagcggtagagagaagcttgcttctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggccattacctaatacgtgatggttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagta

SEQ ID NO: 69 - DNA, 746 bp, Stenotrophomonas maltophilia
  source 1..746: mol_type = genomic DNA
ggcagcacagaggagcttgctccttgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacaggattagataccctggtagtccacgccct

SEQ ID NO: 70 - DNA, 899 bp, Pichia terricola
  source 1..899: mol_type = genomic DNA
ctgcgtgcgcgtaacaaacccctaaacatgaataacctagtcaagaatccataagaataaaactttcaacaacggatctcttggttctcgcatcgatgaagagcgcagcgaaatgcgatacctagtgtgaattgcagccatcgtgaatcatcgagttcttgaacgcacattgcgccccctggtattccggggggcatgcctgtttgagcgtcgtttctatctcacgcaagtggagctggcccggccttggccccgccgaaaagaaacgagggcgaagcgaactatgttgtgcgccgaccccagctatcaagctcgacctcaaatcaggtaggaatacccgctgaacttaagcatatcaataagcggaggaaaagaaaccaacagggattgcctcagtagcggcgagtgaagcggcaagagctcagatttgaaatcgcctcggcgagttgtaaattgcaggttggagtctttgtggcggcgtgtgtctaagtcccttggaacagggcgccattgagggtgagagccccgtgcggcacgcgtccaagctttaagacccttctgacgagtcgagttgtttgggaatgcagctctaagtgggtggtaaattccatctaaggctaaatactggcgagagaccgatagcgaacaagtactgtgaaggaaagatgaaaagcactttgaaaagagagtgaaacagcacgtgaaattgttgaaagggaagggtattgggctcgacatggggactgcgcaccgttgcttcttgtaggcggcgctctgtgcggtttctgggccagcatcagtttttgccgcgggagaatggggggaggaacgtggctcttcggagtgttatagcctctctcagatgccgcgagcggggactgaggtctgcgattcgttca

SEQ ID NO: 71 - DNA, 848 bp, Clavispora fructus
  source 1..848: mol_type = genomic DNA
tacgatatctaaacaaaatcaattttttttcttcaatacaacaaaaaaatcaaaactttcaacaacggatctcttggttctcgcatcgatgaagaacgcagcgaattgcgatacgtagtatgacttgcagacgtgaatcatcgaatctttgaacgcacattgcgcctcgaggtattcctcgaggcatgcctgtttgagcgtcggccccccctctaacccccgggttaggtgttgacacgaaattccaagcgcaatcaatctcatgtttttgatgacgcccacccatttcgccctcaaatcaggtaggactacccgctgaacttaagcatatcaataagcggaggaaaagaaaccaacagggattgcctcagtaacggcgagtgaagcggcaaaagctcaaatttgaaatcccgcgggagttgtaatttgaaggtttcgggttctgaggctgtgcgcgcccaagtccattggaacatggcgcctgggagggtgagagccccgtccggcgctgcgcagtctttttttgcgacccgtttccgacgagtcgagttgtttgggaatgcagctcaaagtgggtggtaaattccatctaaagctaaatattggcgagagaccgatagcgaacaagtacagtgatggaaagatgaaaagcactttgaaaagagagtgaaacagtacgtgaaattgttgaaagggaagggcttgcaagcagacacggtttcggccgggccagcatcggtttgccggggcggacaatgcggcgggaatgtggcgcgtctccttgtggggcgcgtgtttatagcccggcgtgatacgcccatggtagaccgaggcctgcgatctaatct

SEQ ID NO: 72 - DNA, 843 bp, Hanseniaspora occidentalis
  source 1..843: mol_type = genomic DNA
cttttgattttttggggttgcttcgaacttgcagacagagtgtcgagacttgtgagcctgcgcttaattgcgcggcctagagtcgagtgcttgttattggctgcgagggacgagtgccttttgaaaaaatccattacacactgtgaagattttttttcatacattttacttctttggggctttcgagctccaaaggctataaacacaaaccaaacttttttttttattatttgttaatcaagaaattttcttattgaaattaaatattttaaaactttcaacaacggatctcttggttctcgcatcgatgaagaacgtagcgaattgcgataagtaatgtgaattgcagattctcgtgaatcattgaatttttgaacgcacattgcgccctctggtattccagggggcatgcctgtttgagcgtcatttccttctcaaaatctcgattttggttgtgagtgatactctgttacagggttaacttgaaagtgctattgccctagctactcttttttttacttgctaagaaaaagatttttggataatttcaatgtatttaggtatttataccgactttcattggatgctgagagtcttgtctaagcgcttttgtgagatttgagcagaagggattaacagtattcataaagtttgacctcaaatcaggtaggattacccgctgaacttaagcatatcaataagcggaggaaaagaaaccaaccgggattgcctcagtaacggcgagtgaagcggcaaaagctcaaatttgaaatctggcactttcagtgtccgagttgtaatttgtagaagtagttttgggactggtccttatctatgtttctt

SEQ ID NO: 73 - DNA, 817 bp, Hanseniaspora uvarum
  source 1..817: mol_type = genomic DNA
ttgttgctcgagttcttgtttagatcttttacaataatgtgtatctttactgaagatgtgcgcttaattgcgctgcttctttagagtgtcgcagtgaaagtagtcttgcttgaatctcagtcaacgctacacacattggagtttttttactttaatttaattctttctgctttgaatcgaaaggttcaaggcaaaaaacaaacacaaacaattttattttattataattttttaaactaaaccaaaattcctaacggaaattttaaaataatttaaaactttcaacaacggatctcttggttctcgcatcgatgaagaacgtagcgaattgcgataagtaatgtgaattgcagatactcgtgaatcattgaatttttgaacgcacattgcgcccttgagcattctcaggggcatgcctgtttgagcgtcatttccttctcaaaagataatttattattttttggttgtgggcgatactcagggttagcttgaaattggagactgtttcagtcttttttaattcaacacttagcttctttggagacgctgttctcgctgtgatgtatttatggatttattcgttttactttacaagggaaatggtaacgtaccttaggcaaagggttgcttttaatattcatcaagtttgacctcaaatcaggtaggattacccgctgaacttaagcatatcaataagcggaggaaaagaaaccaactgggattaccttagtaacggcgagtgaagcggtaaaagctcaaatttgaaatctggtactttcagtgcccgagttgtaatttgtagaatttgtctttgatt

SEQ ID NO: 74 - DNA, 950 bp, Pichia fermentans
  source 1..950: mol_type = genomic DNA
cactgcgtgggcgacacgaaacaccgaaaccgaacgcacgccgtcaagcaagaaatccacaaaactttcaacaacggatctcttggttctcgcatcgatgaagagcgcagcgaaatgcgatacctagtgtgaattgcagccatcgtgaatcatcgagttcttgaacgcacattgcgcccgctggtattccggcgggcatgcctgtctgagcgtcgtttccttcttggagcggagcttcagacctggcgggctgtctttcgggacggcgcgcccaaagcgaggggctttctgcgcgaactagactgtgcgcgcggggcggccggcgaacttattaccaagctcgacctcagatcaggcaggagtacccgctgaacttaagcatatcaataagcggaggaaaagaaaccaacagggattgccccagtagcggcgagtgaagcggcaaaagctcagatttggaatcgcttcggcgagttgtgaattgcaggttggcgcctctgcggcggcggcggtccaagtcccttggaacagggcgccattgagggtgagagccccgtgggaccgtttgcctaagctctgaggcccttctgacgagtcgagttgtttgggaatgcagctctaagcgggtggtaaattccatctaaggctaaatactggcgagagaccgatagcgaacaagtactgtgaaggaaagatgaaaagcactttgaaaagagagtgaaacagcacgtgaaattgttgaaagggaagggtattgcgcccgacatggagcgtgcgcaccgctgcccctcgtgggcggcgctctgggcgtgctctgggccagcatcggtttttgccgcgggagaagggcggcgggcatgtagctcttcggagtgttatagcctgccgccggcgccgcgagcggggaccgaggactgcgacttttgtctcggatgctggcacaacggcgc

SEQ ID NO: 75 - DNA, 592 bp, Pseudomonas fluorescens
  source 1..592: mol_type = genomic DNA
agcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaaattaatactttgctgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtgga

SEQ ID NO: 76 - DNA, 620 bp, Rahnella aquatilis
  source 1..620: mol_type = genomic DNA
tcgagcggcagcgggaagtagcttgctactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggtgcagtgttaatagcactgtgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattcca

SEQ ID NO: 77 - DNA, 740 bp, Paenibacillus amylolyticus
  source 1..740: mol_type = genomic DNA
tgcagtcgagcggacttgatgagaagcttgcttctctgatggttagcggcggacgggtgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacagga

SEQ ID NO: 78 - DNA, 875 bp, Bacillus licheniformis
  source 1..875: mol_type = genomic DNA
tgcagtcgagcggaccgacgggagcttgctcccttaggtcagcggcggacgggtgagtaacacgtgggtaacctgcctgtaagactgggataactccgggaaaccggggctaataccggatgcttgtttgaaccgcatggttcaaacataaaaggtggcttttcgctaccacttacagatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacatgtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaactcaaaggaattga

SEQ ID NO: 79 - DNA, 914 bp, Brevibacillus fluminis
  source 1..914: mol_type = genomic DNA
tgcagtcgagcgagttccttcgggggctagcggcggacgggtgagtaacacgtaggcaacctgcctgtaagactgggataacatagggaaacttatgctaataccagatagagttttggatcgcatggtccgaaacggaaaggtggcgcaagctatcacttacagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctctcgggtcgtaaagttctgttgttagggacgaacaagtgccgttcgaatagggcggcaccttgacggtacctaacgagaaagccacggctaactacgtgccagcagccgcggtaatacgtaggtggcaagcgttgtccggaattattgggcgtaaagcgcgcgcaggcggttatgtaagtctgatgttaaagcccggggctcaacctcggtccgcattggaaactgtgtaacttgagtgcagaagaggaaagtggtattccacgtgtagcggtgaaatgcgtagagatgtggaggaacaccagtggcgaaggcgactttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaa

SEQ ID NO: 80 - DNA, 833 bp, Clavispora fructus
  source 1..833: mol_type = genomic DNA
aaatcaattttttttcttcaatacaacaaaaaaatcaaaactttcaacaacggatctcttggttctcgcatcgatgaagaacgcagcgaattgcgatacgtagtatgacttgcagacgtgaatcatcgaatctttgaacgcacattgcgcctcgaggtattcctcgaggcatgcctgtttgagcgtcggccccccctctaacccccgggttaggtgttgacacgaaattccaagcgcaatcaatctcatgtttttgatgacgcccacccatttcgccctcaaatcaggtaggactacccgctgaacttaagcatatcaataagcggaggaaaagaaaccaacagggattgcctcagtaacggcgagtgaagcggcaaaagctcaaatttgaaatcccgcgggagttgtaatttgaaggtttcgggttctgaggctgtgcgcgcccaagtccattggaacatggcgcctgggagggtgagagccccgtccggcgctgcgcagtctttttttgcgacccgtttccgacgagtcgagttgtttgggaatgcagctcaaagtgggtggtaaattccatctaaagctaaatattggcgagagaccgatagcgaacaagtacagtgatggaaagatgaaaagcactttgaaaagagagtgaaacagtacgtgaaattgttgaaagggaagggcttgcaagcagacacggtttcggccgggccagcatcggtttgccggggcggacaatgcggcgggaatgtggcgcgtctccttgtggggcgcgtgtttatagcccggcgtgatacgcccatggtagaccgaggcctgcgatctaatct

SEQ ID NO: 81 - DNA, 701 bp, Candida mesenterica
  source 1..701: mol_type = genomic DNA
ctgttcttttttaaaaaaaccatttactaattctaatttttatattaaaactttcaacaacggatctcttggttctcgcatcgatgaagaacgcagcgaaatgcgatacgtaatacgaattgcagctctcggaatcatcgaatctttgaacgcacattgcaccgtggggtattccccacggtatgcattgatgagcggtaaactccctcgtctacgacggtcttgccactaaagaaaaaagttcaatatcaaaaacattgtcctcttctcctttccctcatcaatgtaagactacccgctgaacttaagcatatcaataagcggaggaaaagaaaccaacagggattgcctcagtaacggcgagtgaagcggcaaaagctcaaatttgaaacctttcaggattgtaatttgaagatggcatcaaaaaaaggctgaaaacttatgttccttggaacaggacgtcacagagggtgagaatcccgtgcagttcaacgccctacctttcttgccatcaaagagtcgagttgtttgggaatgcagctcaaagtgggtggtaaattccatctaaagctaaatactggcgagagaccgatagcgaacaagtaccgtgagggaaagatgaaaagcactttgaaaagagagtgaaacagtacgtgaaattgttgaaagggaagggcatgaagatagattgtgagggtcgt

SEQ ID NO: 82 - DNA, 943 bp, Enterobacter sp.
  source 1..943: mol_type = genomic DNA
tgcagtcgaacggtagcacagagagcttgctcttgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccacagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccac

SEQ ID NO: 83 - DNA, 859 bp, Debaryomyces hansenii
  source 1..859: mol_type = genomic DNA
gcttattgcgcggcgaaaaaccttacacacagtgttttttgttattacaagaacttttgctttggtctggactagaaatagtttgggccagaggtttactgaactaaacttcaatatttatattgaattgttatttatttaattgtcaatttgttgattaaattcaaaaaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaaccttcgggtttggtattgagtgatactcttagttgaactaggcgtttgcttgaaatgtattggcatgagtggtactggatagtgctatatgactttcaatgtattaggtttatccaactcgttgaatagtttaatggtatatttctcggtattctaggctcggccttacaatataacaaacaagtttgacctcaaatcaggtaggattacccgctgaacttaagcatatcaataagcggaggaaaagaaaccaacagggattgccttagtaacggcgagtgaagcggcaaaagctcaaatttgaaatctggcaccttcggtgtccgagttgtaatttgaagaaggtaactttggagttggctcttgtctatgttccttggaacaggacgtcacagagggtgagaatcccgtgcgatgagatgcccaattctatgtaaagtgctttcgaagagtcgagttgtttgggaatgcagctctaagtgggtggtaaattccatctaaagctaaatattgg

SEQ ID NO: 84 - DNA, 598 bp, Erwinia toletana
  source 1..598: mol_type = genomic DNA
ctactctgtcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaa

SEQ ID NO: 85 - DNA, 917 bp, Aureobasidium pullulans
  source 1..917: mol_type = genomic DNA
tcagcgcccgacctccaccctttgttgttaaaactaccttgttgctttggcgggaccgctcggtctcgagccgctggggattcgtcccaggcgagcgcccgccagagttaaaccaaactcttgttatttaaccggtcgtctgagttaaaattttgaataaatcaaaactttcaacaacggatctcttggttctcgcatcgatgaagaacgcagcgaaatgcgataagtaatgtgaattgcagaattcagtgaatcatcgaatctttgaacgcacattgcgccccttggtattccgaggggcatgcctgttcgagcgtcattacaccactcaagctatgcttggtattgggcgtcgtccttagttgggcgcgccttaaagacctcggcgaggccactccggctttaggcgtagtagaatttattcgaacgtctgtcaaaggagaggaactctgccgactgaaacctttatttttctaggttgacctcggatcaggtagggatacccgctgaacttaagcatatcaataagcggaggaaaagaaaccaacagggattgccctagtaacggcgagtgaagcggcaacagctcaaatttgaaagctagccttcgggttcgcattgtaatttgtagaggatgatttggggaagccgcctgtctaagttccttggaacaggacgtcatagagggtgagaatcccgtatgtgacaggaaatggcaccctatgtaaatctccttcgacgagtcgagttgtttgggaatgcagctctaaatgggaggtaaatttcttctaaagctaaatattggcgagagaccgatagcgcacaagtagagtgatcgaaagatgaaaagcactttggaaagagagttaaaaagcacgtgaaattgttgaaagggaagcgcttgcaatcagacttgt

SEQ ID NO: 86 - DNA, 797 bp, Debaryomyces hansenii
  source 1..797: mol_type = genomic DNA
gcgcttattgcgcggcgaaaaaaccttacacacagtgttttttgttattacaagaacttttgctttggtctggactagaaatagtttgggccagaggtttactgaactaaacttcaatatttatattgaattgttatttatttaattgtcaatttgttgattaaattcaaaaaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaaccttcgggtttggtattgagtgatactcttagttgaactaggcgtttgcttgaaatgtattggcatgagtggtactggatagtgctatatgactttcaatgtattaggtttatccaactcgttgaatagtttaatggtatatttctcggtattctaggctcggccttacaatataacaaacaagtttgacctcaaatcaggtaggattacccgctgaacttaagcatatcaataagcggaggaaaagaaaccaacagggattgccttagtaacggcgagtgaagcggcaaaagctcaaatttgaaatctggcaccttcggtgtccgagttgtaatttgaagaaggtaactttggagttggctcttgtctatgttccttggaacaggacgtcacagagggtgagaatcccgtgcgatgagatgcccaattctatgtaaagtgctttcgaa

SEQ ID NO: 87 - DNA, 783 bp, Arthrobacter protophormiae
  source 1..783: mol_type = genomic DNA
atgcagtcgaacgatgaagcccagcttgctgggtggattagtggcgaacgggtgagtaacacgtgggtaacctgcccctgactctgggataagcccgggaaactgggtctaataccggatatgacttttgaccgcatggttgagggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctatcgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgta

SEQ ID NO: 88 - DNA, 645 bp, Rhodococcus cercidiphylli
  source 1..645: mol_type = genomic DNA
tgcagtcgagcggtaaggcctttcggggtacacgagcggcgaacgggtgagtaacacgtgggtgatctgccctgcactctgggataagcttgggaaactgggtctaataccggatatgaccgcatgccgcatggtgtgtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaa

SEQ ID NO: 89 - DNA, 413 bp, Microbacterium sp.
  source 1..413: mol_type = genomic DNA
cttgctctgtgggatcattggcgaacgggtgagtaacacgtgagcaacctgcccctgactctgggataagcgctggaaacggcgtctaatactggatacaagtaccgaccgcatggtcaactactggaaagatttattggttggggatgggctcgcggcctatcagcttgttggtgaggtaatggctcaccaaggcctccacgggtagccggcctganagggtgaccggccacactgggactgagacacggcccacactcctacgggaggcancagtggggaatattgcacaatgggcgcaagcctgatgcatcaacgccacgtgagggatgacggccttcgggttgtaaacgtcttttancacggaagaagcgaaagtgacggtacctgcataaaaagcgccggctaactac

SEQ ID NO: 90 - DNA, 915 bp, Meyerozyma caribbica
  source 1..915: mol_type = genomic DNA
accttacacacagtgtctttttgatacagaactcttgctttggtttggcctagagataggttgggccagaggtttaacaaaacacaatttaattatttttattgatagtcaaattttgaattaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaacccccgggtttggtattgagtgatactcttagtcgaactaggcgtttgcttgaaaagtattggcatgggtagtactggatagtgctgtcgacctctcaatgtattaggtttatccaactcgttgaatggtgtggcgggatatttctggtattgttggcccggccttacaacaaccaaacaagtttgacctcaaatcaggtaggaatacccgctgaacttaagcatatcaataagcggaggaaaagaaaccaacagggattgccttagtagcggcgagtgaagcggcaaaagctcaaatttgaaatctggcaccttcggtgtccgagttgtaatttgaagattgtaaccttggggttggctcttgtctatgtttcttggaacaggacgtcacagagggtgagaatcccgtgcgatgagatgcccaatcctatgtaaggtgctttcgaagagtcgagttgtttgggaatgcagctctaagtgggtggtaaattccatctaaagctaaatattggcgagagancgatagcgaacaagtacagtgatggaaagatgaaaagaactttgaaaagagagtgaaaaagtacgtgaaattgttgaaagggaagggtttgagatca

SEQ ID NO: 91 - DNA, 957 bp, Meyerozyma caribbica
  source 1..957: mol_type = genomic DNA
gcttactgcgcggcgaaaaaccttacacacagtgtctttttgatacagaactcttgctttggtttggcctagagataggttgggccagaggtttaacaaaacacaatttaattatttttattgatagtcaaattttgaattaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaacccccgggtttggtattgagtgatactcttagtcgaactaggcgtttgcttgaaaagtattggcatgggtagtactggatagtgctgtcgacctctcaatgtattaggtttatccaactcgttgaatggtgtggcgggatatttctggtattgttggcccggccttacaacaaccaaacaagtttgacctcaaatcaggtaggaatacccgctgaacttaagcatatcaataagcggaggaaaagaaaccaacagggattgccttagtagcggcgagtgaagcggcaaaagctcaaatttgaaatctggcaccttcggtgtccgagttgtaatttgaagattgtaaccttggggttggctcttgtctatgtttcttggaacaggacgtcacagagggtgagaatcccgtgcgatgagatgcccaatcctatgtaaggtgctttcgaagagtcgagttgtttnnaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaagggaagggtttgagatcagactcgatattttgtgagccttgc

SEQ ID NO: 92 - DNA, 498 bp, Candida asparagi
  source 1..498: mol_type = genomic DNA
ctgganacgatatctaaacaaaatcaattttttttcttcaatacaacaaaaaaatcaaaactttcaacaacggatctcttggttctcgcatcgatgaagaacgcagcgaattgcgatacgtagtatgacttgcagacgtgaatcatcgaatctttgaacgcacattgcgcctcgaggtattcctcgaggcatgcctgtttgagcgtcggccccccctctaacccccgggttaggtgttgacacgaaattccaagcgcaatcaatctcatgtttttgatgacgcccacccatttcgccctcaaatcaggtaggactacccgctgaacttaagcatatcaataagcggaggaaaagaaaccaacagggattgcctcagtaacggcgagtgaagcggcaaaagctcaaatttgaaatcccgcgggagttgtaatttgaaggtttcnggttctgaggctgtgcgcgcccaagtccattggnacatggcgcctgggagggtga

SEQ ID NO: 93 - DNA, 880 bp, Bacillus megaterium
  source 1..880: mol_type = genomic DNA
acatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggccacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgac

SEQ ID NO: 94 - DNA, 657 bp, Paenibacillus alvei
  source 1..657: mol_type = genomic DNA
tgcagtcgagcggacttgatggagtgcttgcactcctgatggttagcggcggacgggtgagtaacacgtaggtaacctgcccataagactgggataacccacggaaacgtgagctaataccagataggcattttcctcgcatgagggagatgagaaaggcggagcaatctgccacttatggatggacctgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgcctaggagagtaactgctcttagggtgacggtacctgagaagaaagccccggctaactacgtgccagcagccgcggtaatacgtagggggcgagcgttgtccggaattattgggcgtaaagcgcgcgcaggcggcaatgtaagttgggtgtttaaacctagggctcaaccttgggtcgcatccaaaactgcatagcttgagtacagaagaggaaagtggaattccacgtgtagcggtgaaatgcgtaga

SEQ ID NO: 95 - DNA, 619 bp, Bacillus sp.
  source 1..619: mol_type = genomic DNA
acatgcagtcgagcgaatgacgaagaagctgtgcttcttctgatttagcggcggacgggtgagtaacacgtgggcaacctgccctgtagattgggataactccgggaaaccggggctaataccgaataatccatttcctcacatgtggaaatgttaaaagacggtttacgctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaatcccacggctcaaccgtggaaggtcattggaaactgggggacttgagtacagaa

SEQ ID NO: 96 - DNA, 847 bp, Bacillus pumilus
  source 1..847: mol_type = genomic DNA
acatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagta

SEQ ID NO: 97 - DNA, 967 bp, Talaromyces stolii
  source 1..967: mol_type = genomic DNA
acctcccacccttgtctctatacacctgttgctttggcgggcccaccggggccacctggtcgccgggggacgttcgtccccgggcccgcgcccgccgaagcgctctgtgaaccctgatgaagatgggctgtctgagtactatgaaaattgtcaaaactttcaacaatggatctcttggttccggcatcgatgaagaacgcagcgaaatgcgataagtaatgtgaattgcagaattccgtgaatcatcgaatctttgaacgcacattgcgccccctggcattccggggggcatgcctgtccgagcgtcatttctgccctcaagcacggcttgtgtgttgggtgcggtccccccgggggcctgcccgaaaggcagcggcgacgtccgtctggtcctcgagcgtatggggctttgtcactcgctcgggaaggactggcgggggttggtcaccaccacaaaattttaccacggttgacctcggatcaggtaggagttacccgctgaacttaagcatatcaataagcggaggaaaagaaaccaaccgggattgcctcagtaacggcgagtgaagcggcaagagctcaaatttgaaatctggccccctcggggtccgagttgtaatttgcagaggatgcttcgggagcggtccccatctaagtgccctggaacgggccgtcatagagggtgagaatcccgtctgggatgggcggccgcgcccgtgtgaagctccttcgacgagtcgagttgtttgggaatgcagctctaagcgggtggtaaatttcatctaaagctaaatactggccggagaccgatagcgcacaagtagagtgatcgaaagatgaaaagcactttgaaaagagagttaaacagcacgtgaaattgttgaaagggaagcgttgtccaccagactcgcccgggggggttcagccggcacgtgtgccggtgtactcctctccgggcgggccagca

SEQ ID NO: 98 - DNA, 926 bp, Fusarium subglutinans
  source 1..926: mol_type = genomic DNA
taccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggactcgcgagtcaaatcgcgttccccaaattgattggcggtcacgtcgagcttccatagcgtagtagtaaaaccctcgttactggtaatcgtcgcggccacgccgttaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggaggtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggttaatcatctggggttctccccagtgcacttttccagtccaggccagcatcagttttcc

SEQ ID NO: 99 - DNA, 973 bp, Hanseniaspora uvarum
  source 1..973: mol_type = genomic DNA
ttgttgctcgagttcttgtttagatcttttacaataatgtgtatctttactgaagatgtgcgcttaattgcgctgcttctttagagtgtcgcagtgaaagtagtcttgcttgaatctcagtcaacgctacacacattggagtttttttactttaatttaattctttctgctttgaatcgaaaggttcaaggcaaaaaacaaacacaaacaattttattttattataattttttaaactaaaccaaaattcctaacggaaattttaaaataatttaaaactttcaacaacggatctcttggttctcgcatcgatgaagaacgtagcgaattgcgataagtaatgtgaattgcagatactcgtgaatcattgaatttttgaacgcacattgcgcccttgagcattctcaggggcatgcctgtttgagcgtcatttccttctcaaaagataatttattattttttggttgtgggcgatactcagggttagcttgaaattggagactgtttcagtcttttttaattcaacacttagcttctttggagacgctgttctcgctgtgatgtatttatggatttattcgttttactttacaagggaaatggtaacgtaccttaggcaaagggttgcttttaatattcatcaagtttgacctcaaatcaggtaggattacccgctgaacttaagcatatcaataagcggaggaaaagaaaccaactgggattaccttagtaacggcgagtgaagcggtaaaagctcaatttgaaatctggtactttcagtgcccgagttgtaatttgtagaatttgtctttgattangtccttgtctatgttccttggaacaggacgtcatagagggtgagaatcccgtttggcgaggataccttttctctgtaagactttttcgaagagtcgagttgtttgggaatgcagctcaaagtgggtggtaaattccatctaaagctaaatattgg

SEQ ID NO: 100 - DNA, 914 bp, Fusarium pseudocircinatum
  source 1..914: mol_type = genomic DNA
aacccctgtgacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcccagcttggtgttgggactcgcgagtcaaatcgcgttccccaaattgattggcggtcacgtcgagcttccatagcgtagtagtaaaaccctcgttactggtaatcgtcgcggccacgccgttaaaccccaacttctgaatgttgacctcggatcaggtaggaatacccgctgaacttaagcatatcaataagcggaggaaaagaaaccaacagggattgccctagtaacggcgagtgaagcggcaacagctcaaatttgaaatctggctctcgggcccgagttgtaatttgtagaggatacttttgatgcggtgccttccgagttccctggaacgggacgccatagagggtgagagccccgtctggttggatgccaaatctctgtaaagttccttcgacgagtcgagtagtttgggaatgctgctctaaatgggangtatatgtcttctaaagctaaataccggccagagaccgatagcgcacaagtagagtgatcgaaagatgaaaagcactttgaaaagagagttaaaaagtacgtgaaattgttgaaagggaagcgtttatgaccagacttgggcttggnttaatcatctggggttctccccagtgcactttt

SEQ ID NO: 101 - DNA, 1000 bp, Pichia fermentans
  source 1..1000: mol_type = genomic DNA
cacactgcgtgggcgacacgaaacaccgaaaccgaacgcacgccgtcaagcaagaaatccacaaaactttcaacaacggatctcttggttctcgcatcgatgaagagcgcagcgaaatgcgatacctagtgtgaattgcagccatcgtgaatcatcgagttcttgaacgcacattgcgcccgctggtattccggcgggcatgcctgtctgagcgtcgtttccttcttggagcggagcttcagacctggcgggctgtctttcgggacggcgcgcccaaagcgaggggccttctgcgcgaactagactgtgcgcgcggggcggccggcgaacttataccaagctcgacctcagatcaggcaggagtacccgctgaacttaagcatatcaataagcggaggaaaagaaaccaacagggattgccccagtagcggcgagtgaagcggcaaaagctcagatttggaatcgcttcggcgagttgtgaattgcaggttggcgcctctgcggcggcggcggtccaagtcccttggaacagggcgccattgagggtgagagccccgtgggaccgtttgcctatgctctgaggcccttctgacgagtcgagttgtttgggaatgcagctctaagcgggtggtaaattccatctaaggctaaatactggcgagagaccgatagcgaacaagtactgtgaaggaaagatgaaaagcactttgaaaagagagtgaaacagcacgtgaaattgttgaaagggaagggtattgcgcccgacatggagcgtgcgcaccgctgcccctcgtgggcggcgctctgggcgtgctctgggccagcatcggtttttgccgcgggagaanggcggcgggcatgtagctcttcngagtgttatagcctgccgccggcgccgcgagcggggaccgaggactgcgacttttgtctcggatgctggcacaacggcgcaacaccgcccgtcttgaaacatggaccaaggagtctaacgtctatgcga

SEQ ID NO: 102 - DNA, 664 bp, Paenibacillus amylolyticus
  source 1..664: mol_type = genomic DNA
gagaagcttgcttctctgatagcgttagcggcggacgggtgagtaacacgtaggcaacctgccctcaagtttgggacaactaccggaaacggtagctaataccgaatagttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaa

SEQ ID NO: 103 - DNA, 669 bp, Pseudomonas cedrina
  source 1..669: mol_type = genomic DNA
catgcagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaa

SEQ ID NO: 104 - DNA, 784 bp, Microbacterium hydrocarbonoxydans
  source 1..784: mol_type = genomic DNA
tgcagtcgaacggtgaacacggagcttgctctgtgggatcagtggcgaacgggtgagtaacacgtgagcaacctgcccctgactctgggataagcgctggaaacggcgtctaatactggatacgaaccacgaaggcatcttcagtggttggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgca

SEQ ID NO: 105 - DNA, 807 bp, Pantoea agglomerans
  source 1..807: mol_type = genomic DNA
ttttgcaacccactcccatggtgtgacgggcggtgtgtacaaggcccgggaacgtattcaccgtggcattctgatccacgattactagcgattccgacttcacggagtcgagttgcagactccgatccggactacgacgcactttgtgaggtccgcttgctctcgcgaggtcgcttctctttgtatgcgccattgtagcacgtgtgtagccctactcgtaagggccatgatgacttgacgtcatccccaccttcctccggtttatcaccggcagtctcctttgagttcccgaccgaatcgctggcaacaaaggataagggttgcgctcgttgcgggacttaacccaacatttcacaacacgagctgacgacagccatgcagcacctgtctcagcgttcccgaaggcaccaaagcatctctgctaagttcgctggatgtcaagagtaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccactcctcaagggaacaacctccaagtcgacatcgtttacggcgtggactaccagggtatctaatcctgtttgctccccacgctttcgcacctgagcgtcagtctttgtccagggggccgccttcgccaccggtattcctccagatctctacgcatttcaccgctacacctggaattctacccccctctacaagactcaagcctgccagtttcaaatgcagttccca

SEQ ID NO: 106 - DNA, 851 bp, Paenibacillus telluris
  source 1..851: mol_type = genomic DNA
acatgcagtcgagcggagttgatggagtgcttgcactcctgatagcttagcggcggacgggtgagtaacacgtaggtaacctgcccgtaagactgggataacattcggaaacgaatgctaataccggatacacaacttggtcgcatgatcggagttgggaaagacggagcaatctgtcacttacggatggacctgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgctaaggagagtaactgctctttaggtgacggtacctgagaagaaagccccggctaactacgtgccagcagccgcggtaatacgtagggggcaagcgttgtccggaattattgggcgtaaagcgcgcgcaggcggccttgtaagtctgttgtttcaggcacaagctcaacttgtgttcgcaatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagta

SEQ ID NO: 107 - DNA, 872 bp, Fictibacillus enclensis
  source 1..872: mol_type = genomic DNA
tgcagtcgagcgaatgacgaggagcttgctcctctgatttagcggcggacgggtgagtaacacgtgggtaacctgcctgtaagacggggataactccgggaaaccggggctaataccggatgataacgagaagcgcctgcttcttttttgaaagtcggtttcggctgacgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatggacgaaagtctgaccgagcaacgccgcgtgagcgatgaaggccttcgggtcgtaaagctctgttgtcagagaagaacaagtaccggagtaactgccggtaccttgacggtacctgaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttgggggggttccaccctcagtgctgacgttaacacattaagcactccgcctggggagtacggccgcaaggctgaaactcaaggaattga

SEQ ID NO: 108 - DNA, 865 bp, Pichia membranifaciens
  source 1..865: mol_type = genomic DNA
cactgtgtgggcgcacaaaacacctaaacctggagtatacacacgtcaacaaaagatctaaaagaataaaactttcaacaacggatctcttggttctcgcatcgatgaagagcgcagcgaaatgcgatacctagtgtgaattgcagccatcgtgaatcatcgagttcttgaacgcacattgcgcccgtcggtattccggcgggcatgcctgtctgagcgtcgtttccttcttgtgcaccggggtctttgcagatcctctctgcgcagagctggccgtgccactggcccggccgaaaagaaacgttgcggacgaaacgaactacatcgggacgctttggccgccgagcgaaaaaaaaaacaccattgagctcgacctcaaatcagggaggagtacccgctgaacttaagcatatcaataagcggaggaaaaaaaaccaacagggattgccccantaacggcgagtgaagcggcaagagctcaaatttnaaatcnngctnatttttttggcncgagttgnaaagtgtangcgggagtctttgtggancanggtgtccaantcccttggaacagggcgcctganagggtgagagccccgtggggtgccntgnnaagctttgaggccctgctgacnagtcnagttgtttgggaatgcanctccaagtgggtggtaaattccatctaaggctaaatactggcgagagaccgatagcgaacaagtactgtgaaggaaanatgaaaagcactttgaaaagagagtgaaacnncacgtgaaattgttgaaagggaanggtattgggcccnacatgggggantgcgcaccgctgtctcttgtnncngcgctctgggcgctctctgggncagcat

SEQ ID NO: 109 - DNA, 992 bp, Rhodotorula babjevae
  source 1..992: mol_type = genomic DNA
gtccacttaacttggagtccgaactctcactttttaaccctgtgcatctgttaattggaatagtagctcttcggagtgaaccaccattcacttataaaacacaaagtctatgaatgtatacaaatttataacaaaacaaaactttcaacaacggatctcttggctctcgcatcgatgaagaacgcagcgaaatgcgatacgtaatgtgaattgcagaattcagtgaatcatcgaatctttgaacgcaccttgcgctccttggtattccgaggagcatgcctgtttgagtgtcatgaaatcttcaacccacctctttcttagtgaatctggtggtgcttggtttctgagcgctgctctgcttcggcttagctcgttcgtaatgcattagcatccgcaaccgaacttcggattgacttggcgtaatagactattcgctgaggattctagtttactagagccgagttgggttaaaggaagctcctaatcctaaagtctattttttgattagatctcaaatcaggtaggactacccgctgaacttaagcatatcaataagcggaggaaaagaaactaacaaggattcccctagtagcggcgagcgaagcgggaagagctcaaatttataatctggcaccttcggtgtccgagttgtaatctctagaagtgttttccgcgttggaccgcacacaagtctgttggaatacagcggcatagtggtgaaacccccgtatatggtgcggacgcccagcgctttgtgatacactttcaatgagtcgagttgtttgggaatgcagctcaaattgggtggtaaattccatctaaagctaaatattggcgagagaccgatagcgaacaagtaccgtgagggaaagatgaaaagcactttggaaagagagttaacagtacgtgaaattgttggaaggnaacgcttgaagtcagacttgcttgccggagcttgcttcggtttgcaggccagcatcagttttccgggg

SEQ ID NO: 110 - DNA, 509 bp, Microbacterium testaceum
  source 1..509: mol_type = genomic DNA
cttgcttggtggatcatggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccc

SEQ ID NO: 111 - DNA, 927 bp, Bacillus aryabhattai
  source 1..927: mol_type = genomic DNA
tgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcga

SEQ ID NO: 112 - DNA, 908 bp, Talaromyces atroroseus
  source 1..908: mol_type = genomic DNA
cgcgggtccacctcccacccgtgtctcttgaataccctgttgctttggcgggcccaccgggacacccccggtcgccggggggcactgcgcccccgggcccgcgcccgccagagcgccgatgaacccgaatgaagaaggactgtctgagtctacgatataattatcaaaactttcaacaatggatctcttggttccggcatcgatgaagaacgcagcgaaatgcgataagtaatgtgaattgcagaattccgtgaatcatcgaatctttgaacgcacattgcgccccctggcattccggggggcatgcctgtccgagcgtcatttctgccctcaagcccggcttgtgtgttgggcgtggtccccccggtttcgggggggacctgcccgaaaggcagcggcgacgttccgcctaggtcctcgagcgtatggggctttgtcacccgctcgggaggggcctacgggcgttggccatccacccatttttttacggttgacctcggatcaggtaggagttacccgctgaacttaagcatatcaataagcggaggaaaagaaaccaaccgggattgcctcagtaacggcgagtgaagcggcaagagctcaaatttgaaatctggcccccctgggggtccgagttgtaatttggagaggatgcttcgggtacggtgcccatctaagtgccctggaacgggcggtcatagagggtgagaatcccgtatgggatgggcggccgtgcccgtgtgaagctccttcgacgagtcgagttgtttgggaatgcagctctaagcgggtggtaaatttcatctaaagctaaatactggccggagaccgatagcgcacaagtagagtgatcgaaagatgaaaagcactttgaaaagagagttaaacagcacgtgaaattgttgaaa

SEQ ID NO: 113 - DNA, 904 bp, Pichia membranifaciens
  source 1..904: mol_type = genomic DNA
gtctttcgcccctatacccaaattcgacgatcgatttgcacgtcagaaccgctacgagcctccaccagagtttcctctggcttcaccctattcaggcatagttcaccatctttcgggtcccaacagctatgctcttactcaaatccatccgataaacatcaggatcggtcgatcgtgccccccgaaggggtccgacctacgttcactttcattacgcgtacgggttttacacccaaacactcgcatagacgttagactccttggtccatgtttcaagacgggcggtattgcgccgttgtgccagcatccgagacagaagccgcagtcctcggtccccgcacgcggtatctggcgccggctataacactccgaagagccactttccggcacccattctcccgcagcaagaaccgatgctggcccagagagcgcccagagcgccgcctacaagagacagcggtgcgcactccccatgtcgggcccaatacccttccctttcaacaatttcacgtgctgtttcactctcttttcaaagtgcttttcatctttccttcacagtacttgttcgctatcggtctctcgccagtatttagccttagatggaatttaccacccacttggagctgcattcccaaacaactcgactcgtcagcagggcctcaaagcttcgcacgnnancccacggggctctcaccctctcangcgccctgttccaagggacttggacaccgtgctccacaaagactcccgcctacactctacaactcgtgccaaaaaaattagcacgatttcaaatctgagctcttgccgcttcactcgccgctactggggcaatccctgttggtttcttttcctccgcttattgatatgcttaagttcagcgggtactcctacctgatctgag

SEQ ID NO: 114 - DNA, 678 bp, Enterobacter cloacae
  source 1..678: mol_type = genomic DNA
ttgctgctttgctgaccagtggcggacgggtgagtaatgtctgggaaactgcctgatggagggggataactactggaaacggtagctaataccgcataacgtcacaagaccagggagggggaccttcgggcctcttgccatcggatgtgcccaaatgggattatctagtaggtggggtaacggctcgcctaggccacnatccctacctggtctgagaggatgaccacccacactggaactgagacacggtccctactcctacgggaggcggcagtggggaatattgcacaatgggcgcaagcctgatgcgcccatgccgcgtgtatgaacaacgccttcnggttgtaaagtactttcngcggggaggaaggcgacagggttaataaccctgtccattgacgttacccgcagaacaagcaccggctaactccgtgccagcagccgcggtaatacgtgagggtgcaagcgttaatcggaattactgggcgtaaagcgcacgcaggcggtctgtcaaatcggatgtgaaatccccgggctcaacctgggaactgcattctgaactggcaggctatagtcttgtanaggggggtagaattccaggtgtagcggtgaaatgcgtagagatctggaggaataccggtggcgaaggcggccccctggacaaaagactgacgctca

SEQ ID NO: 115 - DNA, 853 bp, Chryseobacterium sp.
  source 1..853: mol_type = genomic DNA
tgcagccgagcggtagaagatcttcggatctttgagagcggcgtacgggtgcggaacacgtgtgcaacctgcctttatcagggggatagcctttcgaaaggaagattaataccccataatataatgagtggcatcacttattattgaaaactccggtggatagagatgggcacgcgcaagattagatagttggtagggtaacggcctaccaagtcagtgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattga

SEQ ID NO: 116 - DNA, 769 bp, Hanseniaspora opuntiae
  source 1..769: mol_type = genomic DNA
gttcttgttnagatcttttacaataatgtgtatctttaatgaagatgtgcgcttaattgcgctgctttattagagtgtcgcagtagaagtagtcttgcttgaatctcagtcaacgtttacacacattggagtttttttactttaatttaattctttctgctttgaatcgaaaggttcaaggcaaaaaacaaacacaaacaattttattttattataattttttaaactaaaccaaaattcctaacggaaattttaaaataatttaaaactttcaacaacggatctcttggttctcgcatcgatgaaaaacgtaccgaattgcgataagtaatgtgaattgcaaatactcgtgaatcattgaatttttgaacgcacattgcgcccttgagcattctcaagggcatgcctgtttgancgtcatttccttctcaaaagataattttttattttttggttgtgggcgatactcagggttagcttgaaattggagactgtttcantcttttttaattcaacacttagcttctttggagacgctgttctcgctgtgatgtatttatggatttattcgttttactttacaagggaaatggtaatgtaccttaggcaaagggttgcttttaatattcatcaagtttgacctcaaatcaggtaggattacccgctgaacttaagcatatcaataagcggaggaaaagaaaccaactgggattaccttantaacggcnagtgaagcggtaaaagctcaaatttgaatctggtactttca

SEQ ID NO: 117 - DNA, 812 bp, Paenibacillus amylolyticus
  source 1..812: mol_type = genomic DNA
tgatgcgttagcggcggacgggtgagtaacacgtaggcaacctgccctcaagtttgggacaactaccggaaacggtagctaataccgaataattgttttcttcgcctgaaggaaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtac

SEQ ID NO: 118 - DNA, 852 bp, Pseudomonas brassicacearum
  source 1..852: mol_type = genomic DNA
gcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattga

SEQ ID NO: 119 - DNA, 872 bp, Bacillus nealsonii
  source 1..872: mol_type = genomic DNA
tgcagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattga

SEQ ID NO: 120 - DNA, 706 bp, Bacillus amyloliquifaciens
  source 1..706: mol_type = genomic DNA
gtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctga

SEQ ID NO: 121 - DNA, 927 bp, Candida oleophila
  source 1..927: mol_type = genomic DNA
ttgcgcggcgaaaaaccttacacactatgtttttttaatttgaaactattgctttggtctggcttagaaataggttgggccaaaggttttatcaaaacttcaatatttattattgaattgttatttttaattttatgtcaatttgttgattaatatcaaaaatcttcaaaactttcaacaacggatctcttggttctcgcatcgatgaagaacgcagcgaaatgcgataagtaatatgaattgcagattttcgtgaatcatcgaatctttgaacgcacattgcgccctttggtattccaaagggcatgcctgtttgagcgtcatttctctctcaaatcttcggatttggttttgagtgatactcttagtcagactaagcgtttgcttgaaatgtattggcatgagtggtactagatagtgctgaactgttttcaatgtattaggtttatccaactcattgaccagtaaagtatttgtttattacacaggctcggccttacaacaacaaacaaagtttgacctcaaatcaggtaggactacccgctgaacttaagcatatcaataagcggaggaaaagaaaccaacagggattgccttagtaacggcgagtgaagcggcaaaagctcaaatttgaaatctagcactttcagtgttcgagttgtaatttgaagaaggtaactttggaattggctcttgtctatgttccttggaacaggacgtcacagagggtgagaatcccgtgcgatgagatgtccaattctatgtaaagtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgtt

SEQ ID NO: 122 - DNA, 836 bp, Hanseniaspora uvarum
  source 1..836: mol_type = genomic DNA
gttgctcgagttcttgtttagatcttttacaataatgtgtatctttattgaagatgtgcgcttaattgcgctgcttctttaaagtgtcgcagtgaaagtagtcttgcttgaatctcagtcaacgctacacacattggagtttttttactttaatttaattctttctgctttgaatcgaaaggttcaaggcaaaaaacaaacacaaacaattttattttattataattttttaaactaaaccaaaattcctaacggaaattttaaaataatttaaaactttcaacaacggatctcttggttctcgcatcgatgaaaaacgtagcgaattgcgataagtaatgtgaattgcaaatactcgtgaatcattgaatttttgaacgcacattgcgcccttgagcattctcaggggcatgcctgtttgagcgtcatttccttctcaaaagataatttattattttttggttgtgggcgatactcagggttagcttgaaattggagactgtttcantcttttttaattcaacacttancttctttggagacgctgttctcgctgtgatgtatttatggatttattcgttttactttacaagggaaatggtaacgtaccttaggcaaagggttgcttttaatattcatcaagtttgacctcaaatcaggtaggattacccgctgaacttaagcatatcaataagcggaggaaaagaaaccaactgggattaccttagtaacggcgagtgaagcggtaaaagctcaaatttgaaatctggtactttcagtgcccgagttgtaatttgtagaatttgtctttgattaggtccttgtctatgttcctt

SEQ ID NO: 123 - DNA, 922 bp, Candida akabanensis
  source 1..922: mol_type = genomic DNA
caccaaattaattttctttttcaatcgtttttataataaaaactttcaacaacggatctcttggttctcgcatcgatgaagaacgcagcgaattgcgatacgtaatatgacttgcagacgtgaatcattgaatctttgaacgcacattgcgccttgaggtattcctcaaggcatgcctgtttgagcgtcggctcctttcaaaccctagggtttggctttgcctccgaaatattaggatctaatgcaatacgtttcattaatccaaattcttcgccctcaaatcaggtaagactacccgctgaacttaagcatatcaataagcggaggaaaagaaaccaacagggattgcctcagtaacggcgagtgaagcggcaaaagctcaaatttgaaatccttcgggagttgtaatttgaaggtgagatggcgacttcaagtctggctaaagtcccttggaacagggcgccttagagggtgagagccccgtacaaccagttcttgaagtcatatgctttctctccaacgagtcgagttgtttgggaatgcagctcaaagtgggtggtaaattccatctaaagctaaataccggcgagagaccgatagcgaacaagtaccgtgagggaaagatgaaaagcactttgaaaagagagtgaaacagtacgtgaaattgttgaaagggaagggcttgcaagcagacacaaccctcgtggttgggccagcatcggttgctaggggtggataaggcggcgggaatgtagcttcctcggaagtattatatcccgctgagatacacccaccggcgaccgaggcctgcgatttttaatcaaggatgctggcgtaatggttgcaagccgcccgtcttgaaacacggaccaaggagtctaacgtctatgcaagtgtttgggtgaataaaaccccagcgcgg

SEQ ID NO: 124 - DNA, 927 bp, Bacillus subtilis
  source 1..927: mol_type = genomic DNA
tgcagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaa

SEQ ID NO: 125 - DNA, 956 bp, Enterobacter huaxiensis
  source 1..956: mol_type = genomic DNA
tgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccaga

SEQ ID NO: 126 - DNA, 939 bp, Rhodotorula babjevae
  source 1..939: mol_type = genomic DNA
gtccacttaacttggagtccgaactctcactttctaaccctgtgcatctgttaattggaatagtagctcttcggagtgaaccaccattcacttataaaacacaaagtctatgaatgtatacaaatttataacaaaacaaaactttcaacaacggatctcttggctctcgcatcgatgaagaacgcagcgaaatgcgatacgtaatgtgaattgcagaattcagtgaatcatcgaatctttgaacgcaccttgcgctccttggtattccgaggagcatgcctgtttgagtgtcatgaaatcttcaacccacctctttcttagtgaatctggtggtgcttggtttctgagcgctgctctgcttcggcttagctcgttcgtaatgcattagcatccgcaaccgaacttcggattgacttggcgtaatagactattcgctgaggattctagtttactagagccgagttgggttaaaggaagctcctaatcctaaagtctattttttgattagatctcaaatcaggtaggactacccgctgaacttaagcatatcaataagcggaggaaaagaaactaacaaggattcccctagtagcggcgagcgaagcgggaagagctcaaatttataatctggcaccttcggtgtccgagttgtaatctctagaagtgttttccgcgttggaccgcacacaagtctgttggaatacagcggcatagtggtgaaacccccgtatatggtgcggacgcccagcgctttgtgatacactttcaatgagtcgagttgtttgggaatgcagctcaaattgggtggtaaattccatctaaagctaaatattggcgagagaccgatagcgaacaagtaccgtgagggaaagatgaaaagcactttggaaagagagttaacagtacgtgaaattgttggaagggaaacgcttgaagtca

SEQ ID NO: 127 - DNA, 926 bp, Bacillus pumilus
  source 1..926: mol_type = genomic DNA
tgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaa

SEQ ID NO: 128 - DNA, 843 bp, Bacillus pumilus
  source 1..843: mol_type = genomic DNA
tgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagta

SEQ ID NO: 129 - DNA, 850 bp, Bacillus thuringiensis
  source 1..850: mol_type = genomic DNA
acatgcaagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagta

SEQ ID NO: 130 - DNA, 682 bp, Psychrobacillus glaciei
  source 1..682: mol_type = genomic DNA
tgcaagtcgagcgaatgacgaagaagcttgcttcttctgatttagcggcggacgggtgagtaacacgtgggcaacctgccctgtagattgggataactccgggaaaccggggctaataccgaataatccatttcctcacatgtggaaatgttaaaagacggtttcggctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaaactctgttgtgagggaagaacaagtacgagagtaactgctcgtaccttgacggtacctcattagaaagccacggctaactacgtgccagcagccgcggtaatacgtaggtggcaagcgttgtccggaattattgggcgtaaagcgcgcgcaggcggtcctttaagtctgatgtgaaatcccacggctcaaccgtggaaggtcattggaaactgggggacttgagtacagaagaggaaagcggaattccaagtgtagcggtgaaatgcgtagagatttggaggaacaccagtggcgaa

SEQ ID NO: 131 - DNA, 927 bp, Bacillus pumilus
  source 1..927: mol_type = genomic DNA
gcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttacc

SEQ ID NO: 132 - DNA, 874 bp, Bacillus pumilus
  source 1..874: mol_type = genomic DNA
tgcagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattga

SEQ ID NO: 133 - DNA, 937 bp, Bacillus pumilus
  source 1..937: mol_type = genomic DNA
tgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttacc

SEQ ID NO: 134 - DNA, 848 bp, Microbacterium sp.
  source 1..848: mol_type = genomic DNA
atgcagtcgaacggtgaaggcggagcttgctctgctggatcagtggcgaacgggtgagtaacacgtgagcaatctgcccctgactctgggataagcgctggaaacggcgtctaatactggatacgagctgcgaaggcatcttcagcagctggaaagaatttcggtcagggatgagctcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaccccgaggctcaacctcgggcctgcagtgggtacgggcagactagagtgcggtagaggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattga

SEQ ID NO: 135 - DNA, 923 bp, Brachybacterium alimentarium
  source 1..923: mol_type = genomic DNA
atgcagtcgaacgatgacgaccgagcttgctcggtctgattagtggcgaacgggtgagtaacacgtgagtaacctgccccccacttcgggataacttcgagaaatcgtggctaataccggatatgaacttccgccgcatggtggttgttggaaagtttttcggtgggggatggactcgcggcctatcagtttgttggtgaggtaatggctcaccaagacgatgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatgg

SEQ ID NO: 136 - DNA, 923 bp, Pseudomonas putida; identical to SEQ ID NO: 15
  source 1..923: mol_type = genomic DNA

SEQ ID NO: 137 - DNA, 845 bp, Microbacterium zeae
  source 1..845: mol_type = genomic DNA
tgcagtcgaacggtgaagccaagcttgcttggtggatcagtggcgaacgggtgagtaacacgtgagcaacctgccctggactctgggataagcgctggaaacggtgtctaatactggatatgaggcgtgatcgcatggtcatgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattga

SEQ ID NO: 138 - DNA, 818 bp, Paenarthrobacter nitroguajacolicus
  source 1..818: mol_type = genomic DNA
catgcagtcgaacgatgatcccagcttgctgggggattagtggcgaacgggtgagtaacacgtgagtaacctgcccttgactctgggataagcctgggaaactgggtctaataccggatacgaccatctggcgcatgtcatggtggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgtaagtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacgg

SEQ ID NO: 139 - DNA, 942 bp, Bacillus velezensis
  source 1..942: mol_type = genomic DNA
atacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgangggggcccgcacaagcggtggagcatgtggtttaattcgaagcaacgcgaagaaccttacc

SEQ ID NO: 140 - DNA, 679 bp, Bacillus pumilus
  source 1..679: mol_type = genomic DNA
tgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaa

SEQ ID NO: 141 - DNA, 888 bp, Oceanobacillus sojae
  source 1..888: mol_type = genomic DNA
tgcagtcgagcgcgggaagcggacagaactcttcggagggacgttcgtggaacgagcggcggacgggtgagtaacacgtaggcaacctgcctgtaagactgggataactcgcggaaacgcgagctaataccggataatacttatcatctcctgatggtaagttgaaaggcggcttttgctgtcacttacagatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcggggaagaacaagtatgatagtaactgatcgtaccttgacggtacccgaccagaaagccacggctaactacgtgccagcagccgcggtaatacgtaggtggcaagcgttgtccggaattattgggcgtaaagcgctcgcaggcggttctttaagtctgatgtgaaatcttgcggctcaaccgtaaacgtgcattggaaactggaggacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattga

SEQ ID NO: 142 - DNA, 914 bp, Aureobasidium pullulans
  source 1..914: mol_type = genomic DNA
gcgcccgacctccaaccctttgttgttaaaactaccttgttgctttggcgggaccgctcggtctcgagccgctggggattcgtcccaggcgagcgcccgccagagttaaaccaaactcttgttatttaaccggtcgtctgagttaaaattttgaataaatcaaaactttcaacaacggatctcttggttctcgcatcgatgaagaacgcagcgaaatgcgataagtaatgtgaattgcagaattcagtgaatcatcgaatctttgaacgcacattgcgccccttggtattccgaggggcatgcctgttcgagcgtcattacaccactcaagctatgcttggtattgggcgtcgtccttagttgggcgcgccttaaagacctcggcgaggccactccggctttaggcgtagtagaatttattcgaacgtctgtcaaaggagaggaactctgccgactgaaacctttatttttctaggttgacctcggatcaggtagggatacccgctgaacttaagcatatcaataagcggaggaaaagaaaccaacagggattgccctagtaacggcgagtgaagcggcaacagctcaaatttgaaagctagccttcgggttcgcattgtaatttgtagaggatgatttggggaagccgcctgtctaagttccttggaacaggacgtcatagagggtgagaatcccgtatgtgacaggaaatggcaccctatgtaaatctccttcgacgagtcgagttgtttgggaatgcagctctaaatgggaggtaaatttcttctaaagctaaatattggcgagagaccgatagcgcacaagtagagtgatcgaaagatgaaaagcactttggaaagagagttaaaaagcacgtgaaattgttgaaagggaagcgcttgcaatcagacttg

SEQ ID NO: 143 - DNA, 675 bp, Stenotrophomonas sp.
  source 1..675: mol_type = genomic DNA
catgcagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaa

SEQ ID NO: 144 - DNA, 680 bp, Bacillus subtilis
  source 1..680: mol_type = genomic DNA
tgcagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaa

SEQ ID NO: 145 - DNA, 598 bp, Stenotrophomonas pavanii; identical to SEQ ID NO: 84
  source 1..598: mol_type = genomic DNA

SEQ ID NO: 146 - DNA, 725 bp, Bacillus velezensis
  source 1..725: mol_type = genomic DNA
tgcagtccgagcggacagatgggagccttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgt

SEQ ID NO: 147 - DNA, 921 bp, Meyerozyma guilliermondii
  source 1..921: mol_type = genomic DNA
cgcttactgcgcggcgaaaaaccttacacacagtgtctttttgatacagaactcttgctttggtttggcctagagataggttgggccagaggtttaacaaaacacaatttaattatttttacagttagtcaaattttgaattaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaacccccgggtttggtattgagtgatactcttagtcggactaggcgtttgcttgaaaagtattggcatgggtagtactagatagtgctgtcgacctctcaatgtattaggtttatccaactcgttgaatggtgtggcgggatatttctggtattgttggcccggccttacaacaaccaaacaagtttgacctcaaatcaggtaggaatacccgctgaacttaagcatatcaataagcggaggaaaagaaaccaacagggattgccttagtagcggcgagtgaagcggcaaaagctcaaatttgaaatctggcgccttcggtgtccgagttgtaatttgaagattgtaaccttggggttggctcttgtctatgtttcttggaacaggacgtcacagagggtgagaatcccgtgcgatgagatgcccaattctatgtaaggtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaaggga

SEQ ID NO: 148 - DNA, 890 bp, Meyerozyma guilliermondii
  source 1..890: mol_type = genomic DNA
aaccttacacacagtgtctttttgatacagaactcttgctttggtttggcctagagataggttgggccagaggtttaacaaaacacaatttaattatttttacagttagtcaaattttgaattaatcttcaaaactttcaacaacggatctcttggttctcgcatcgatgaagaacgcagcgaaatgcgataagtaatatgaattgcagattttcgtgaatcatcgaatctttgaacgcacattgcgccctctggtattccagagggcatgcctgtttgagcgtcatttctctctcaaacccccgggtttggtattgagtgatactcttagtcggactaggcgtttgcttgaaaagtattggcatgggtagtactagatagtgctgtcgacctctcaatgtattaggtttatccaactcgttgaatggtgtggcgggatatttctggtattgttggcccggccttacaacaaccaaacaagtttgacctcaaatcaggtaggaatacccgctgaacttaagcatatcaataagcggaggaaaagaaaccaacagggattgccttagtagcggcgagtgaagcggcaaaagctcaaatttgaaatctggcgccttcggtgtccgagttgtaatttgaagattgtaaccttggggttggctcttgtctatgtttcttggaacaggacgtcacagagggtgagaatcccgtgcgatgagatgcccaattctatgtaaggtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaat

SEQ ID NO: 149 - DNA, 906 bp, Pichia membranifaciens
  source 1..906: mol_type = genomic DNA
cactgtgtgggcgcacaaaacacctaaacctggagtatacacacgtcaacaaaagatctaaaagaataaaactttcaacaacggatctcttggttctcgcatcgatgaagagcgcagcgaaatgcgatacctagtgtgaattgcagccatcgtgaatcatcgagttcttgaacgcacattgcgcccgtcggtattccggcgggcatgcctgtctgagcgtcgtttccttcttgtgcaccggggtctttgcagatcctctctgcgcagagctggccgtgccactggcccggccgaaaagaaacgttgcggacgaagcgaactacatcgggacgctttggccgccgagcgaaaaaaaacaccattgagctcgacctcagatcaggtaggagtacccgctgaacttaagcatatcaataagcggaggaaaagaaaccaacagggattgccccagtagcggcgagtgaagcggcaagagctcagatttgaaatcgtgctaatttttttggcacgagttgtagagtgtaggcgggagtctttgtggagcacggtgtccaagtcccttggaacagggcgcctgagagggtgagagccccgtggggtgccgtgcgaagctctgaggccctgctgacgagtcgagttgtttgggaatgcagctccaagtgggtggtaaattccatctaaggctaaatactggcgagagaccgatagcgaacaagtactgtgaaggaaagatgaaaagcactnngaaaagagagtgaaacagcacgtgaaattgttgaaagggaanggtattgggcccnacatggggagtgcgcaccgctgtctcttgtangcggngctctgggcgctctctgggccancatcngttcttgctgcgggagaatgggtgccggaaagtggctcttc

SEQ ID NO: 150 - DNA, 949 bp, Candida oleophila
  source 1..949: mol_type = genomic DNA
gcttattgcgcggcgaaaaaccttacacactatgtttttttaatttgaaactattgctttggtctggcttagaaataggttgggccaaaggttttatcaaaacttcaatatttattattgaattgttattttaattttattgtcaatttgttgattaatatcaaaaatcttcaaaactttcaacaacggatctcttggttctcgcatcgatgaagaacgcagcgaaatgcgataagtaatatgaattgcagattttcgtgaatcatcgaatctttgaacgcacattgcgccctttggtattccaaagggcatgcctgtttgagcgtcatttctctctcaaatcttcggatttggttttgagtgatactcttagtcagactaagcgtttgcttgaaatgtattggcatgagtggtactagatagtgctgaactgttttcaatgtattaggtttatccaactcgttgaccagtaaagtatttgtttattacacaggctcggccttacaacaacaaacaaagtttgacctcaaatcaggtaggactacccgctgaacttaagcatatcaataagcggaggaaaagaaaccaacagggattgccttagtaacggcgagtgaagcggcaaaagctcaaatttgaaatctagcactttcagtgttcgagttgtaatttgaagaaggtaactttggaattggctcttgtctatgttccttggaacaggacgtcacagagggtgagaatcccgtgcgatgagatgtccaattctatgtaaagtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaagggaagggcttga

SEQ ID NO: 151 - DNA, 902 bp, Candida oleophila
  source 1..902: mol_type = genomic DNA
cgcttattgcgcggcgaaaaccttacacactatgtttttttaatttgaaactattgctttggtctggcttagaaataggttgggccaaaggttttatcaaaacttcaatatttattattgaattgttattttaattttattgtcaatttgttgattaatatcaaaaatcttcaaaactttcaacaacggatctcttggttctcgcatcgatgaagaacgcagcgaaatgcgataagtaatatgaattgcagattttcgtgaatcatcgaatctttgaacgcacattgcgccctttggtattccaaagggcatgcctgtttgagcgtcatttctctctcaaatcttcggatttggttttgagtgatactcttagtcagactaagcgtttgcttgaaatgtattggcatgagtggtactagatagtgctgaactgttttcaatgtattaggtttatccaactcgttgaccagtaaagtatttgtttattacacaggctcggccttacaacaacaaacaaagtttgacctcaaatcaggtaggactacccgctgaacttaagcatatcaataagcggaggaaaagaaaccaacagggattgccttagtaacggcgagtgaagcggcaaaagctcaaatttgaaatctagcactttcagtgttcgagttgtaatttgaagaaggtaactttggaattggctcttgtctatgttccttggaacaggacgtcacagagggtgagaatcccgtgcgatgagatgtccaattctatgtaaagtgctttcgaagagtcgagttgtttgggaatgcagctctaagtgggtggtaaattccatctaaagctaaatattggcgagagaccgatagcgaacaagtacagtgatggaaagatgaaaagaactttga

SEQ ID NO: 152 - DNA, 845 bp, Microbacterium sp.
  source 1..845: mol_type = genomic DNA
tgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttggcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattga

SEQ ID NO: 153 - DNA, 824 bp, Microbacterium maritypicum
  source 1..824: mol_type = genomic DNA
atgcagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgc

SEQ ID NO: 154 - DNA, 622 bp, Microbacterium sp.
  source 1..622: mol_type = genomic DNA
tgcagtcgaacggtgaagccaagcttgcttggtggatcagtggcgaacgggtgagtaacacgtgagcaacctgccctggactctgggataagcgctggaaacggcgtctaatactggatatgagctctcatcgcatggtgggggttggaaagatttttcagtctgggatgggctcgcggcctatcagcttgttggtgaggtaatggctcaccaaggcgtccacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgca

SEQ ID NO: 155 - DNA, 391 bp, Microbacterium sp.
  source 1..391: mol_type = genomic DNA
tgcagtcgaacggtgaagccaagcttgcttggtggatcagtggcgaacgggtgagtaacacgtgagcaacctgccctggactctgggataagcgctggaaacggcgtctaatactggatatgagacgtgatcacatggtcgtgtttggaaagatttttcggtctgggatgggctcgcggcctatcatcttgttggtgaggtaatggctcaccaaggcgtcgacgggtagccggcctganagggtgaccggccacactgggactganacacggcccanactcctacgggaggcagcantggggaatattgcacaatgggcggaagcctgatgcagcaacgccgcgtgagggatgacggccttcnggttgtaaacctcttttagcagggaaga

SEQ ID NO: 156 - DNA, 925 bp, Brevibacterium frigoritolerans
  source 1..925: mol_type = genomic DNA
tgcagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaggaattgacgggggcccgcacaagcggtggagcatgtggtttaattcgaagcacgcgaga

SEQ ID NO: 157 - DNA, 861 bp, Pseudomonas marginalis
  source 1..861: mol_type = genomic DNA
tgcagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattga

SEQ ID NO: 158 - DNA, 908 bp, Exserophilum rostratum
  source 1..908: mol_type = genomic DNA
acctcccacccgtgtttattttaccttgttgcttcggcgggcccgccttaactggccgccggggggcttacgcccccgggcccgcgcccgccgaagacaccctcgaactctgtctgaagattgtagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcatttctgccctcaagcacggcttgtgtgttgggccccgtcctccgatcccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgccccagtaacggcgagtgaagcggcaagagctcaaatttgaaagctggctccttcggggtccgcattgtaatttgtagaggatgcttcgggagcggtccccatctaagtgccctggaacgggacgtcatagagggtgagaatcccgtatgggatggggtgtccgcgcccgtgtgaagctccttcgacgagtcgagttgtttgggaatgcagctctaaatgggtggtaaatttcatctaaagctaaatattggccggagaccgatagcgcacaagtagagtgatcgaaagatgaaaagcactttgaaaagagagttaaaaagcacgtgaaattgttgaaagggaagcgcttgcgacca

SEQ ID NO: 159 - DNA, 911 bp, Exserophilum rostratum
  source 1..911: mol_type = genomic DNA
ctgggtccacctcccacccgtgtttattttaccttgttgcttcggcgggcccgccttaactggccgccggggggcttacgcccccgggcccgcgcccgccgaagacaccctcgaactctgtctgaagattgtagtctgagtgaaaatataaattatttaaaactttcaacaacggatctcttggttccggcatcgatgaagaacgcagcgaaatgcgatacgtaatgtgaattgcaaattcagtgaatcatcgagtctttgaacgcacattgcgccccctggtattccggggggcatgcctgtccgagcgtcatttctgccctcaagcacggcttgtgtgttgggccccgtcctccgatcccgggggacgggcccgaaaggcagcggcggcaccgcgtccggtcctcgagcgtatggggctttgtcacccgctctgtaggcccggccggcgcttgccgatcaacccaaatttttatccaggttgacctcggatcaggtagggatacccgctgaacttaagcatatcaataagcggaggaaaagaaaccaacagggattgccccagtaacggcgagtgaagcggcaagagctcaaatttgaaagctggctccttcggggtccgcattgtaatttgtagaggatgcttcgggagcggtccccatctaagtgccctggaacgggacgtcatagagggtgagaatcccgtatgggatggggtgtccgcgcccgtgtgaagctccttcgacgagtcgagttgtttgggaatgcagctctaaatgggtggtaaatttcatctaaagctaaatattggccggagaccgatagcgcacaagtagagtgatcgaaagatgaaaagcactttgaaaagagagttaaaaagcacgtgaaattgttgaaagggaagcgcttgc

SEQ ID NO: 160 - DNA, 949 bp, Candida akabanensis
  source 1..949: mol_type = genomic DNA
acatgtttttgaacaacaccaaattaattttctttttcaatcgtttttataataaaaactttcaacaacggatctcttggttctcgcatcgatgaagaacgcagcgaattgcgatacgtaatatgacttgcagacgtgaatcattgaatctttgaacgcacattgcgccttgaggtattcctcaaggcatgcctgtttgagcgtcggctcctttcaaaccctagggtttggctttgcctccgaaatattaggatctaatgcaatacgtttcattaatccaaattcttcgccctcaaatcaggtaagactacccgctgaacttaagcatatcaataagcggaggaaaagaaaccaacagggattgcctcagtaacggcgagtgaagcggcaaaagctcaaatttgaaatccttcgggagttgtaatttgaaggtgagatggcgacttcaagtctggctaaagtcccttggaacagggcgccttagagggtgagagccccgtacaaccagttcttgaagtcatatgctttctctccaacgagtcgagttgtttgggaatgcagctcaaagtgggtggtaaattccatctaaagctaaataccggcgagagaccgatagcgaacaagtaccgtgagggaaagatgaaaagcactttgaaaagagagtgaaacagtacgtgaaattgttgaaagggaagggcttgcaagcagacacaaccctcgtggttgggccagcatcggttgctaggggtggataaggcggcgggaatgtagcttcctcggaagtattatatcccgctgagatacacccaccggcgancgaggcctgcgatttttaatcnannatgctggcgtaatggttgcaagccgcccgtcttgaaacacggaccaaggagtctaacgtctatgcaagtgtttgggtgaataaaaccccagcgcggaatgaaagtaa

SEQ ID NO: 161 - DNA, 1021 bp, Candida railenensis
  source 1..1021: mol_type = genomic DNA
cgcttattgcgcggcgaaaaaccttacacactatgtttttttaatttgaaactattgctttggtctggcttagaaataggttgggccaaaggttttatcaaaacttcaatatttattattgaattgttattttaattttattgtcaatttgttgattaatatcaaaaatcttcaaaactttcaacaacggatctcttggttctcgcatcgatgaagaacgcagcgaaatgcgataagtaatatgaattgcagattttcgtgaatcatcgaatctttgaacgcacattgcgccctttggtattccaaagggcatgcctgtttgagcgtcatttctctctcaaatcttcggatttggttttgagtgatactcttagtcagactaagcgtttgcttgaaatgtattggcatgagtggtactagatagtgctgaactgttttcaatgtattaggtttatccaactcgttgaccagtaaagtatttgtttattacacaggctcggccttacaacaacaaacaaagtttgacctcaaatcaggtaggactacccgctgaacttaagcatatcaataagcggaggaaaagaaaccaacagggattgccttagtaacggcgagtgaagcggcaaaagctcaaatttgaaatctagcactttcagtgttcgagttgtaatttgaagaaggtaactttggaattggctcttgtctatgttccttggaacaggacgtcacagagggtgagaatcccgtgcgatgagatgtccaattctatgtaaagtgctttcgaagagtcgagttgtttgggaatgcagctctaagtgggtggtaaattccatctaaagctaaatattggcgagagaccgatagcgaacaagtacagtgatggaaagatgaaaagaactttgaaaagagagtgaaaaagtacgtgaaattgttgaaagggaagggcttganatcanacttggtattttgtgttccttattctttttggatttggttcctcacagcttaccgggccagcatc

SEQ ID NO: 162 - DNA, 658 bp, Curtobacterium sp.
  source 1..658: mol_type = genomic DNA
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagggagcttgctcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaa

SEQ ID NO: 163 - DNA, 655 bp, Arthrobacter koreensis
  source 1..655: mol_type = genomic DNA
catgcagtcgaacgatgacttctgtgcttgcacagaatgattagtggcgaacgggtgagtaacacgtgagtaacctgcccttaacttcgggataagcctgggaaaccgggtctaataccggatacgacctcctggcgcatgccatggtggtggaaagctttagcggttttggatggactcgcggcctatcagcttgttggttggggtaatggcccaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaa

SEQ ID NO: 164 - DNA, 813 bp, Rhodococcus corynebacterioides
  source 1..813: mol_type = genomic DNA
catgcagtcgaacggtaaggcccttcggggtacacgagtggcgaacgggtgagtaacacgtgggtgatctgccctgcacttcgggataagcccgggaaactgggtctaataccggatagtactgcgcggtgcatgccgtgtggtggaaagatttatcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtac

SEQ ID NO: 165 - DNA, 812 bp, Rhodococcus corynebacterioides
  source 1..812: mol_type = genomic DNA
catgcagtcgaacggtaaggcccttcggggtacacgagtggcgaacgggtgagtaacacgtgggtgatctgccctgcacttcgggataagcccgggaaactgggtctaataccggatagtactgcgcggtgcatgccgtgtggtggaaagatttatcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagta

SEQ ID NO: 166 - DNA, 516 bp, Paenibacillus sp.
  source 1..516: mol_type = genomic DNA
aatctgtcacttacggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcttctagagtaactgctaggagagtgacggtacctgagaagaaagccccggctaactacgtgccagcagccgcggtaatacgtagggggcaagcgttgtccggaattattgggcgtaaagcgcgcgcaggcggctacttaagtctggtgtttaatcctggggctcaaccccgggtcgcactggaaactgggtggcttgagtgcagaagaggagagtggaattccacgtgtagcggtgaaatgcgtagagatgtggaggaacaccagtggcga

SEQ ID NO: 167 - DNA, 651 bp, Microbacterium arborescens
  source 1..651: mol_type = genomic DNA
catgcagtcgaacggtgaagcagagcttgctctgtggatcagtggcgaacgggtgagtaacacgtgagcaatctgcccctgactctgggataagcgctggaaacggcgtctaataccggatacgagctgcgaccgcatggtcagtagctggaaagaatttcggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaa

SEQ ID NO: 168 - DNA, 840 bp, Bacillus cereus
  source 1..840: mol_type = genomic DNA
gaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaggaattga

SEQ ID NO: 169 - DNA, 620 bp, Microbacterium sp.
  source 1..620: mol_type = genomic DNA
acggtgaagcagagcttgctctgtggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatca

SEQ ID NO: 170 - DNA, 380 bp, Microbacterium testaceum
  source 1..380: mol_type = genomic DNA
acggtgaaccagcttgcttggtggatcatggcgaacgggtgagtaacacgtgagcaacctgccctggactctgggataagctctggaaacggcgtctaatactggatattanacgtgatcaaatggtcnngtttggaaacatttttctgtctgggatgggctcgcggcctatcatcttgttggtgaggtaatggctcaccaaggcgtccacgggtagccggcctgagatggtgacccgccccactgggactgaaacaccgccccnactcctacgggaggcagcantggggaatattgcacaatgggcgaaagcctgatgccncaacgccgcgtgagggatgacggccttcntgttgtaaacctcttttagcagggaagaa

SEQ ID NO: 171 - DNA, 918 bp, Ustilago davisii
  source 1..918: mol_type = genomic DNA
ttttttctgaggtgtggctcgcacctgtccaactaaacttgagctacccaatttcaacacggttgcatcggttggctgtcaaacagtgcctcggcgctgggaggcggtcgacacacaacacaaacacttttgatgatctaggattttgaatgaagttcatttttatgatggaaccgactggtaatgcggtcgtctaaatctaaaaaacaacttttggcaacggatctcttggttctcccatcgatgaagaacgcagcgaattgcgataagtaatgtgaattgcagaagtgaatcatcgaatctttgaacgcaccttgcgctcccggcagatctaatctggggagcatgcctgtttgagggccgcgaattgtttcgaacgacagcttttttcttcgtgaaaaagttggcggatcggtattgagggttttgccatttaccatggctccctcgaaatgcattagcgcatccatttgataggcaagacggacgaaagctcgattttcgccctctcttccctgccgggttttgataatatcaggacttcggaggcggagaaagggttagagctggacgcaacgttttgctgtttggagtgcttctgaaacccgcccatgcctctttcttcggaaaaggaagggattttttcaattcatcggcctcagattggtaggactacccgctgaacttaagcatatcaataagcggaggaaaagaaactaacaaggattcccctagtaacggcgagtgaagagggaagagcccaagattgaaagctggcgtcttcggcgtccgcattgtaatctcaagaagtgttttccgcttcggaccatgcctaagtcccttggaaaagggcatcatagagggtgataatcccgtacatggcatggagcgcccgaagctttgtgatacgctttctaa

SEQ ID NO: 172 - DNA, 628 bp, Microbacterium testaceum
  source 1..628: mol_type = genomic DNA
agcttgcttggtggatcagtggcgaacgggtgagtaacacgtgagcaacctgccctggactctgggataagcgctggaaacggcgtctaatactggatatgagctctcatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaa

SEQ ID NO: 173 - DNA, 942 bp, Microbacterium sp.
  source 1..942: mol_type = genomic DNA
tgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatgg

SEQ ID NO: 174 - DNA, 817 bp, Curtobacterium albidum
  source 1..817: mol_type = genomic DNA
catgcagtcgaacgatgatgcccagcttgctgggtggattagtggcgaacgggtgagtaacacgtgagtaacctgcccctgactctgggataagcgttggaaacgacgtctaatactggatatgactaccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagta

SEQ ID NO: 175 - DNA, 847 bp, Plantibacter flavus
  source 1..847: mol_type = genomic DNA
catgcagtcgaacgatgaagcccagcttgctgggtggattagtggcgaacgggtgagtaacacgtgagtaacctgcccttgactctgggataagcgttggaaacgacgtctaataccggatacgagcttccaccgcatggtgagttgctggaaagaattttggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagtacggccgcaaggctaaaactcaaaggaattga

SEQ ID NO: 176 - DNA, 814 bp, Plantibacter flavus
  source 1..814: mol_type = genomic DNA
tgcagtcgaacgatgaagcccagcttgctgggtggattagtggcgaacgggtgagtaacacgtgagtaacctgcccttgactctgggataagcgttggaaacgacgtctaataccggatacgagcttccaccgcatggtgagttgctggaaagaattttggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgctactgacgctgaggagcgaaagggtggggagcaaacaggcttagataccctggtagtccaccccgtaaacgttgggcgctagatgtggggaccattccacggtttccgtgtcgtagctaacgcattaagcgccccgcctggggagta

SEQ ID NO: 177 - DNA, 375 bp, Microbacterium sp.
  source 1..375: mol_type = genomic DNA
atgcagtcgaacggtgaagcccagcttgctgggtggatcagtggcgaacgggtgagtaacacgtgagcaacctgcccctgactctgggataagcgctggaaacggcgtctaatactggatacgagtttcgaccgcatggtcagttactggaaagaattttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaaac

SEQ ID NO: 178 - DNA, 802 bp, Sanguibacter keddieii
  source 1..802: mol_type = genomic DNA
cctagagcttgctctggttgatcagtggcgaacgggtgagtaacacgtgagtaacctgcccttgactctgggataactccgggaaaccggggctaataccggatacgagacgcgaccgcatggtcggcgtctggaaagtttttcggtcaaggatggactcgcggcctatcagcttgttggtgaggtaatggctcaccaaggcgtcgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagtagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcaaggctcaaccttgagcttgcatcgggtacgggcagactagagtgtggtaggggtgactggaattcctggtgtagcggtggaatgcgcagatatcaggaggaacaccgatggcgaaggcaggtcactgggccactactgacgctgaggagcgaaagcatggggagcgaacaggattagataccctggtagtccatgccgtaaacgttgggcactaggtgtggggctcattccacgagttccgcgccgcagctaacgcattaagtgccccgcctggggagtacgg

SEQ ID NO: 179 - DNA, 812 bp, Rhodococcus corynebacterioides
  source 1..812: mol_type = genomic DNA
atgcagtcgaacggtaaggcccttcggggtacacgagtggcgaacgggtgagtaacacgtgggtgatctgccctgcacttcgggataagcccgggaaactgggtctaataccggatagtactgcgcggtgcatgccgtgtggtggaaagatttatcggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattactgggcgtaaagagctcgtaggcggtttgtcgcgtcgtctgtgaaaaccagcagctcaactgttggcttgcaggcgatacgggcagacttgagtatttcaggggagactggaattcctggtgtagcggtgaaatgcgcagatatcaggaggaacaccggtggcgaaggcgggtctctgggaaataactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtac

SEQ ID NO: 180 - DNA, 455 bp, Pseudomonas fluorescens
  source 1..455: mol_type = genomic DNA
gagcttgctcctggattcagcggctgacgggtgagtaatgcctatgaatctgcctggtagtgggggacaacgtttcgaaaggaacgctaataccgcatacgtcctacgggagaaagcaggggagcttcgggccttgcgctatcaaatgaacctangtcggattagctagttggtgaggtaatggctcacccaggcgacgatccataactggtctgagaggatgatcaatcacactggaactgacacacagtccagactcctaccggaggcagcagtggggaatattggacaatgggcnaaagcctgatccagccatgccgcgtgtgtgaagaaggtcttcggattggaaatcactttaatttgggaggaagggttgtagattaatactctgcaattttgacgttaccgacacaataagcaccggctaactctgtgccagcagccgcggtaataca

SEQ ID NO: 181 - DNA, 627 bp, Rhodococcus sovatensis
  source 1..627: mol_type = genomic DNA
atgcagtcgagcggtaaggcctttcggggtacacgagcggcgaacgggtgagtaacacgtgggtgatctgccctgcactctgggataagcctgggaaactgggtctaataccggatatgaccatctcatgcatgtggggtggtggaaagctttatgtggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatca

SEQ ID NO: 182 - DNA, 913 bp, Curtobacterium sp.
  source 1..913: mol_type = genomic DNA
aagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagggagcttgctcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttacca

SEQ ID NO: 183 - DNA, 711 bp, Bacillus licheniformis
  source 1..711: mol_type = genomic DNA
tgcagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctga

SEQ ID NO: 184 - DNA, 703 bp, Raoultella terrigena
  source 1..703: mol_type = genomic DNA
tgcagtcgagcggtagcacagaagagcttgctctttgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttgacgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctca

SEQ ID NO: 185 - DNA, 791 bp, Stenotrophomonas maltophilia
  source 1..791: mol_type = genomic DNA
gcagcacagaggagcttgctccttgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcg

SEQ ID NO: 186 - DNA, 927 bp, Bacillus megaterium
  source 1..927: mol_type = genomic DNA
tgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaggaattgacgggggcccgcacaagcggtggagcatgtggtttaattcgaagcacgcgaga

SEQ ID NO: 187 - DNA, 869 bp, Bacillus proteolyticus
  source 1..869: mol_type = genomic DNA
tgcagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgccctggggagtacggccgcaggctgaaaactcaa

SEQ ID NO: 188 - DNA, 838 bp, Clostridium thiosulfatireducens
  source 1..838: mol_type = genomic DNA
tgcagtcgagcgatgaagcccttcggggtgaattagcggcggacgggtgagtaacacgtgggtaacctgccttatagagggggatagccttccgaaaggaagattaataccgcatgaaatgtttttatcgcatggtagaaacatcaaaggagtaatccgctataagatggacccgcggcgcattagctagttggtgaggtaacggcccaccaaggcgacgatgcgtagccgacctgagagggtgatcggccacattggaactgagacacggtccagactcctacgggaggcagcagtggggaatattgcgcaatgggggaaaccctgacgcagcaacgccgcgtgaatgaagaaggccttagggttgtaaagttctgttttctgggacgataatgacggtaccagaggaggaagccacggctaactacgtgccagcagccgcggtaatacgtaggtggcaagcgttgtccggatttactgggcgtaaaggatgcgtaggcggatgtttaagtgagatgtgaaatacccgagctcaacttgggtgctgcatttcaaactggatatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctggggagtacgatcgcaagattaaaactcaaaggaattga

SEQ ID NO: 189 - DNA, 939 bp, Bacillus cereus
  source 1..939: mol_type = genomic DNA
tgcagtcgagcgaatggattaagagcttgctcttatgaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttacc

SEQ ID NO: 190 - DNA, 765 bp, Paenibacillus borealis
  source 1..765: mol_type = genomic DNA
gaatggaagcttgcttccattcttagcttagcggcggacgggtgagtaacacgtaggcaacctgccctcaagactgggataactaccggaaacggtagctaataccggataatttctttcctctcctgaagagagaatgaaaggcggagcaatctgccacttggggatgggcctgcggcgcattagctagttggtggggtaacggctcaccaaggcgacgatgcgtagccgacctgagagggtgaacggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgtccggtagagtaactgctaccggagtgacggtacctgagaagaaagccccggctaactacgtgccagcagccgcggtaatacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacaggattagataccctggtagtccacgccgtaaacgatgagtgct

SEQ ID NO: 191 - DNA, 847 bp, Bacillus tropicus
  source 1..847: mol_type = genomic DNA
tgcagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtac

SEQ ID NO: 192 - DNA, 987 bp, Bacillus tropicus
  source 1..987: mol_type = genomic DNA
tgcagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgg

SEQ ID NO: 193 - DNA, 938 bp, Bacillus tropicus
  source 1..938: mol_type = genomic DNA
gtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccagg

SEQ ID NO: 194 - DNA, 932 bp, Bacillus toyonensis
  source 1..932: mol_type = genomic DNA
tgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaaga

SEQ ID NO: 195 - DNA, 922 bp, Lactobacillus harbinensis
  source 1..922: mol_type = genomic DNA
tgcaagtcgaacgaggtttggtcagtttgcggtggtgcttgcatcaccaattaccgatcaaaccgagtggcggacgggtgagtaacacgtgggtaacctgcccttcagcaggggataacatttggaaacagatgctaataccgtataaccacggagaccgcatggtctccgggtaaaagatggcgcaagctatcactgaaggatggacccgcggcgtattagccagttggtggggtaacggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgacagtaactggtcatgcagtgacggtattcaatcagaaagtcacggctaactacgtgccagcagccgcggtaatacgtaggtggcaagcgttgtccggatttattgggcgtaaagcgagtgcaggcggtcttttaagtctgatgtgaaagccttcggcttaaccgaagaagggcatcggaaactgggagacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgaatactaagtgtttggagggtttccgcccttcagtgctgcagctaacgcattaagtattccgcctggggagtacgaccgcaaggttgaaactcaaaggaattgacgggggcccgcacaagcggtgg

SEQ ID NO: 196 - DNA, 706 bp, Lactobacillus harbinensis
  source 1..706: mol_type = genomic DNA
acatgcagtcgaacgaggtttggtcagtttgcggtggtgcttgcatcaccaattaccgatcaaaccgagtggcggacgggtgagtaacacgtgggtaacctgcccttcagcaggggataacatttggaaacagatgctaataccgtataaccacggagaccgcatggtctccgggtaaaagatggcgcaagctatcactgaaggatggacccgcggcgtattagccagttggtggggtaacggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgacagtaactggtcatgcagtgacggtattcaatcagaaagtcacggctaactacgtgccagcagccgcggtaatacgtaggtggcaagcgttgtccggatttattgggcgtaaagcgagtgcaggcggtcttttaagtctgatgtgaaagccttcggcttaaccgaagaagggcatcggaaactgggagacttgagtgcagaagaggagagtggaactccatgtgtagcggtgaaatgcgtagatatatggaagaacaccagtggcgaa

SEQ ID NO: 197 - DNA, 713 bp, Lactobacillus harbinensis
  source 1..713: mol_type = genomic DNA
tcagtttgcggtggtgcttgcatcaccaattaccgatcaaaccgagtggcggacgggtgagtaacacgtgggtaacctgcccttcagcaggggataacatttggaaacagatgctaataccgtataaccacggagaccgcatggtctccgggtaaaagatggcgcaagctatcactgaaggatggacccgcggcgtattagccagttggtggggtaacggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgacagtaactggtcatgcagtgacggtattcaatcagaaagtcacggctaactacgtgccagcagccgcggtaatacgtaggtggcaagcgttgtccggatttattgggcgtaaagcgagtgcaggcggtcttttaagtctgatgtgaaagccttcggcttaaccgaagaagggcatcggaaactgggagacttgagtgcagaagaggagagtggaactccatgtgtagcggtgaaatgcgtagatatatggaagaacaccagtggcgaangcggctctctggtctgtaactgacgctga

SEQ ID NO: 198 - DNA, 681 bp, Bacillus velezensis
  source 1..681: mol_type = genomic DNA
tgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaa

SEQ ID NO: 199 - DNA, 947 bp, Bacillus zhangzhouensis
  source 1..947: mol_type = genomic DNA
tgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgac

SEQ ID NO: 200 - DNA, 889 bp, Levilactobacillus brevis
  source 1..889: mol_type = genomic DNA
atgacgtgcttgcactgatttcaacaatgaagcgagtggcgaactggtgagtaacacgtgggaaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttcaagggttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtg

SEQ ID NO: 201 - DNA, 923 bp, Pediococcus pentosaceus
  source 1..923: mol_type = genomic DNA
tgcagtcgaacgaacttccgttaattgattatgacgtacttgtactgattgagattttaacacgaagtgagtggcgaacgggtgagtaacacgtgggtaacctgcccagaagtaggggataacacctggaaacagatgctaataccgtataacagagaaaaccgcatggttttcttttaaaagatggctctgctatcacttctggatggacccgcggcgtattagctagttggtgaggcaaaggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtg

SEQ ID NO: 202 - DNA, 628 bp, Lactobacillus buchneri
  source 1..628: mol_type = genomic DNA
cgcgtctccgttgatgattttaggtgcttgcacttgaaagatttaacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcnncggttttttaggtctgatgtgaaagccttcggcttaaccggagaagtgcatcggaaaccgggagacttgagtgcaga

SEQ ID NO: 203 - DNA, 894 bp, Lactobacillus buchneri
  source 1..894: mol_type = genomic DNA
ttaggtgcttgcacttgaaagatttaacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtgg

SEQ ID NO: 204 - DNA, 915 bp, Enterococcus gilvus
  source 1..915: mol_type = genomic DNA
ccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaaga

SEQ ID NO: 205 - DNA, 862 bp, Lactiplantibacillus plantarum
  source 1..862: mol_type = genomic DNA
tgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagta

SEQ ID NO: 206 - DNA, 860 bp, Lacticaseibacillus paracasei
  source 1..860: mol_type = genomic DNA
cgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgca

SEQ ID NO: 207 - DNA, 876 bp, Lactiplantibacillus plantarum
  source 1..876: mol_type = genomic DNA
tgcagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctga

SEQ ID NO: 208 - DNA, 855 bp, Lactiplantibacillus plantarum
  source 1..855: mol_type = genomic DNA
acgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacgg

SEQ ID NO: 209 - DNA, 808 bp, Lacticaseibacillus paracasei
  source 1..808: mol_type = genomic DNA
agaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttacc

SEQ ID NO: 210 - DNA, 901 bp, Lacticaseibacillus paracasei
  source 1..901: mol_type = genomic DNA
ggattggcggacgggggaggaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccagg

SEQ ID NO: 211 - DNA, 853 bp, Lactococcus lactis
  source 1..853: mol_type = genomic DNA
tgcagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaagg

SEQ ID NO: 212 - DNA, 784 bp, Lacticaseibacillus paracasei
  source 1..784: mol_type = genomic DNA
ttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatc

SEQ ID NO: 213 - DNA, 673 bp, Lacticaseibacillus paracasei
  source 1..673: mol_type = genomic DNA
gcggattggcggacgggggaggaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctga

SEQ ID NO: 214 - DNA, 797 bp, Lacticaseibacillus paracasei
  source 1..797: mol_type = genomic DNA
tgcagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgcta

SEQ ID NO: 215 - DNA, 774 bp, Leuconostoc pseudomesenteroides
  source 1..774: mol_type = genomic DNA
tcgaacgcacagcgaaaggtgcttgcacctttcaagtgagtggcgaacgggtgagtaacacgtggacaacctgcctcaaggctggggataacatttggaaacagatgctaataccgaataaaactcagtgtcgcatgacacaaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaacacta

SEQ ID NO: 216 - DNA, 896 bp, Pediococcus parvulus
  source 1..896: mol_type = genomic DNA
tgcagtcgaacgcactttcgttgaatgaattagaggtgcttgcaccgaagatgattttagctataaagtgagtggcgaacgggtgagtaacacgtgggtaacctgcccagaagtgggggataacacctggaaacagatgctaataccgcataacaaagtaaaccgcatggtttacttttaaaagatggcttcggctatcacttctggatggacccgcggcgtattagctagttggtgagataaaggctcaccaaggcagtgatacgtagccgacctgagagggtaatcggccacattgggactgagacacggcccagactcctacgggaggcagcagtagggaatcttccacaatggacgaaagtctgatggagcaacgccgcgtgagtgatgaaggctttagggtcgtaaaactctgttgttggagaagaacgtgtgtgagagtaactgctcatgcagtgacggtatccaaccagaaagccacggctaactacgtgccagcagccgcggtaatacgtaggtggcaagcgttatccggatttattgggcgtaaagcgagcgcaggcggtcttttaagtctaatgtgaaagccttcggcttaaccgaagaagtgcattggaaactggaagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaa

SEQ ID NO: 217 - DNA, 879 bp, Pediococcus pentosaceus
  source 1..879: mol_type = genomic DNA
tgcagtcgaacgaacttccgttaattgattatgacgtacttgtactgattgagattttaacacgaagtgagtggcgaacgggtgagtaacacgtgggtaacctgcccagaagtaggggataacacctggaaacagatgctaataccgtataacagagaaaaccgcatggttttcttttaaaagatggctctgctatcacttctggatggacccgcggcgtattagctagttggtgaggcaaaggctcaccaaggcagtgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtaagagtaactgtttacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgca

SEQ ID NO: 218 - DNA, 869 bp, Lactobacillus paracasei
  source 1..869: mol_type = genomic DNA
tgcagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgc

SEQ ID NO: 219 - DNA, 912 bp, Enterobacter cloacae
  source 1..912: mol_type = genomic DNA
tgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcangtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgca

SEQ ID NO: 220 - DNA, 954 bp, Lactobacillus plantarum
  source 1..954: mol_type = genomic DNA
tgcagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttacc

SEQ ID NO: 221 - DNA, 952 bp, Lactobacillus harbinensis
  source 1..952: mol_type = genomic DNA
cgaggtttggtcagtttgcggtggtgcttgcatcaccaattaccgatcaaaccgagtggcggacgggtgagtaacacgtgggtaacctgcccttcagcaggggataacatttggaaacagatgctaataccgtataaccacggagaccgcatggtctccgggtaaaagatggcgcaagctatcactgaaggatggacccgcggcgtattagccagttggtggggtaacggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgacagtaactggtcatgcagtgacggtattcaatcagaaagtcacggctaactacgtgccagcagccgcggtaatacgtaggtggcaagcgttgtccggatttattgggcgtaaagcgagtgcaggcggtcttttaagtctgatgtgaaagccttcggcttaaccgaagaagggcatcggaaactgggagacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccag

SEQ ID NO: 222 - DNA, 778 bp, Leuconostoc pseudomesenteroides
  source 1..778: mol_type = genomic DNA
gcagtcgaacgcacagcgaaaggtgcttgcacctttcaagtgagtggcgaacgggtgagtaacacgtggacaacctgcctcaaggctggggataacatttggaaacagatgctaataccgaataaaactcagtgtcgcatgacacaaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgcagtagaggtaagtggaactccatgtgtagcggtggaatgcgnnnnnatatggaagaacaccagtggcgaaggcggcttactggactgtaactgacgttgaggctcgaaagtgtgggtagcaaacaggattagataccctggtagtccacaccgtaaacgatgaacacta

SEQ ID NO: 223 - DNA, 547 bp, Lactobacillus pentosis
  source 1..547: mol_type = genomic DNA
ctatactgcagtcgaacgactctggtattgattggtgcttgctctgatttacatttgaatgaatggcgaactggtgaataacccctgggaaacctgcccctaagcgggggataacacctggaaacagatgctaataccgcataacaacttggaccgcatggtccgagcttgaaagatggcttcggctatcacttttggatggtcccccggcgtattanctaaatggtggggtaacggctccccatgggnatgatacctaacccacctgaaaaggtaatcggccccattgggactgaaacccggcccaaactcctacgggaagcagcagtaaggaatcttccccaatggaccaaagtctgatggaacaaccccccgtgagtgaaaaagggtttccgctcctaaaactctgttgttaaaaaaaaacatatctgaaaataactggtcangtattgacggtatttaaccagaaagccacggctaactacctgccagcagccgcggtaatacctaagtggcaagcgttgtccggatttattgggcgtaaagc

SEQ ID NO: 224 - DNA, 924 bp, Lactococcus lactis
  source 1..924: mol_type = genomic DNA
tgcagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttgatgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcga

SEQ ID NO: 225 - DNA, 705 bp, Lactococcus delbrueckii
  source 1..705: mol_type = genomic DNA
ctggatgagcaccgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaaaaaggttttcggatcgtaaaactctgttggtatagaagaacgttggtgagagtggaaagctcatcaagtgacggtaactacccacaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcacgaaaggagagtggaattccatgtgtancggtgaaatgcntacatatatggaggaacaccggtggcgaaagcggctctctggcctgtaactgacgctgatgctcgaaagcgtggggagcaaacaggatta

SEQ ID NO: 226 - DNA, 934 bp, Lactococcus lactis
  source 1..934: mol_type = genomic DNA
tgcagttgagcgctgaaggttggtacttgtaccaactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttac

SEQ ID NO: 227 - DNA, 524 bp, Pediococcus parvulus
  source 1..524: mol_type = genomic DNA
atgattttagctataaagtgagtggcgaacgggtgagtaacacgtgggtaacctgcccagaagtgggggataacacctggaaacagatgctaataccgcataacaaagtaaaccgcatggtttacttttaaaagatggcttcggctatcacttctggatggacccgcggcgtattagctagttggtgagataaaggctcnccaaggcggtgatacgtagccgacctgagagggtaatcggccacattgggactgagacacggcccaaactcctacgggaggcagcagtagggaatcttccacaatggacgaaagtctgatggagcaacgccgcgtgagtgatgaaggctttagggtcgtaaaactctgttgttggaaaanaacgtgtgtgagagtaactgctcntgcagtgacggtatccaaccanaaagccacggctaactacntgccancagccgcggtaatacntangtggcaagcgttatccggatttattgggcgtaaagcgagcgcaggcggtctttt

SEQ ID NO: 228 - DNA, 828 bp, unidentified
  source 1..828: mol_type = genomic DNA; note = uncultured fungus
caacccctaaacatgaataacctagtcaagaatccataagaataaaactttcaacaacggatctcttggttctcgcatcgatgaagagcgcagcgaaatgcgatacctagtgtgaattgcagccatcgtgaatcatcgagttcttgaacgcacattgcgccccctggtattccggggggcatgcctgtttgagcgtcgtttctatctcacgcaagtggagctggcccggccttggccccgccgaaaagaaacgagggcgaagcgaactatgttgtgcgccgaccccagctatcaagctcgacctcaaatcaggtaggaatacccgctgaacttaagcatatcaataagcggaggaaaagaaaccaacagggattgcctcagtagcggcgagtgaagcggcaagagctcagatttgaaatcgcctcggcgagttgtaaattgcaggttggagtctttgtggcggcgtgtgtctaagtcccttggaacagggcgccattgagggtgagagccccgtgcggcacgcgtctaagctttaangnncttctgacgagtcgagttgtttgggaatgcagctctaagtgggtggtaaattccatctaaggctaaatacnggcgagagaccgatagcgaacaagtactgtgaaggaaagatgaaaagcactttgaaaagagagtgaaacagcacgtgaaattgttgaaagggaagggtattgggctcgacatggggactgcgcaccgntgcttcttgtangcggcgctctgtgnggtctctgggccagcatcagtttttgccgcgggagaatggggggaggaacgtggctcttcgga

SEQ ID NO: 229 - DNA, 991 bp, Lactococcus lactis
  source 1..991: mol_type = genomic DNA
catgcaagttgagcgctgaaggttggtacttgtaccaactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcggttgaaactcaaaggaattgggggcccgcacaagcggtggagcatgtggtttaattcgaagcaacgcgagaaccttaccctgacatactcgtgctaagataggaagttccggtgcatggtgtcgtcagctctcccccc

SEQ ID NO: 230 - DNA, 932 bp, Galactomyces geotrichum
  source 1..932: mol_type = genomic DNA
tttgtgaatttcaacaaacaacatcaattttatagtctattatttttaattaaaacttttaacaatggatctcttggttctcgtatcgatgaagaacgcagcgaaacgcgatatttcttgtgaattgcagaagtgaatcatcagtttttgaacgcacattgcactttggggtatcccccaaagtatacttgtttgagcgttgtttctctcttggaattgctttgctcttctaaaatttcgaatcaaattcgtttgaaaaacaacactattcaacctcagatcaagtaggattacccgctgaacttaagcatatcaataagcggaggaaaagaaaccaacagggattgccttagtaacggcgagtgaagcggcaaaagctcaaatttgaaatcggcccccaggtcgagttgtaatttgtagattgtatcttgagagcggattaaagtctgttggaacacagcgccttagagggtgacagccccgtaaaatctattctcattgtaagatactttcgaagagtcgagttgtttgggaatgcagctctaagtgggaggtaaattccttctaaagctaaatattgacgagagaccgatagcgaacaagtactgtgaaggaaagatgaaaagcactttgaaaagagagtgaaaaagtacgtgaaattgttaaaagggaagggtattgaatcagacttggtgctgttgttcaactgtactcagcagtactaggccaaggtggggtgtttgggagtgaaaaagaagtaggaacgtaactcttcggagtgttatagcctactttcatagctcctcctgcgcttcggcaaggaccttgtaatgattctataccgcccgtcttgaaacacggaccaaggagtctaacgtctatgcggtttgggtgtaaaacccgtacgcgtaaagtactatcgactttccggg

SEQ ID NO: 231 - DNA, 755 bp, Lactobacillus brevis
  source 1..755: mol_type = genomic DNA
tgcagtcgaacgagcttccgttgaatgacgtgcttgcactgatttcaacaatgaagcgagtggcgaactggtgagtaacacgtggggaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttcaagggttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtaganatatggaagaacaccagtggcgaaggcggctgtctagtctgtaactgacgctgaggctcgaaagcatgggtagcgaacagga

SEQ ID NO: 232 - DNA, 933 bp, Lactococcus lactis
  source 1..933: mol_type = genomic DNA
gcagttgagcgatgaagattggtgcttgcaccaatttgaagagcagcgaacgggtgagtaacgcgtggggaatctgcctttgagcgggggacaacatttggaaacgaatgctaataccgcataataactttaaacataagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttac

SEQ ID NO: 233 - DNA, 925 bp, Leucosporidium scottii
  source 1..925: mol_type = genomic DNA
gcgcatctacttgtagagcgtgacctccactttctaactctgtgcatttattggcggaaggacttgagcaatcgagtttccttctgcggctcattttaaaacactagttaaagtatgtaacgaaatatcgaaacaaaaaaaactttcaacaacggatctcttggcttgctcatcgatgaagaacgcagcgaaatgtgataagtaatgtgaattgcagaattcagtgaatcatcgaatctttgaacgcaccttgcgctctctggtattccggagagcatgtctgtttgagtgtcatgaactcttcaacccaccagtttcttgtagactgattggtgtttggtttctgagcgttgctggtcttcggatctagctcgttcgtaatatattagcatctctaattcgaactcggattgactcagtgtaatagactattcgctgaggacacgctcttgtagtgtggccgaatgagatctcagtagaagcttccaactactttagtcaactttagattagacctcagatcaggcaggattacccgctgaacttaagcatatcaataagcggaggaaaagaaactaacaaggattcccctagtaacggcgagtgaagcgggaagagctcaaatttgtaatctggcactttcagtgtccgagttgtaatctcgagaagtattttccgcgccggaccgcatacaagtctgttggaatacagcgtcatagtggtgagaaccccgtaactgatgcggatgcccggtgctttgtgatatactttcgaagagtcgagttgtttgggaatgcagctcaaattgggtggtaaattccatctaaagctaaatattggagcaagaccgatagcgaacaagtaccgtgagggaaagatgaaaagcactttggaaagagagttaacagtacgtgaaattgttgga

SEQ ID NO: 234 - protein, 714 aa, Hafnia paralvei
MVNIHAWEELANKELGRQGKKVQDLVRETSEGIAVKSLYTAHDLEGLEVTDSLPGMAPYVRGPRATMYAGQPWTIRQYAGFSTAKESNAFYRRNLAAGQKGLSVAFDLATHRGYDSDNPRVAGDVGKAGVAIDSVEDMKVLFDQIPLDKMSVSMTMNGAVLPIMAFYIVAAEEQGIGPELLTGTIQNDILKEYLCRNTYIYPPAPSMRIISDIIAWSSQNMPRFNTISISGYHMSEAGANCVQQVAFTIADGIEYIKAALKAGLNIDDFAPRLSFFFGIGMDLFMNIAMLRAARYLWSEAVSQFGATNPKSLALRTHCQTSGWSLTEQDPYNNIVRTTIEALGATLGGTQSLHTNAFDEALGLPTDFSARIARNTQIIIQEESEICRTIDPLAGSYFVESLTDQIVKQARAIIQKIDDVGGMAKAIEVGLPKRMIEEASANEQSLIDQGKRVIVGVNKYKLDKEAETQILEIDNVKVRNEQIAQLQRIRATRDNDAVQQALTRLRHAAQHNENLLEVAIEAARLRATLGEISDTIEAVFDRYLVPSECVTGVIARSYHQSENDAQAFDQILAQTQNFLTETGRRPRILIAKMGQDGHDRGAKVIASAYSDLGFDVDLSPMFSTPQEIARLAVENDVHVIGASSLAAGHKTLIPELIAALHQYGRQDICVVAGGVIPPQDYTFLREHGVSAIYGPGTPMLVSVRDVLQLISAHHD

SEQ ID NO: 235 - protein, 476 aa, Butyrivibrio proteoclasticus
MSSSSQARQRINALLEENSFVEIGALVTARNTDFNLKQEETPSDGVVTGYGVIDGNLVYVYSQDASVLGGSIGEMHARKIVRLYELAIKTGSPVIGLIDSTGLRLQEATDALNGFGEIYLKQVEASGVVPQITAIFGACGGGLAIIPSITDFTFMESEKAKLFVNSPNALDGNYKEKCDTSAAKWQSTETANVDVVSDEASIYAQIRELVSILPSNNEDGDSYQECSDDLNRACENLDGATADPSLIARQISDNGLFFETKREYAKEMVTGFIRLNGATVGLVGNRTAVFDENGKEAEKFADKLTAHGLEKAAEFITFCDAFDLPVLTLTNATGFGTSKCDEKHVAKAAGRLVYSLANATVPKVNLITGKAFGSAYVIMNSKAIGADVTISWPDAQVGTMDANLAAKIICDGKDAETVSKAAAEYAALQNNVKSAAARGYVDEIVEPADTRKYVVGAFEMLFTKRDERPAKKHGTV

SEQ ID NO: 236 - protein, 516 aa, Clostridium perfringens
MVRVSFLKPCEVAEFVKDGDTIVTEGFVASCCPESLTKALEKRFLETGHPRNLTLMYSAAQGNRDGSGADHFAHKGMTKRVIAGHWNMAPKLGKMAVENEIEAYNLPQGTLAQLFRDIAGKRVGTITHVGLNTFVDPRISGGKLNEVTKEDIVKLIEIEGEEKLLYKSFPIDVCFLRGSSADECGNVTLDREVATLDVTSIAQACKNNGGKVFVQVERVVSGGCLDPRLVKIPGIYVDGIVLAEPCDHEQCLGMKFNPAYTGEVRIPLSSIEKAPLNARKIIARRAAMELKKDTIVNLGIGIPEVISLVANEEGIGDYMTLTVESGPVGGVPQGGAAFGACINPDAILDQPYQFDFYDGGGVDLAFLGLAQADRNGNINVSKFGPRIAGCGGFINITQNAKKVIFCGTFTASGLKVETGDGKLHIIQEGKSNKFLEDVEQITFSGEYANKTNQPVMYITERAVFELRNDGLHLTEIAPGVNLEEDILAHMDFVPNIDEPLKLMDERIFYDKLMGLK

SEQ ID NO: 237 - protein, 516 aa, Clostridium perfringens; identical to SEQ ID NO: 236

SEQ ID NO: 238 - protein, 509 aa, Veillonella parvula
MATVQEKIELLHEKLAKVKAGGGEKRVEKQHAQGKMTARERLAKLFDDNSFVELDQFVKHRCVNFGQEKKELPGEGVVTGYGTIDGRLVYAFAQDFTVEGGSLGEMHAAKIVKVQRLAMKMGAPIVGINDSGGARIQEAVDALAGYGKIFFENTNASGVIPQISVIMGPCAGGAVYSPALTDFIYMVKNTSQMFITGPAVIKSVTGEEVTAEDLGGAMAHNSVSGVAHFAAENEDDCIAQIRYLLGFLPSNNMEDAPLVDTGDDPTREDESLNSLLPDNSNMPYDMKDVIAATVDNGEYYEVQPFYATNIITCFARFDGQSVGIIANQPKVMAGCLDINASDKSSRFIRFCDAFNIPIVNFVDVPGFLPGTNQEWGGIIRHGAKMLYAYSEATVPKITVITRKAYGGSYLAMCSQDLGADQVYAWPTSEIAVMGPAGAANIIFKKDEDKDAKTAKYVEEFATPYKAAERGFVDVVIEPKQTRPAVINALAMLASKRENRAPKKHGNIPL

SEQ ID NO: 239 - protein, 422 aa, Anaerotignum propionicum
MSLTQGMKAKQLLAYFQGKADQDAREAKARGELVCWSASVAPPEFCVTMGIAMIYPETHAAGIGARKGAMDMLEVADRKGYNVDCCSYGRVNMGYMECLKEAAITGVKPEVLVNSPAADVPLPDLVITCNNICNTLLKWYENLAAELDIPCIVIDVPFNHTMPIPEYAKAYIADQFRNAISQLEVICGRPFDWKKFKEVKDQTQRSVYHWNRIAEMAKYKPSPLNGFDLFNYMALIVACRSLDYAEITFKAFADELEENLKAGIYAFKGAEKTRFQWEGIAVWPHLGHTFKSMKNLNSIMTGTAYPALWDLHYDANDESMHSMAEAYTRIYINTCLQNKVEVLLGIMEKGQVDGTVYHLNRSCKLMSFLNVETAEIIKEKNGLPYVSIDGDQTDPRVFSPAQFDTRVQALVEMMEANMAAAE

SEQ ID NO: 240 - protein, 374 aa, Anaerotignum propionicum
MSRVEAILSQLKDVAANPKKAMDDYKAETGKGAVGIMPIYSPEEMVHAAGYLPMGIWGAQGKTISKARTYLPAFACSVMQQVMELQCEGAYDDLSAVIFSVPCDTLKCLSQKWKGTSPVIVFTHPQNRGLEAANQFLVTEYELVKAQLESVLGVKISNAALENSIAIYNENRAVMREFVKVAADYPQVIDAVSRHAVFKARQFMLKEKHTALVKELIAEIKATPVQPWDGKKVVVTGILLEPNELLDIFNEFKIAIVDDDLAQESRQIRVDVLDGEGGPLYRMAKAWQQMYGCSLATDTKKGRGRMLINKTIQTGADAIVVAMMKFCDPEEWDYPVMYREFEEKGVKSLMIEVDQEVSSFEQIKTRLQSFVEML

SEQ ID NO: 241 - protein, 325 aa, Rahnella woolbedingensis
MKALVLEQQDKTTVAEVKDIALPEMAEGDVLVDISWSGLNYKDALAITGKGKIIRQFPMVPGIDFTGHVKRSNDPRYSTGQAVILTGWGVGENHWGGLAQQACVKGDWLVALPEAIPARNAMIIGTAGFTAMLCVMALEDAGVTPQSGTVLVTGASGGVGSTAVALLHTLGYTVAAVTGRESTHDYLRKLGASEILSRDDFSETRPLEKQLWAGAIDTVGDKVLAKVLAQTNYGGCVAACGLAGGFGLPTTVMPFILRNVRLQGVDSVSVPAEHRAAVWERLASTLPESFYQQAATEITLEQAPAYAEDFLNNKIQGRTLVKIGG

SEQ ID NO: 242 - protein, 554 aa, Citrobacter braakii
MRSKRFEALAKRPVNQDGFVKEWIEEGFIAMESPNDPKPSIKIVNGTVTELDGKSASEFDLIDHFIARYGINLARAEEVMAMDSVKLANMLCDPNVKRKDIVPLTTAMTPAKIVEVVSHMNVVEMMMAMQKMRARRTPSQQAHVTNVKDNPVQIAADAAEGAWRGFDEQETTVAVARYAPFNAIALLVGSQVGRPGVLTQCSLEEATELKLGMLGHTCYAETISVYGTEPVFTDGDDTPWSKGFLASSYASRGLKMRFTSGSGSEVQMGYAEGKSMLYLEARCIYITKAAGVQGLQNGSVSCIGVPSAVPSGIRAVLAENLICSSLDLECASSNDQTFTHSDMRRTARLLMQFLPGTDFISSGYSAVPNYDNMFAGSNEDAEDFDDYNVLQRDLKVDGGLRPVREEDVIAIRNKAARALQAVFAGMGLPPITDEEVEAATYAHGSKDMPERNIVEDIKFAQEIINKNRNGLEVVKALAQGGFTDVAQDMLNIQKAKLTGDYLHTSAIIVGDGQVLSAVNDVNDYAGPATGYRLQGERWEEIKNIPGALDPNELG

SEQ ID NO: 243 - protein, 469 aa, Acetobacterium woodii
MNIDTTGIEYIVKKVMAEIDCAEEGGKPLKDGELGIFNDMENAIDAAFIAQKSFMRASMAFRSKIIAAMRAEMLKKENMEMICQMAVEETGMGNYEHKLLKHELAATKTPGVEDLVADAFTGDDGLTLIEQSPFGVIGAVSPSTNPSETIICNGIGMLAGGNTVVFAPHPSAKKTSALVVKLLNKAILEAGGPENLIVTTVKPTIDSANTMFASPKITMLCATGGPGVVKSVLQSGKKAIGAGAGNPPALVDETADIEKAGKDIIDGCCFDNNLPCIAEKEVVVVEQVADYLIFNMKKNGAYELKDAQKIKELEELVIPGGRLSRDYVGRSAKVILKGIGIEVDDSVRVVIIETSKDHIFAVEELMMPILAIVRVKDVAEGIDLAVSLEHGNRHTAIMHSTNINNLTEMAKRVQTTIFVKNGPSYAGIGVGGEGYTTFTIAGPTGEGLTSAKTFTRKRRCVLVGGFTIK

SEQ ID NO: 244 - protein, 402 aa, Enterobacter sp.
MIEFPVVLVINCGSSSVKFSVLDAASCEALITGIADGVNTENAFISVNGGEPAPLARKDYEGALAAIALELEARDLMGSVALIGHRIAHGGSVFSESTPITDEVIDQIREISPLAPLHNYANLSGVEAAKHLFPGVQQVAVFDTSFHQTLAPQAYLYGLPYRYFEELGVRRYGFHGTSHRYVAQQAYSLLDIPQQDSGLVIAHLGNGASICAVRNGESVDTSMGMTPLEGLVMGTRCGDVDFGAMAWIAQQTGQTLDDLERVVNKESGLLGISGLSSDLRTLEKAWHDGHERARLAIETFVHRIARHIAGHAASLHRLDGVVFTGGIGENSKLIRQLVTDRLKVFGITLDPLKNALPGSAGERIITTDDSDVPCAVIPTNEEKMIALDAIRLGKVHPAAAYA

SEQ ID NO: 245 - protein, 554 aa, Bacillus azotoformans
MKSKRFQVLAERPVNQDGFVAEWPEVGLMAMDGPYDPKPSIKIENGVIVELDGKTRDEFDFIDRFIADYAINIEKTEEAMAIDSVQFARMLVDINVPREKIVPLTTAMTPAKLCEVVADMNVVELMMALQKMRARKTPSNQCHVTNVKDNPVQIAADAAEAALRGFDEQETTVGIVRYAPFNALGLLVGSQTGRGGILTQCSVEEATELEMGMRGLTSYAETVSVYGTEPVFVDGDDTPYSKTFLASAYASRGLKMRFTSGTGSEVQMGYAEGKSMLYLEARCVYIAKGAGSQGLQNGSISCIGVPGGVPSGIRAVLAENLFTTMLDMEVASGNDQTFSHSDIRRTARTLMQMLPGTDFIFSGYSSVPNYDNMFAGANFDAEDFDDYNVLQRDLKVDGGLRPVSEEEVVAVRNKAARAVQSVFEGLGLPTITDEEVEAATYAHGSKDMPDRNIVEDLRAVDSMMKRGVTGLDVVKALSKGGFEDVAENVLNMLKQRVSGDYLHTSAIINKDWNVISAVNDLNDYRGPGTGYRISEERWEEIKNIPRAIRPEDVN

SEQ ID NO: 246 - protein, 256 aa, Bacillus azotoformans
MPQIFKGSFSSKLEKIWAQIRQGAFDQGRGLIYMAINEKLIREVIEEVLLSLKVENQQPEIIAGPKPSSVINAVQGLELTETGIATVGARKDEVVVALAPAFGIHQTKTIVKVPHNEVLKEVIAGIEEEGLTARVIRVYHTSDVGFVAHQAAKISGSGIGIGIQSKGTTVIHQKDLQPLANLELFPQAPLLDSDTFRAIGKNAAKYAKGESPNPVPTKNDQMARPKYQAIAALLHIKETEHVDRNKKPVELQVKFN

SEQ ID NO: 247 - protein, 402 aa, Salmonella typhimurium
MNEFPVVLVINCGSSSIKFSVLDVATCDVLMAGIADGMNTENAFLSINGDKPINLAHSNYEDALKAIAFELEKRDLTDSVALIGHRIAHGGELFTQSVIITDEIIDNIRRVSPLAPLHNYANLSGIDAARHLFPAVRQVAVFDTSFHQTLAPEAYLYGLPWEYFSSLGVRRYGFHGTSHRYVSRRAYELLDLDEKDSGLIVAHLGNGASICAVRNGQSVDTSMGMTPLEGLMMGTRSGDVDFGAMAWIAKETGQTLSDLERVVNKESGLLGISGLSSDLRVLEKAWHEGHERARLAIKTFVHRIARHIAGHAASLHRLDGIIFTGGIGENSVLIRQLVIEHLGVLGLTLDVEMNKQPNSHGERIISANPSQVICAVIPTNEEKMIALDAIHLGNVKAPVEFA

SEQ ID NO: 248 - protein, 216 aa, Clostridium novyi [sequence omitted]

SEQ ID NO: 249 - protein, 400 aa, Bacillus mycoides
MYDFIIIGGGIVGLSTGMALTKKFPRAKIAIIEKEKELAHHQTGHNSGVIHSGIYYKPGSYKAKFAKEGNAAMVQFCKENDIAYDMCGKVIVATEKDELPLLHNLYERGLQNDLHIAKIDKEELVEIEPHVKGLEAIRVPSCGIADYRGVSYAFARLIQESGGEIHLGTTAERITEKKDAVTIETNKGTFKTKFLINCAGLHSDRIAKKTGILTDMKIVPFRGEYYELVPEKRHLVKHLIYPVPNPEFPFLGVHFTRMINGDVHAGPNAVLSFKREGYTKTDFDIKDFMETMTYTGFWKMAMPNMKEGIKEMVRSFSKQSFLKSLQRLIPELTEKDIVPTHAGVRAQAILSNGNMVDDFCIIPGINSLHICNAPSPAATASIKIGEEIAKQVPDVVAVRV

SEQ ID NO: 250 - protein, 392 aa, Clostridium acetobutylicum
MKEVVIASAVRTAIGSYGKSLKDVPAVDLGATAIKEAVKKAGIKPEDVNEVILGNVLQAGLGQNPARQASFKAGLPVEIPAMTINKVCGSGLRTVSLAAQIIKAGDADVIIAGGMENMSRAPYLANNARWGYRMGNAKFVDEMITDGLWDAFNDYHMGITAENIAERWNISREEQDEFALASQKKAEEAIKSGQFKDEIVPVVIKGRKGETVVDTDEHPRFGSTIEGLAKLKPAFKKDGTVTAGNASGLNDCAAVLVIMSAEKAKELGVKPLAKIVSYGSAGVDPAIMGYGPFYATKAAIEKAGWTVDELDLIESNEAFAAQSLAVAKDLKFDMNKVNVNGGAIALGHPIGASGARILVTLVHAMQKRDAKKGLATLCIGGGQGTAILLEKC

SEQ ID NO: 251 - protein, 282 aa, Clostridium acetobutylicum
MKKVCVIGAGTMGSGIAQAFAAKGFEVVLRDIKDEFVDRGLDFINKNLSKLVKKGKIEEATKVEILTRISGTVDLNMAADCDLVIEAAVERMDIKKQIFADLDNICKPETILASNTSSLSITEVASATKRPDKVIGMHFFNPAPVMKLVEVIRGIATSQETFDAVKETSIAIGKDPVEVAEAPGFVVNRILIPMINEAVGILAEGIASVEDIDKAMKLGANHPMGPLELGDFIGLDICLAIMDVLYSETGDSKYRPHTLLKKYVRAGWLGRKSGKGFYDYSK

SEQ ID NO: 252 - protein, 261 aa, Clostridium acetobutylicum
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 253 - protein, 379 aa, Clostridium acetobutylicum
MDFNLTREQELVRQMVREFAENEVKPIAAEIDETERFPMENVKKMGQYGMMGIPFSKEYGGAGGDVLSYIIAVEELSKVCGTTGVILSAHTSLCASLINEHGTEEQKQKYLVPLAKGEKIGAYGLTEPNAGTDSGAQQTVAVLEGDHYVINGSKIFITNGGVADTFVIFAMTDRTKGTKGISAFIIEKGFKGFSIGKVEQKLGIRASSTTELVFEDMIVPVENMIGKEGKGFPIAMKTLDGGRIGIAAQALGIAEGAFNEARAYMKERKQFGRSLDKFQGLAWMMADMDVAIESARYLVYKAAYLKQAGLPYTVDAARAKLHAANVAMDVTTKAVQLFGGYGYTKDYPVERMMRDAKITEIYEGTSEVQKLVISGKIFR

SEQ ID NO: 254 - protein, 414 aa, Acetoanaerobium sticklandii
MSLKDKFFSHVSQEDWNDWKWQVRNRIETVEELKKYIPLTPEEEEGVKRCLDTLRMAITPYYLSLIDVENPNDPVRKQAVPLSLELHRAASDQEDPLHEDGDSPVPGLTHRYPDRVLLLMTDQCSMYCRHCTRRRFAGQTDSAVDTKQIDAAIEYIKNTPQVRDVLLSGGDALLISDEKLEYTIKRLREIPHVEVIRIGSRVPVVMPQRITPELVSMLKKYHPVWLNTHFNHPNEITEESKRACELLADAGIPLGNQSVLLAGVNDCMHVMKKLVNDLVKIRVRPYYIYQCDLSVGIEHFRTPVAKGIEIIEGLRGHTSGYCVPTFVVDAPGGGGKTPVMPNYVISQNHNKVILRNFEGVITTYDEPDHYTFHCDCDVCTGKTNVHKVGVAGLLNGETATLEPEGLERKQRGHH

SEQ ID NO: 255 - protein, 519 aa, Acetoanaerobium sticklandii
MISVESKLNLDFNLVEKARAKAKAIAIDTQEFIEKHTTVTVERAVCRLLGIDGVDTDEVPLPNIVVDHIKENNGLNLGAAMYIANAVLNTGKTPQEIAQAISAGELDLTKLPMKDLFEVKTKALSMAKETVEKIKNNRSIRESRFEEYGDKSGPLLYVIVATGNIYEDITQAVAAAKQGADVIAVIRTTGQSLLDYVPYGATTEGFGGTYATQENFRLMREALDKVGAEVGKYIRLCNYCSGLCMPEIAAMGAIERLDVMLNDALYGILFRDINMQRTMIDQNFSRIINGFAGVIINTGEDNYLTTADAFEEAHTVLASQFINEQFALLAGLPEEQMGLGHAFEMDPELKNGFLYELSQAQMAREIFPKAPLKYMPPTKFMTGNIFKGHIQDALFNMVTIMTNQRIHLLGMLTEALHTPFMSDRALSIENAQYIFNNMESISEEIQFKEDGLIQKRAGFVLEKANELLEEIEQLGLFDTLEKGIFGGVKRPKDGGKGLNGVVSKDENYYNPFVELMLNK

SEQ ID NO: 256 - protein, 344 aa, Acetoanaerobium sticklandii
MKGCKYGTHRVIEPKGSLPQPALKISNDMNIFSNEILIDVQALNVDSASFTQIEEEAGHDTKKIAAKILEIVGERGKMQNPVTGSGGMLIGTIEKIGEDLEGKIDLKVGDKIATLVSLSLTPLQIDEIIDIKPDIDRVEIKGKAILFESGIYAKLPTDMSETLALAALDVAGAPAQTAKLVKPGDSVLILGAAGKSGMMCCYEAKKRVGPTGRVVGLVRNEKSKAKLLEMGIVDDVIIASAQLPVEVLETSLAANNGNEYDISINCVNVENTEMSSILPIRNGGTVYFFSMATSFTKAALGAEGVGKDVDMIIGNGYTKGHAEITLQILRESEIVRTTFEKMYL

SEQ ID NO: 257 - protein, 273 aa, Acetoanaerobium sticklandii
MEKLIITAAICGAEVTKEHNPNVPYTVEEIVREAKSAYDAGASVIHLHVREDDGTPTQSKERFKMCVDAIKEACPDAIIQPSTGGAVGMTDEERLQPVFLKPEMASLDCGTCNFGGDEIFVNTENMIINFSKYMIKNGVKPECEVFDKSMIDMAIRLAKKGHIQTPMHFNFVMGVNGGISATPRDLVFLIGSIPSESSFTVSAMGRNQFPMAAMAIITGGHVRVGFEDNVYIEKGVPAKSNGELVEKVVRLAKEFGRPVATPSEAREILGISK

SEQ ID NO: 258 - protein, 126 aa, Clostridium acetobutylicum
MKSVLKIRMSAHDAHYGGGLVDGARMLQLFGDVATELLIMNDGDEGLFKAYDMVEFMAPVFAGDYIEVEGSITEQGNTSRKMIFEARKVIVPRTDINDSACDVLETPIVVCRASGTCVVPKDKQRK

SEQ ID NO: 259 - protein, 371 aa, Clostridium kluyveri
MKLLKLAPDVYKFDTAEEFMKYFKVGKGDFILTNEFLYKPFLEKFNDGADAVFQEKYGLGEPSDEMINNIIKDIGDKQYNRIIAVGGGSVIDIAKILSLKYTDDSLDLFEGKVPLVKNKELIIVPTTCGTGSEVTNVSVAELKRRHTKKGIASDELYATYAVLVPEFIKGLPYKFFVTSSVDALIHATEAYVSPNANPYTDMFSVKAMELILNGYMQMVEKGNDYRVEIIEDFVIGSNYAGIAFGNAGVGAVHALSYPIGGNYHVPHGEANYLFFTEIFKTYYEKNPNGKIKDVNKLLAGILKCDESEAYDSLSQLLDKLLSRKPLREYGMKEEEIETFADSVIEGQQRLLVNNYEPFSREDIVNTYKKLY

SEQ ID NO: 260 - protein, 490 aa, Clostridium aminobutyricum
MLMTAEQYIESLRKLNTRVYMFGEKIENWVDHPMIRPSINCVAMTYELAQDPQYADLMTTKSNLIGKTINRFANLHQSTDDLRKKVKMQRLLGQKTASCFQRCVGMDAFNAVFSTTYEIDQKYGTNYHKNFTEYLKYIQENDLIVDGAMTDPKGDRGLAPSAQKDPDLFLRIVEKREDGIVVRGAKAHQTGSINSHEHIIMPTIAMTEADKDYAVSFACPSDADGLFMIYGRQSCDTRKMEEGADIDLGNKQFGGQEALVVFDNVFIPNDRIFLCQEYDFAGMMVERFAGYHRQSYGGCKVGVGDVVIGAAALAADYNGAQKASHVKDKLIEMTHLNETLYCCGIACSAEGYPTAAGNYQIDLLLANVCKQNITRFPYEIVRLAEDIAGGLMVTMPSEADFKSETVVGRDGETIGDFCNKFFAAAPTCTTEERMRVLRFLENICLGASAVGYRTESMHGAGSPQAQRIMIARQGNINAKKELAKAIAGIK

SEQ ID NO: 261 - protein, 262 aa, Acetoanaerobium sticklandii
MSSGLYSMEKKEFDKVLDLERVKPYGDTMNDGKVQLSFTLPLKNNERSAEAAKQIALKMGLEEPSVVMQQSLDEEFTFFVVYGNFVQSVNYNEIHVEAVNSEILSMEETDEYIKENIGRKIVVVGASTGTDAHTVGIDAIMNMKGYAGHYGLERYEMIDAYNLGSQVANEDFIKKAVELEADVLLVSQTVTQKNVHIQNMTHLIELLEAEGLRDRFVLLCGGPRINNEIAKELGYDAGFGPGRFADDVATFAVKTLNDRMNS

SEQ ID NO: 262 - protein, 301 aa, Clostridium acetobutylicum
MIKSFNEIIMKVKSKEMKKVAVAVAQDEPVLEAVRDAKKNGIADAILVGDHDEIVSIALKIGMDVNDFEIVNEPNVKKAALKAVELVSTGKADMVMKGLVNTATFLRSVLNKEVGLRTGKTMSHVAVFETEKFDRLLFLTDVAFNTYPELKEKIDIVNNSVKVAHAIGIENPKVAPICAVEVINPKMPSTLDAAMLSKMSDRGQIKGCVVDGPLALDIALSEEAAHHKGVTGEVAGKADIFLMPNIETGNVMYKTLTYTTDSKNGGILVGTSAPVVLTSRADSHETKMNSIALAALVAGNK

SEQ ID NO: 263 - protein, 355 aa, Clostridium acetobutylicum
MYRLLIINPGSTSTKIGIYDDEKEIFEKTLRHSAEEIEKYNTIFDQFQFRKNVILDALKEANIEVSSLNAVVGRGGLLKPIVSGTYAVNQKMLEDLKVGVQGQHASNLGGIIANEIAKEINVPAYIVDPVVVDELDEVSRISGMADIPRKSIFHALNQKAVARRYAKEVGKKYEDLNLIVVHMGGGTSVGTHKDGRVIEVNNTLDGEGPFSPERSGGVPIGDLVRLCFSNKYTYEEVMKKINGKGGVVSYLNTIDFKAVVDKALEGDKKCALIYEAFTFQVAKEIGKCSTVLKGNVDAIILTGGIAYNEHVCNAIEDRVKFIAPVVRYGGEDELLALAEGGLRVLRGEEKAKEYK

SEQ ID NO: 264 - protein, 356 aa, Clostridium acetobutylicum
MKFKLLTINPGSTSTKIAVFENEKEILSETLRHSSKELEAYKNIYEQFEFRKDTILKVLKDKNFNIQNIDAVVGRGGLLKPIVGGTYKVNEKMLKDLKAGVQGEHASNLGGIIANSIAEAFGVSAYIVDPVVVDEMEDIARFSGIPELPRKSIFHALNQKAVAKRYAKESERDYEDLNIIVAHMGGGVSVGAHKNGKIIDVNNALDGEGAFSPERSGNLPSGDLVRLCFSGKYTEDEILKKITGKGGFVAYHGTNNALDVQNAALEGDYDAKMTYNAMGYQVAKDIGSAAAVLDGKVDCIILTGGIAYNKLMTDFIAKKVSFIAPITIYPGEDEMLALAEGTLRVLSGQEEAKKYK

SEQ ID NO: 265 - protein, 269 aa, unidentified
  source 1..269: note = glutaconate CoA-transferase, subunit B
MADYTKYTNKEMQAITLAQQITDDNIAIVGTGLPLIGASVAKRLFAPKCNLIVESGLMDCSPIEVPRSVGDLRFMAHCGCQWPNIRFIGFETNDWLHNNDRIIAFIGGAQIDPYGNVNSTCIGDYHNPKTRFTGSGGANAIATFNNTIIMIQHEKRRFMQKIDYVTSPGWIDGPGGRERLGLPGNRGPLAVVTDRGILKFDKDTKRMYLAGYYETSSPEDIIENTGFDLDVSRAVKLDPPSPEVIKMIREEIDPGQAFIQVPKEEPEAK

SEQ ID NO: 266 - protein, 588 aa, Clostridium sp.
MNMYSMPGYFQNMPIIGKSLVNQNPENEESLKAVEQDIHESIEKVLAAGITSEEKLNERGQLSAMQRINALIDAGTWCPLNSLFNPEDNRFGTTNIVNGLGRVDGKWVYIVASDNKKMAGAWVPGQAENLLRASDTAKMLHLPLVYLLNCSGVEFPNQDKVYPNRRGGGTPFFRNSELNQLGVPVIVGIYGTNPAGGGYHSISPTVLIAHQDANMAVGGAGILSGMNPKGFIDEETAEGIIAAQIENSKHHVPAPGSVPIHYDETGFFREVYENDLGVIEGIKKYISYLPAYNLEFFRVDTPKAPQFPAEDLYSIVPMNQKRPYDMYEVIARLFDNSEFAEYKKGYGPEMITGLAKVNGLLVGVVANVQGLLMNYPEYKQNSVGIGGKLYRQGLIKMNEFVTLCARDRIPLIWLQDTTGIDVGDEAEKAELLGLGQSLIYSIENSKLPSLEVTIRKASAAAHYVLGGPQGNNTNVFSLGTGACEYYVMPGETAANAMYSRKLVKAKKAGEPLQPIIDKMNDMINMYTEKSRPKYCTKTGMVDEIVDMTDIRPYIQAFTEAAYQNPQSICPFHQMITPRAIREFETFKK

SEQ ID NO: 267 - protein, 218 aa, Clostridium acetobutylicum
MNSKIIRFENLRSFFKDGMTIMIGGFLNCGTPTKLIDFLVNLNIKNLTIISNDTCYPNTGIGKLISNNQVKKLIASYIGSNPDTGKKLFNNELEVELSPQGTLVERIRAGGSGLGGVLTKTGLGTLIEKGKKKISINGTEYLLELPLTADVALIKGSIVDEAGNTFYKGTTKNFNPYMAMAAKTVIVEAENLVSCEKLEKEKAMTPGVLINYIVKEPA

SEQ ID NO: 268 - protein, 221 aa, Clostridium acetobutylicum
MINDKNLAKEIIAKRVARELKNGQLVNLGVGLPTMVADYIPKNFKITFQSENGIVGMGASPKINEADKDVVNAGGDYTTVLPDGTFFDSSVSFSLIRGGHVDVTVLGALQVDEKGNIANWIVPGKMLSGMGGAMDLVNGAKKVIIAMRHTNKGQPKILKKCTLPLTAKSQANLIVTELGVIEVINDGLLLTEINKNTTIDEIRSLTAADLLISNELRPMAV

SEQ ID NO: 269 - protein, 373 aa, Lactiplantibacillus plantarum
MSKYDYLVVGAGLFGAVFAHEAALRGKHVKVIEKRNHIAGNIYTKEVDGIQVHQYGAHIFHTSDKQIWEYVNQFAEFNRYTNSPVANYKGHMYNLPFNMNTFSELWGVRTPAEAQAKIQEQKDAAQLSGEPKNLEEQAISLIGTDIYEKLIKGYTEKQWGQKATDLPAFIIRRLPVRYTYDNNYFNDTYQGIPIGGYTQIVEKMLDHPEIDVETGVDFFANKNQYLADFPKIIFTGMIDQYFNYQLGELEYRSLRFETEERDVDNYQGNAVINYTDAETPYTRIIEHKHFEFGKGDKGKTIITREYPANWKRGDEPYYPVNNTRNNTLYKQYAELAKQEGNVIFGGRLGQYRYYDMHQVIHAALVTVNKISNL

SEQ ID NO: 270 - protein, 334 aa, Lactiplantibacillus plantarum
MNKGRIVWIDIAKGIGIILVVYGHALGGIMNSNGIGVHNSLTIPYNIIYGFHMPLFFFLAGMFVHNWAKRPLKVALSQKLRSLVIPYFVWTIITGSVMALVRKYTNSGLGVKDILLSPIAPFSEYWFLYVLFVIFVIYYVMIRLVNDKGLIVIAFLLFLMRPILYEYWIFDALSLNFLWFVLGAEFQKQKMLNSVMKYSTKKMWFSLIVFVVVNILNLIVLRLNVYWIGSYYKVLTVPAGIMFVIYISQLLEKYEVIEAILSWLGGASMAIYVMHLIPIAGCRIIALKLIRYQNLFALSIIITLIALIVCVSIYALIIKTVIGKVVFGKKLVKY

SEQ ID NO: 271 - protein, 207 aa, Lactiplantibacillus plantarum
MKSNFSFLPFFKVLWYRLFWIVLFAVLGGISGYFVERQMFTPQYSVSSTVSVYHVKSKAGSNLDQLNTDVNRLGTVQSEIGDPGIYANASRLVKENKGTSIPTKYFIEHVSVSAKASSTILSVGATANTAQKAADMSNYVIQAYKNKYLKSDGRLRIEQLSKAKAMYATKSEPDYMKFIKNGALIGAILAYLVCLVLYFRKRNSKSK

SEQ ID NO: 272 - protein, 339 aa, Lactiplantibacillus plantarum
MSHIGGISMQNPRLTIIVPCYNEEAVLPKSAHILDGILTDLIQHKQVNAASKLLFVDDGSQDKTWKLIKSLEKQYSTVTGLKFSRNFGHQNALMAGMQVASPTAEIVITIDADLQDDPQVIPEMVARYRAGSDIVLGVRNDRSSDSLFKRWTADGFYRLMERIGVQLVPNHADFRLLSQRAVQALLTYEETNLFLRGIVPRLGFPTTKLYYHRQPRFASVSKYPLRKMVAFAFDGITSFSIAPIKVILLFGMVISGGSLMMMLYALIQGLLGTATSGWSSLMTSLWFLGGMQLIGISIVGEYVGKIFAEVKHRPRYIIETDDYTATQQPAIVNSQRVHG

SEQ ID NO: 273 - protein, 237 aa, Lactiplantibacillus plantarum
MITVCMATYNGERYVRQQLASILKQLNSADEVIVVDDCSQDRTLFMIKTFNDERIKVISNSTNIGPIKSFEKGLVLSHGDYIFLADQDDVWLSNKVSTVLNCFKHDKADLVVHDAIVVDDNLKPIAQSWNNYNHNRFGKSWLSTLTKNPFTGANMAFSRRVLEACVPFPEKIPMHDWWIGGVCQQSGFEISIINKSLLLYRRHNSNVTGNSHQLKKMLVNRIHFWSVMRRHSSGCIN

SEQ ID NO: 274 - protein, 193 aa, Lactiplantibacillus plantarum
MGKLKVTTTKLQDVKIIEPAVFGDKRGFFTETYSDRDFKEAGIDFDFIQDNQSLSAEAGVLRGLHFQRGKAAQTKLIRVVTGAVLDVIVDVRAGSPTYGEWEGYIISESNHRQLLVPRGFAHGFVTLTDNVNFLYKCDNYYNAEADGGITFMDKDLNINWPIDYDQAITSDKDAKQQTFKEFEQNNPFVYGEI

SEQ ID NO: 275 - protein, 280 aa, Lactiplantibacillus plantarum
MAKVMIVGANGQLGHELQRLLNEQEIAFDALTEKELDITDLDAVKAKIAELQPAVLYDCAAYTAVDKAEDEGKALNWLVNVDGTKNLAQVAAEQGVKLVYVSTDYIFDGTNKGEYLEDDPANPKNEYGRAKWAGEEAVRHSGADYYIVRTSWVFGEFGHNFVFTMQNLAKTHDKLTVVNDQLGRPTWTRTLAEFMAHLVKTEAASGTYQLSNDNTATWYDFAKEILKNTDVEVAPVTSEQFPQKAYRPQHSVMNLDKAKATGYHILTWQEALSEFLESLG

SEQ ID NO: 276 - protein, 256 aa, Lactiplantibacillus plantarum
MMDQAVSFDFFIRLVRKYWRAIVSFTVVGLIVAAGLTFFVITPKYQSSVQILVNRKNTNAATEYAGQQADVQMITTYKELIAGQVVLKPAKQQLSKRYGIERSLNTLKSEVSVTSTTNSQVFSIAVTDADAKASATIANQIARSFKNQVQKIIKVNNVTIVAPAETPNGAVSPKKPLNMLIGLVVGLLLGIVYAAIRMLTDRRVHDADFLTDELGLTSLGLVNHQHHHSMKKQALNLNGGYHTHNDRTSSQAMKRV

SEQ ID NO: 277 - protein, 242 aa, Lactiplantibacillus plantarum
MFKRKEQNITTTAPINLTTINEPMSVITEQIKTIRTNINFAATDHKLRTLMVTSAMLGEGKSTVSGNLAVEYAKEGMQVLLVDADLRRPTIHKTFGLKNHKGLSSWLANQMDDVNDAIHPVIGNLFVMTSGPKPPNPAELLGSNKMTEFLTSATRKLDLVIVDAPPILPVTDSQLLANKVDGTVLVVRQGVAQKAAVRDAVNSLKKSQANILGTVLNDVRDSSHHGYYGYNSGYGYYSDEDK

SEQ ID NO: 278 - protein, 287 aa, Lactiplantibacillus plantarum
MKGIILAGGSGTRLYPVTKVTSKQLLPIYDKPMIYYPLSTLMLSGIKDILIISTSRDSNSFKALLGDGSELGIHIEYAIQQEPNGLAEAFIIGKQFIGDDSVCLILGDNIFYGNGLSETLQKAVRLKDGAIVYGYRVKDPERFGVVSFDNKKNVISIEEKPTDPKSDFAVTGIYFFDNDVVSIAESIKPSARGELEITDINNVYLKRKKLKVELLSRGFAWLDTGTHESLQDASSFIQTVERRQNILIASIEEVAFRMGYIDSKQLQSLAAPLHKTRYGQYLASLVE

SEQ ID NO: 279 - protein, 429 aa, Lactiplantibacillus plantarum
MKKKVYTWILISVVLLSCTALVIANQHRLQSSQATNRQAVLTANKPLTDKVGGFVWLYGYKKGSTRNRDYIKSQVIAAHSTHLHYVVISILFNNKYVNKGKFDFEEFDFAMKTIKENGLVPIVVFSSNDSVDANEYAKNKRAVLNKYERLIRSVIIKYRDHGVIWQMWNEPNGLFWFNQSNSGTNAAQVRTWVDFNAKIFAYVRRYDPNSVFLAGAIAGNYSDSKQDMRLAIQNHITKYGDALANHPYLSSSYPDNGAPENLLKLNSRKFLLSLTADNSKKAVRSIPLVTTEMGYSMSKSHFGSWSEEDQANYLARSIFVLDMMHQPIISLYALVDEKNGSGEWGLYKGMSPHYVSKQSARLISQLLSNLDGYSFDERLHSDTRDFVLKYKKNGQRDRIVCWTMDDDHVLKVSGQTVLVTKTPQIVYEK

SEQ ID NO: 280 - protein, 353 aa, Lactiplantibacillus plantarum
MKITFILPGFTRFPVGGYQIVYQYAGYLSSKGYDVEIIHAMFLPTQEKPGIKKKIIYSVKSFLFALHLIRPWFQIDSRIKVLNKGKILTKDVRKADRVIATAWETSEFVSLLPSECGEKYYFIQHYETWGGKERVDKTWKLPLKKIVIASWLKKIASEMQEEAVLVPNFVEQNNFFVTKPIKDRTPTISMLYSEHEIKGSNLGIQVLKMLKNKYPNVHIKLFGVFEKPDNLPEGTMYYQNPSRKVLRDEIYNESSVYLFPSVSEGWGLTATEAMACGAALCSTDNGGVDDFAVDGESALISPVKNAERLFKNLERLVIDDELRNKIAVNGQQNVLKLTFDSSAHLFEHAIDLA

SEQ ID NO: 281 - protein, 273 aa, Lactiplantibacillus plantarum
MTWTLKLTVMGTAIMGLRPTEYIDLHCHLLPGLDDGPQQLAQAVEMARQAVADGIHYVLATPHHLDRRYQNTGLVVERAVAELQAELKRQQIPLTVFAGQEVHLRDDLATALPHLLGIDVGRRYLLLELPHEQVPNYVAQVIFELLQQGTTPVIAHPERNAQIMAQPERLYDLVQQGCLAQLTAGSLVGQFGRAVKSTALELVECGLVQVIASDAHLMARRGFMMRAGYQALARLDSTNPASFAVNARLLLNGDPVVLGEVLRPNQRRKFWLF

SEQ ID NO: 282 - protein, 257 aa, Lactiplantibacillus plantarum
MAFGRKKHLNNDTMKNGVKLITLANPQSVISEQFRNIRTNINFMNVDREVKTIVFTSAMASAGKSTVSANVAITMAQAGKKTILVDADLRRPTMHSTFNVSNSNGLTTLLTSRSMEMDANSVIRESGVENLSILTAGPIPPNPSELLSSKHMLDLIEDLKQEYDMVVLDLAPILDAGETQQLTSFLNGTILVVRQAYSQKSAVKRAVELLKLTKSPILGYVMNDVDADGDDGYGYGYGYGYGYGEEKEKKGLFGRKK

SEQ ID NO: 283 - protein, 331 aa, Lactobacillus casei
MTIAVLGGAGYIGSHTVKQLLAAGEDVVVLDNLITGHRKAVDPRARFYQGDIRDYHFLSQVFSQEKIDGIVHFAAFSIVPESMKDPLKYFDNNTGGMITLLEAMNQFGIKKIVFSSTAATYGEPKQVPIKETDPQVPTNPYGESKLAMEKIMHWADVAYGLKFVALRYFNVAGAMPDGSIGEDHHPETHIVPIILQVAAGTRTGLQIYGDDYPTKDGTNVRDYVHVVDLADAHILALKYLDAGNKSSAFNIGSAHGFSNLEILNAARKVTGQEIPATMGPRRAGDPSTLIASSEKARDILGWKPNYDDIDKIIETAWNWHENHPEGFGDRN

SEQ ID NO: 284 - protein, 373 aa, Limosilactobacillus fermentum
MSKYDYLVVGAGLFGATFAYEAAKRGKRVKVIEKRDHIAGNIFTKEVDGIQVHQYGAHIFHTSNKEIWDYVNQFATFNRYTNSPVANYKGTMYNLPFNMNTFNKMWGVRTPQEAMDKINEQRQEMAGKTPQNLEEQAISLIGRDIYEKLVKGYTEKQWGQKATELPAFIIRRLPVRLTYDNNYFNDDFQGIPVGGYTQIVEKMLASDLIDVETGVDFFAKREEYLANYPKVVFTGMIDEFFDYQLGELQYRSLRFETEELDVDNYQGNAVINYTDAETPYTRVIEHKHFEFGKGDKDKTIVTREYPADWHRGDEPYYPVNNQQNNDLYKQYAKLAQEKEANVIFGGRLGQYRYYDMDQVLHAALVCVEKEFNK

SEQ ID NO: 285 - protein, 221 aa, Lactiplantibacillus plantarum
MHEVEINESIVADEQHCEFISKIGVPVTGWKMDLKRCFDLAVGLLGTLLSVPIVIVFAILIKLTSDGPVFYKQERVGWMGTTFDVIKLRSMYQDAEAQTGAIWAKKNDPRVTPVGRWMRKTRIDELPQFWNVLKGDMSLVGPRPERPELTEQFSERYPDFPKRLRIIPGITGYAQINGGYDITPGAKCQYDNYYIEHFSIWFDIKMLMGTVRVIISGDGAR

SEQ ID NO: 286 - protein, 245 aa, Lactobacillus paracasei
MRSRVIYADTYRKRHQRRLFLLAVLIIALGALFVWWHQRNPRPDPQTYPVLGVRLDQTDGVQDFDSLRSSKVSFVYLKATEGSSYFDDNFNTNFNQAAGSRLSIGIYHGFSFETTPQAQAAQFTRQVGQNIGDLPIGIYLSYYTEKKPSTQWLTTHLQTFVTLVQQHYHRQVLLMGSPSILKAAQKVDPQAPRWVVSDKKPTTSSGFWQYTSGARLPNGPHADYRAAVFMGDRAAFLKLSQQIVN

SEQ ID NO: 287 - protein, 211 aa, Lactobacillus casei
MAKRRRHFTLKIIPLAAWLVIGFFAIGVTLVVGSYWAQQQTEVTQKQEVADEKAAVRAKKVAFIKRLVPTAQAMQKQYGVLTSITLAQAILESNWGTSALAKDYHNLFGIKGTDPATTKVLRTQEYVNDKWITVDGRFRVYDNDSESIRDHALLFVNGTDWNPQQYATVRAAKDYKTAAAALKTDGYATDPDYPQKLIHLIETWNLTQYDS

SEQ ID NO: 288 - protein, 331 aa, Lactiplantibacillus plantarum
MQNPRLTIIVPCYNEEAVLPKSAHILDGILTDLIQHKQVNAASKLLFVDDGSQDKTWKLIKSLEKQYSTVTGLKFSRNFGHQNALMAGMQVASPTAEIVITIDADLQDDPQVIPEMVARYRAGSDIVLGVRNDRSSDSLFKRWTADGFYRLMKRIGVQLVPNHADFRLLSQRAVQALLTYEETNLFLRGIVPRLGFPTTKLYYHRQPRFAGVSKYPLRKMVAFAFDGITSFSIAPIKVILLFGMVISGGSLMMMLYALIQGLLGTATSGWSSLMTSLWFLGGMQLIGISIVGEYVGKIFAEVKHRPRYIIETDDYTATQQPAIVNSQRVHG

SEQ ID NO: 289 - protein, 238 aa, Lactobacillus brevis
MIYAEILAGGKGTRMGNTALPKQFLNLGGMPIIIQTTSKFLLQPFFSGILIVVPNQWMRYTSDLFKKFFSEDELRKISIVKGGNNRNQTLMNGVDFIENNFGLNDEDIIVTHDAVRPFVSSKIIEENVKAAKKYGAADTVITATDTIVEGNLANDLIKSIPDRKKMYQGQTPQTFNIKKLKSGYAKLSEDQKSILTDAAKIFLLTDTSSVKMVEGESINFKITKIFDLKMAELLVGER

SEQ ID NO: 290 - protein, 502 aa, Lactiplantibacillus plantarum
MFYFINEYILGKNSSVEHAAINRVKLFNHYKAPAQIVTKMYDRLLHQTMGTFQLANQQVLNMFDYFQQTTDVPTKVLHTDDMHLPVEYAVEVGANFSKIFNGDEHVSNVGFIPGTIGRVFYQEFFDNQGNLSSTDLWDWRGFKSSTQYFGQNGKLVLERFYNLQGETVIEQYYVPDTNGNPLASRLILKNYRDQAERFFQDANHLFRFFLAELSHLDKQTTTFISDRPGTSVKPLLELQDDSHKYVTVPIYQAKDINDPIHSPLDGFLTPAFDNLQHFDGFITATESQAQHLRTRFPKAKVTVLPTVTTSPLAQSKLRPITARPKQLLYVGRLAPDRQLDQLIRTIALVKQQVKEIQCDFYGYGDPEYLKTLNKLVEELKLTNNVHLLDYHPDLETRYDDYQLLLNTDIVDGGPMSMPEAMSHGIPVISYRFNYGPKDWIDDGHDGFIVDPGNQLALRDRVIELMTDTKKLTAFSEAAFKKLHTSQTDLKVWHRWQQLLGIK

SEQ ID NO: 291 - protein, 270 aa, Lactobacillus helveticus
MALVSVIMSVFNVKKYEYLLNSVNSILNQTYKNFEFIICDDGSTDSKTKEYLERISKLDSRIKIIGYKKNHGPGYSRNECIKFSKGKYIAFQDDDDFSKKERLEKEVNFLDKHPEYSFVGTIANVFDKNKIWGTFRLPEKPQKSDFLWNSPFLNPSMMFRADALKAVHGFRVTKETRRAEDYDLFFRLYAKGYKGYNIQEILFNYRIDIENEKHKKYRPMKDRINEAKVRYGGFKALHLGYRSIPYVIKPIIIGLIPAPIFYEIRKKQYR

SEQ ID NO: 292 - protein, 289 aa, Lactobacillus delbrueckii
MYKNDLSFVMSKILGRLPAKRISDKFNIYRHQQIRKQLTPVFDEAYETFTRYDSHKVNDTIWIFWWQGEDSMPKVVKKCYRSIQQNRGKKNIVLITQDNIKQYTDIPKFIYDKLDKGVITYTHFSDIVRANLIKNNGGLWMDATLYVTSSLDNIDLKKLFYCSGYPADTFNVSFGRWTGFFMGGPSGMDLFSFMDRLYEVYWRDHEKLFDYFLIDYGLDYAWKKDLSSFKSLEESYKQNNPHLFDLQGMLNQPYDDKEWKRITSDTSVFKLSYKKKVDFDKKESYYNRL

SEQ ID NO: 293 - protein, 605 aa, Streptomyces sp.
MHVPPTDPARSAPPASPHRRRRPKALGLTALAAAMLMAVPTTQAAFGSDVRPAAAQEVVGGGDLGPNVLVFDPSTPDIQGKVDEVFRKQESNQFGTDRYALMFKPGTYNDINAQIGFYTSIAGLGLNPDDTTFNGDVTVDAGWFDGNATQNFWRSAENLALNPVNGTNRWAVSQAAPFRRMHVKGGLNLAPDGYGWASGGYIADSKIDGEVGPYSQQQWYTRDSSVGGWGNGVWNMTFSGVEGAPAQSFPEPPYTTLETTPVSREKPFLYLDGDDYKVFVPAKRTNARGTSWGNGTPEGESLPLDQFYVVKPGATAETINAAVDQGLHLLFTPGVYHVDQPIEIDRANTVALGLGLATIIPDNGVTALKVGDVDGVKVAGLLVDAGPVNSETLVEVGSDGASGDHAANPTSLQDVFVRIGGAGPGKATTSIVVNSNDTIIDHTWVWRADHGEGVGWETNRADYGVHVKGDNVLATGLFVEHFNKYDVQWSGENGKTIFYQNEKAYDAPDQAAIQNGDIKGYAAYKVDDSVTTHEGWGMGSYCYFNVNPDIRQQHGFQAPVKPGVKFHDLLVVSLGGKGQYEHVINDIGDPTSGDTTIPSQVVSFP

SEQ ID NO: 294 - protein, 548 aa, Cellulosimicrobium cellulans
MPHDRKNSSRRAWAALCAAVLAVSGALVGVAAPASAVPATIPLTITNDSGRGPIYLYVLGERDGVAGWADAGGTFHPWPGGVGPVPVPAPDASIAGPGPGQSVTIRLPKLSGRVYYSYGQKMTFQIVLDGRLVQPAVQNDSDPNRNILFNWTEYTLNDGGLWINSTQVDHWSAPYQVGVQRADGQVLSTGMLKPNGYEAFYTALEGAGWGGLVQRAPDGSRLRALNPSHGIDVGKISSASIDSYVTEVWNSYRTRDMVVTPFSHEPGTQFRGRVDGDWFRFRSGSGQEVAAFKKPDASSVYGCHKDLQAPNDHVVGPIARTLCAALVRTTALTNPNQPDANSAGFYQDARTNVYAKLAHQQMANGKAYAFAFDDVGAHESLVHDGNPQAAYIKLDPFTGTATPLGNGGSTEQPGTPGGLPAGTGALRIGSTLCLDVPWADPTDTNQVQLATCSGNAAQQWTRGTDGTVRALGKCLDVARSGTADGTAVWIYTCNGTGAQKWTYDSATKALRNPQSGKCLDAQGGAPLRDGQKVQLWTCNQTEAQRWTL

SEQ ID NO: 295 - protein, 682 aa, Niallia circulans
MKPSHFTEKRFMKKVLGLFLVVVMLASVGVLPTSKVQAAGTTVTSMEYFSPADGPVISKSGVGKASYGFVMPKFNGGSATWNDVYSDVGVNVKVGNNWVDIDQAGGYIYNQNWGHWSDGGFNGYWFTLSATTEIQLYSKANGVKLEYQLVFQNINKTTITAMNPTQGPQITASFTGGAGFTYPTFNNDSAVTYEAVADDLKVYVKPVNSSSWIDIDNNAASGWIYDHNFGQFTDGGGGYWFNVTESINVKLESKTSSANLVYTITFNEPTRNSYVITPYEGTTFTADANGSIGIPLPKIDGGAPIAKELGNFVYQININGQWVDLSNSSQSKFAYSANGYNNMSDANQWGYWADYIYGLWFQPIQENMQIRIGYPLNGQAGGNIGNNFVNYTFIGNPNAPRPDVSDQEDISIGTPTDPAIAGMNLIWQDEFNGTTLDTSKWNYETGYYLNNDPATWGWGNAELQHYTNSTQNVYVQDGKLNIKAMNDSKSFPQDPNRYAQYSSGKINTKDKLSLKYGRVDFRAKLPTGDGVWPALWMLPKDSVYGTWAASGEIDVMEARGRLPGSVSGTIHFGGQWPVNQSSGGDYHFPEGQTFANDYHVYSVVWEEDNIKWYVDGKFFYKVTNQQWYSTAAPNNPNAPFDEPFYLIMNLAVGGNFDGGRTPNASDIPATMQVDYVRVYKEQ

SEQ ID NO: 296 - protein, 548 aa, Arthrobacter sp.
MPHDRKNSSRRAWAALCAAVLAVSGALVGVAAPASAVPATIPLTITNDSGRGPIYLYVLGERDGVAGWADAGGTFHPWPGGVGPVPVPAPDASIAGPGPGQSVTIRLPKLSGRVYYSYGQKMTFQIVLDGRLVQPAVQNDSDPNRNILFNWTEYTLNDGGLWINSTQVDHWSAPYQVGVQRADGQVLSTGMLKPNGYEAFYTALESAGWGGLVQRAPDGSRLRALNPSHGIDVGKISSASIDSYVTEVWNSYRTRDMCVTPFSHEPGTQFRGRVDGDWFRFRNGSGQEVAAFKKPDASSVYGCHKDLQAPNDHVVGPIARTLCAALVRTTALTNPNQPDANSAGFYQDARTNVYAKLAHQQMANGKAYAFAFDDVGAHESLVHDGNPQAAYIKLDPFTGTATPIANGGSTEQPGTPGGLPAGTGALRIGSTLCLDVPWADPTDTNQVQLATCSGNAAQQWTRGTDGTVRALGKCLDVARSGTADGTAVWIYTCNGTGAQKWTYDSATKALRNPQSGKCLDAQGGAPLRDGQKVQLWTCNQTEAQRWTL

SEQ ID NO: 297 - protein, 1020 aa, Alkalihalobacillus halodurans
MKGKNVQLLFALVVIILLFPTGASASSHAVSVGKGSYATEFPEIDFGGINDPGFRGQQGEPPATIYRSDRVTGPMQTNSWWGSLAVDRFSMNQYPHPFSVRHRPEGLHVFYDAPHNMVVHENREAGTWHIHGAIGTDFIIKHSGTANFEQAVVDDYNDWYVRGLLENGAQQMAVTYGVGSPYIFVEYEGGSAVLDFDIAPDVWEMNGHVIGFSTHDHKHYAAFAPPGQNWSGIGSRTLTNNANYIAIAKLPEKDGNMLAKFEQYAYSVVRDAVADWTYDEATGTVTTTFEVTTEAKVQGAPDGTIFALYPHQYRHLASSSENQLLQNYQYKIIRGTMIGLEGKRFTTELTYPGVLPSLPDLGDYDRERLIGYLHDATSDYPTGSDTYELGKYIGKLATLAPIADQMGEYELAEQFRGELKDILEDWLQATNASGQLKGKNLFYYNENWGTILGYHAAHSSATRINDHHFHYGYFVKAAAEIARADQEWAKSENWGGMIDLLIRDFMADRDDDLFPYLRMFDPYSGNSWADGLATFDAGNNQESSSEAMHAWTNVILWAEATGNKALRDRAIYLYTTEMSAINEYFFDVHQEIFPEEYGPEIVTINWGGKMDHATWWNSGKVEKYAINWLPFHGGSLYLGHHPDYVDRAYEALRRDIGSTDWNLWSNLVWMYRAFTNPDDALQQMEASIDDYGLFDPGNEKIIERGSTKAQTYHWNHNLAELGRVDPTVTANHPIYAVFNKNGIRTYIAYNFSDSPITVQFSDGHSIQVEPHSFNIGNGDGPTNPDPSEPDLKNPYERIQAEAYDSMSGIRTEGTDDDGGGDNIGWINDGDWVKYERVHFERGASSIEVRVASDTPGGRIEIRTGSPTGTLLGAVQVPNTGGWQEWQTVTGNVQIQPGTYDVYLVFKGSHEYDLMNVNWFVFRANGQGNGDSHTHPDYTAGIRGITGNEVTIFFAPTTEARYVDVHLKVNNGQQLNYRMTERNGEWERVVENLSSGDVLEYSFTYEKLGPQYTTEWFTYTR

SEQ ID NO: 298 - protein, 886 aa, Alkalihalobacillus clausii
MKKRWSAVVLGMLLMAPIEQISAHSVVEEVGKGSYSLEYPPIDFDSIADPGYAEQQQEPPEHIYRTENVNGPMPTNRWWSSLAVDRFSNNHYPHPFSVKHQENGLNVFYDAPHNVVVHENAEAGTWHITGAISTDFTIGHSTTESFADAKVDDFSDWYVSGLLQDGDAMLRLTYGVGSPYIFAEYEGGHAEIDFPIEPQIWANQGNVIGFSTHDNKHYAVYAPDGFDWQLQGNKWGNAASFISVAKLPEATDELLHTFEEYAFSVVRDSRAEYSVDHDTGEVRTVYSVETEAKVAGAKEGTIFALYPHQSRHLTAASEAQLLEETIFTIRGDMKLLPGNEFETTLQYTGVLPSLPNVGTDTDRLHGYLQEAQADYPTGQDTYELGKYLGKLANLAPIADQVGDEALADSFRDELRAQLEDWLVATDEDGRLKSENLFYYNENWGTLLGYHAAHGSAVRINDHHFHYGYFVKAAAEIARVHPEWANDEDWGAMIDLLIRDFAAGRDDDMFPYLRMFDPYSGHSWADGLATFDSGNNQESSSEAMHAWTNLILWAEATNDSELLDRAIYLYTTEMSAINEYFFDVYDEIHPEAYKPEIVTINWGGKMDHATWWHSGMVEKYAINWLPLHGGALYLGHHPDYVERAYQELYTRNGSTDWNLWANMVWAYRALTNPSDAVSQMNAKIDDYGEFNPGDERIMERGSTKAQTYQWVTSLHALGQVDPTVQADTPTYAVFTKNGERIYVAYNYRDAPTTVTFTDGHTAQVEANSFYTNATDVVPPIEQPNPGPDPEPNEPGNGDQHEHDHYSVTVKQDHNETVIAFSPTVPARYVDFHYRLNGGDQQNVRMNEGNGQWHYSIQGVSGGDELTYRFTYERKGPQYETEWYTFRP

SEQ ID NO: 299 - protein, 753 aa, Streptomyces triticirhizae
MRPLTHPRRVILGLTAVATVAAGLTLVPGSATAAEIPVGSGSYSDTRPDGTVGPLDSDGNPVLPQVTDNVADQPVPTNDWWSSLVFKRYADIPHSQPMYGHPLSYQAVANGLEVGYQTQAAVDGAAYNFPHVADLTLGLAGLNSPDTKADGWSDWTVTPYWEDDAHTFRATIGHGSPFVYAEGTGGDAEITTGAAPEVFADEGSTLGVTVNGRDYALFAPGGSAWTVSGDTISSDLGGNGYYSVAVLPDQSALDLYAQYAYSFVTGSTVDWSYDESAGQVSATYTLQTEAREGEETGTIQALYPHQWQHTTDELTDYEYVSPRGTMRVRDGASFTTTQSVVGVLPTLPESGGPDQAQLASFVNEVAADATVGFGDTYWSGKQFGRLAQVVGIADQIGETAARDTILDAMKAGFEEWFTAGGAAQFAYDSDWRTLTGYPASYGSDQELNDHHFHYSYFVYGAAVIAQYDPEWAAESAWGGMVEELIADAANPARDDDRYPFLRGFDVYAGHSWASGHQGFAAGNNQESSSESVNLSAGLILWGSATGDTELRDLGVYLLTTESEAIRQYWFDGNEENFPADYQHNTLGMVWSNGGAHATWWTGNPEEIHGINILPVTGGSLHLAQDQDAIVRNLEELVEENGGPPVEWKEILWEFQALADPAAARAAYDGDGGGSYEPEAGESWAHVYHWIYTLDAVGAPDTSVTADSPTAAAFSNGSSTTYTAHNYGDSEQTVTFSDGATLTVPPNSSATQTG

SEQ ID NO: 300 - protein, 1658 aa, Clostridium carnis
MCSKKIMNLKKTISPIISFCIVTGMIQGLNIDKVMADDVSPYVLSLNRTVYSSSDNGGSTSDKLVDDDYTTRWESEWGKDNQWIYVDLGASAQITGVNIKWENAYATEYEIEVSDDEENWSSIYTQKNGKGGEEKISLNGKGRYVRLNLNKRLFEGYGYSIYEFEVYGTGGVNEPPVKLGENIALNKTAISSSVHEDWYIKPGQVDADKAIDGDNNTHWGSSLQDNQWIFVDLGSIHTIGRVILNWDSSARSYDIEVSDDAEEWKTVYRELNSRGGKENIQLYASGRYVRMKGINRATTYEFGLKEFEIYDYVENDPKPVYEIPEKAEQVITNVGSGSYVTDMSLFTQPKEPYSKTSSIETPIPSNDWWQSLLISDLGNAVTTLPLKSKYQKQGLGLLTPSAGWVKDRTNQTEKNIDFYLMANNIDTAKMESKISGYGDYSATAVLSDNDTEKMKSTFVKGSPYIYSEFSDPNSVEIYSTAIDKIFDENGNTILGKSGDEISTDHIGIEIENTTEDPDKETITRYYGVFAPEGTVFKRVGNKIKIQLGNGEKYLSIATMPSDTDLSYFYDNAYAFVTDTKVDYDYDELTSNVTTKFEQKVDLKRKDFADTTLMCMLPSQWKKSDKETSDLSYPSVRGTLKVTEGNSFTTVDKFNGILPQFIEPLNSEYSRNTLMTYLEELDKSTSSNYMSGDAYWQGKALHPLAMGALVADQINAVEYKEKFLSKLKEILVEWYSYKPGEEEGYYFNYNPEWGTLIYKNSEFGANTGITDHHFTYGYFTFASAVLATYDSEFLNDYGSMVDLLIRDYANPSKNDSKFPQFRSFDPYEGHSWAGGYADNDDGNNQEAAGESLFGWVGEYLWGIVSDNEEYRDAGIYGFTTELNAVKQYWFNYDGDNWLPEYDHKTVGQIYGATNFYGTFFNGDSVYVYGIHWLPTGEYLTNYGIEKDKVAELYDGMRQDIIKDYHNSSDPNKGEEPDPNDVENAWKHITWPIESLSDPESVINKWDTSELQKNEMYNTYWFVNNMAALGQRTDEVWAEGGVSASVYKKDDIYTAMIWNPSDDPMTVKFRNNDGELGYTTVAPKKLVAVNPLIEGAVSKSALQAEINAAKEKVQSDYTEDSWEDFSSLLDSAVNVNNDENATTSQVDEALKNLLNAIKDLENINDIPSSDTNIALNKSVVSSSNEADGLSGKYITDGDLNSRWGSDWNNNTDNHPEYVYIDLGESYYLGSMKIKWSDAYAKNYEIQVCDENPEDENSWRKVSDIDEGNGGEEDIEFNDVNARYVRIYCKEMGLAPYGYSIKDIEIYLAVDKKELVNIIEKANELNKNDYTEESWNKFSNALELAIQINENVDAKQYQVDSIVKKLEKTMNQLVKNDGESNPDVTDESLALNKKVISSSNEADGLSGKYITDGDLNSRWGSDWINNTDNSPEYVYVDLEDVYDINKVKIYWDNAFAKNYEIQVCNENPEDENSWIKVLDIDDGNGGEDDIEFNDVNARYVRIYCKEMGLAPFGYSIKDIEIYSDADKKELDKKELVNIIEKANELNKSDYTEDSWNKFSDALESAIQINENVDAKQYEVDSIVEELEKIMNQLVNNNEESNPDVTDENLSLDQEVISSSDEADGLSGEYIRDEDLDSRLSSDWINNMDNNQDHVYVDVEDV

SEQ ID NO: 301 - protein, 1393 aa, Paenibacillus albicereus
MNRMRSSLRHGRRLAVWTVALALLLPLLAPAARPVPALAAAGADLLTSNRLAYASSVRGGNGPQLAFDGDPSTRWESRLGQDPQWLYVDLGAQATLSRAVIRWEGAYAKSFRIETSSDESAWTPVYATSSGTGGTTDVALSGTGRYVRLVAVQRALPAYGVSLYEFELYGTGGSGPAPQPAPANAALGRPAVSSSDASGYAAAAATDGSLSTRWASASSDPQWIYVDLGQSQRIGKVVLNWETAFGRVYDLQVSEDARSWTTVYRQRYGAGGKDTVPLYASGRYVRMLGIGRGTNYGYSLHEFQVFPYRSGDPQPAYAIAPLPQPSTVPVGSGSYEVGDVTQLEPLYPKNRTGGLNAPIPSNDWWQNLLVQRLGAGTGIVTLPLKAKYSANGLGLLAPGAGTINGDGGAVNADGDPDLYLTAGNLSDPGAIDTKVDGYGDFSVRVVLSDDAAPKMRSVLVKGSPYVYSTFSDPNAPELFVPGLSRAFDDAGQPLLAAEGSSVTADHIGLEIATLDNAVQPKAVLRSYGVFAPPGTVFTRTGGKIKIKLGGGATYLSVAGLPGSGDLGYFYRHAYAFVTDTKVTYGYDMSQAKVSATFASVTELKRSGFSADTLMALLPHQWKSSQTPLTALTYPSIRGTLKLREGNSFSTSDSFTGLLPQFAEPNDAAYSRSELTGYLSQLDTELSNTGGLMNQDPYWQGKVLYPAALGAMVSDSIGDTARRDRYLGVLRTILTDWYTYSASDAPHTYYLHYAPEWGSIFPWAAGWGINTGLTDHHYTYGYYVYASAVLASFDSAFKRDYAGMVEHLIRDYANPSRTDTMYPWLRSFDPYEGHSWAGAYADNDNGNNQEAAGEALNGWAGLFLWGLVTGNDSYRDTGAWGFATELKAIEQYWFNYDRDNWIPEYRHGVAGQVWGSSYLYGTYFSGAPVNIYGIHWLPTGEWMSYYGRDRQEAADLYAAFLRDNGGPESGWEHIVWPYQSLSDPQAAIAKWNPSILQKNEIFNSYWFIHNAASYGNRTTDVWASNWGGVGVYKKGSAYTAMVWNPTGQPITVQFRSASGPTGSVTVPAGKLVKADPLSTGGATPSPTPTPSPSASPTPSPSATPAPTATPTPGAALDRTGWTASSSPSSGDPASNLLDGSMATRWSTGAAMAPGQSITIDMKASKTFGKLVMDSTGSDGDYARGYEVYVSADGASWGSPVATGTGSGPVVTATFAAKTARYVKIVQTGTASSWWSIRELNVYGTAGGGTPSPTPTPSATPSPGAALSRAGWTASSDPTSGDVAANLLDGSMATRWSTGAAMAPGQSITIDMKASKTFGKLVMDSTGSDGDYARGYEVYVSADGASWGSPAATGTGSDPVVTATFASKTARYVKIVQTGTASSWWSIRELNVYGS

SEQ ID NO: 302 - protein, 355 aa, Alkalihalobacillus clausii
MDQQLQMLKALTDANGVSGFEKEARDVMKSYIAPFADSVETDHLGSLIAKKTGNADGPKIMVAGHLDEIGFMVKSIDEKGFVRFQTIGGWWGQVLLASRVTVITDNGPIPGVIGSQPPHVLSPEARKKPVEIEDMFIDIGATSKEEALEFGVKPGNPIAPVCEFTVMKNEKLLMAKAWDNRIGCAIAIDVLKSLHDVEHPNVVYGVGTIQEEVGLRGAKTSAHAIQPDIGFAIDVGVGADTPNTKGEGTLGAGPQIILYDASMIGHKNLRDFVVKTAEENNIPFQYDTIPGGGTDAGAIHLTANGVPALSITIATRYIHTHAGLLHRDDYNNTVKLLVELVKRLDGETVKNITFA

SEQ ID NO: 303 - protein, 412 aa, Bifidobacterium ruminantium
MVLGIDERIDGVNLGNWLVLEKWMDPEPFVRTAEDDEIWMHRTHGALWSERNLAEGLRRHRDTYITLEDFRIIADHGLNLVRIPVPYFIFGDWPGHPGCVAYLDRAFRWARETGLKIMLDLHTVPGSQNGFDNGGLTGVCKWAQNPDLVEYALGVLERLAHRYRDEPALHSIEVLNEPVSWSVFHGSTNTAKNPREASGSTHIPLRFLKRFYRDAYIRLRAVLRPETVIVFHDGFRLLRWGDWFRRAGMRNVMLDTHQYLIAMEEPLFAGPASRLYLQSRHLPWLYRMLVGARGIAIRSAARHIPVLVGEWCVENRWAPRSQNRADAYRQVSRLQRAAWNASAGQIYWSYQLARSAKPGSGEGKPPRDPRNGGNLEAWDLTRVWRHGWMRSDTPHDDMSSAPSINGNRSKGH

SEQ ID NO: 304 - protein, 1388 aa, Clostridium neonatale
MKKRNKKILTLILATSILGSLLAESSIVTKAKEFDKKNNTELEVKNNLMDFNDETTDEAVDVIIPEEVDNTTDEAVNIDMLEIQENGQFEDIAMGKPATSSSGQNSAALAVDGNSGSRWESETKDPQWICIDLGGNFKIKKVKLKWEGAGAEVYNIQLSKDGNKWGNIAEVTDGKGGETRELDCDETVTGRYIRMYGTKRVTTYGYSIFDFEVYGRESGFKSISGKSESVKLKWYAEDSAKGYNIYRLSDPDSGFEKINKEPITGIEYTDTDELDIKKYYYRLKSIDENNDESEVLDYTSITIVEDLDLGDKVKIFDPSMPKEEIQNTVDEVFNEMETEQFGTGRYALLFKPGKYNTNVNVGFYTSVMGLGKTPDDVDITGAVRCEADWFPEQPGNATQNFWRTVENISVTPKYKSNNTTNEEGDLTWAVSQAAPMRRTHIKGNVSLWDPYENDYDLAWASGGFIADSKVDGKIGSASQQQFFTRNVDMDSWNGSNWNMVFVGDKGAPKVDDDKYVSGEAAYTAVDKTPIIREKPFLYIDDDGKYKVFVPDVRKNAQGVSWENGLGDGKSLSVTDTFYIAKPEKDTADTLNEALNEGKNILFTPGIYYLNKELHITRPDTIIFGMGLATLNPNNRNAAIVVDDVDGVNISGLLFNAAQGESPYLLKVGEEGSHKDHSENPILLADLFFRVGGDGEEGARAKSCIVINSDDVIGDHFWVWRADHGDGVGWELNRCDNGLVVNGNNVTIYGLFVEHFNEYQTLWNGENGKVYFYQTEFPYDVPNQEAWMSNDGTVNGYASYKVGDTVKNHELYGAGLYTYFTDADVVVNSPVEIPNTPNVKVKHACSVFLNAYGGATHVVNNTGGAVNSSNMRSAIDFYCNKVGDPAIKPSGGVFSSEQSISIDCAVEGAQIRYTTDGRKPTEKVGTIYTGPFTVDSTTTIKAIAYKEGMESSDISTSTITIKPGLADNIALGKPAKASSGNAALAFDGDANTRWASNWESDEYISVDLGTAYTISEINLLWESAYATKYKIQISNDGVNWTNAYFKNTPNYVNITDSVIDIFNKNTTGGSESISFLKPISARYIKMQGVQPITEYGYSIYEFEVHGEKYKIDETNLRSLYEQHKNKVQGKYTNITWKLFTSALDSAKDILDKDKKSQEEIDTAYNNLLNAINGLKEANNSNSGSSGGSSGGGNSSGGSSSGGGSSSNSNNEEVIDKNDNSEKETGWIKDENNGKWHYLDVNSGEKKTGWFKDSNNRWYHLGTSGAMTTGWFKDSNNKWYHLGTSGAMTTGWFKDSNNKWYHLGTSGAMTIGWFKDSNNKWYHLGTSGAMTIGWFKDSDNKWYHLGASGAMTIGWLKDTDGKWYYLNSDGSMAYDTYIDGYYVNSNGVYK

SEQ ID NO: 305 - protein, 368 aa, Pseudomonas fluvialis
MGNAAIKLRGVNLGSWLVLEKWMVPSLFEGLGATDETTWCVELGPAAAERLRAHWQRWITREDFAWLAERGINAVRIPVGHWIFGPDYPYHPSYGEARHPFVEGGIAVLDNAMSWAQEFGLQVVLDLHAAPGCQNGFDNGGIKDVCEWHTRPEYLEHSLTVLERLAERYGRHPALHAVEALNEPRWDVPTDYLKAYYLQAYERIRRHAPAEQVAVVFHDGFRDFREYLGFMQAPAFSNVLFDIHRYQCFERGDIDMDIYGHMRKAAGEWKTEADAIITELGLPTFCGEWSLGLDLKVVSLWAQGPFNHALERMDDFQQNVAYRGYAAAQLATFEKYQGWFFWNYRTETTPAWCFRECVERGWLPSSFA

SEQ ID NO: 306 - protein, 388 aa, Clostridioides difficile
MYIKGVNLGGWLVLEKWMTSSLFEGTEAEDEYYLPRQLSREAYESRIKTHRSEYITERDFATIKSMGFNSVRIPVPYFIFGDCEPFIGCVKELDKAFAWADKYGLSILIDLHTVPGSQNGFDNGGISGICSWSQNPEYVAFTLNVLERLAKRYGMRHELYGIQILNEPITERMWNIMNVPNRFKAVDKEMARGSKPNSLEFLRDFYIKAYRVMRPYMREENVIVFHDAFELKAWKDFMREEEFKNVVLDTHQYLMLAEADGCEQSIDSYLKYIRENYAKDILQMQKYFPVICGEWSLFNSYACGIDTNGGQSPLNGIESNIDKLSKDDKRELYRKIAKAQLDAWRNGSGHYYWNYKLLLDTVNEEGWIGWDSWDLGKCVAQEWYPIEY

SEQ ID NO: 307 - protein, 565 aa, Pseudomonas sp.
MTIKYSHPKTLLSAALCASAILCSHASLAARFQAEDYTAFADTSAGNTGGAYRSDDVDIEATSDEGGGYNVGWVETGEWLTYASLNIPANGRYVVRARVASDTGGAMSVDLNAGSILLGELAIPATGGWQSWQTVEREVDLSAGTYNLGVYASTGGWNFNWIEVEPVGNTGGGGSSVTFEAEDYDNASDTTPGNTGGAYRSGDVDIEATSDQGGGYNVGWTESGEWLAYNDFNVPTAGNYRFEVRVASGSGGVLSLDLNGGSTSLGEVAIPVTGGWQTWQTVTLDAYVPAGNHSLGVYATTGGWNLNWIKATPTGGGGNPNPNPTVTWSDEFDSIDLNTWNFETGGNGWGNNELQYYTNGNNASIQYDPQAGSNVLVLEARQETGGACWFGGNCGYTSTRMNTRNKKSFKYGRMEARLKLPKAQGIWPAFWMLGDNFNTQGWPQGGELDIMEHVGTNNITSGALHGPGYSGNTPITGHLDHATPIEQSYKTYAVEWDANGIRWYVDDINFYSVSRAQVEQYGQWVYDQPFWFLLNVAVGGNWPGDPDHANFSTQRMYVDYVRVYQ

SEQ ID NO: 308 - protein, 1895 aa, Saccharomyces cerevisiae
MSYNDPNLNGQYYSNGDGTGDGNYPTYQVTQDQSAYDEYGQPIYTQNQLDDGYYDPNEQYVDGTQFPQGQDPSQDQGPYNNDASYYNQPPNMMNPSSQDGENFSDFSSYGPPSGTYPNDQYTPSQMSYPDQDGSSGASTPYGNGVVNGNGQYYDPNAIEMALPNDPYPAWTADPQSPLPIEQIEDIFIDLTNKFGFQRDSMRNMFDHFMTLLDSRSSRMSPEQALLSLHADYIGGDTANYKKWYFAAQLDMDDEIGFRNMKLGKLSRKARKAKKKNKKAMQEASPEDTEETLNQIEGDNSLEAADFRWKSKMNQLSPFEMVRQIALFLLCWGEANQVRFTPECLCFIYKCASDYLDSAQCQQRPDPLPEGDFLNRVITPLYRFIRSQVYEIVDGRYVKSEKDHNKVIGYDDVNQLFWYPEGIAKIVMEDGTRLIDLPAEERYLKLGEIPWDDVFFKTYKETRSWLHLVTNFNRIWIMHISVYWMYCAYNAPTFYTHNYQQLVDNQPLAAYKWATAALGGTVASLIQVAATLCEWSFVPRKWAGAQHLSRRFWFLCVIMGINLGPVIFVFAYDKDTVYSTAAHVVGAVMFFVAVATLVFFSVMPLGGLFTSYMKKSTRSYVASQTFTASFAPLHGLDRWMSYLVWVTVFAAKYAESYFFLILSLRDPIRILSTTSMRCTGEYWWGNKICKVQPKIVLGLMIATDFILFFLDTYLWYIVVNTVFSVGKSFYLGISILTPWRNIFTRLPKRIYSKILATTDMEIKYKPKVLISQIWNAIIISMYREHLLAIDHVQKLLYHQVPSEIEGKRTLRAPTFFVSQDDNNFETEFFPRDSEAERRISFFAQSLSTPIPEPLPVDNMPTFTVLTPHYAERILLSLREIIREDDQFSRVTLLEYLKQLHPVEWDCFVKDTKILAEETAAYENNEDEPEKEDALKSQIDDLPFYCIGFKSAAPEYTLRTRIWASLRSQTLYRTISGFMNYSRAIKLLYRVENPEIVQMFGGNADGLERELEKMARRKFKFLVSMQRLAKFKPHELENAEFLLRAYPDLQIAYLDEEPPLNEGEEPRIYSALIDGHCEILENGRRRPKFRVQLSGNPILGDGKSDNQNHALIFYRGEYIQLIDANQDNYLEECLKIRSVLAEFEELGIEQIHPYTPGLKYEDQSTNHPVAIVGAREYIFSENSGVLGDVAAGKEQTFGTLFARTLAQIGGKLHYGHPDFINATFMTTRGGVSKAQKGLHLNEDIYAGMNAVLRGGRIKHCEYYQCGKGRDLGFGTILNFTTKIGAGMGEQMLSREYYYLGTQLPIDRFLTFYYAHPGFHLNNLFIQLSLQMFMLTLVNLHALAHESILCVYDRDKPITDVLYPIGCYNFHPAIDWVRRYTLSIFIVFWIAFVPIVVQELIERGLWKATQRFFRHILSLSPMFEVFAGQIYSSALLSDIAVGGARYISTGRGFATSRIPFSILYSRFAGSAIYMGSRSMLMLLFGTVAHWQAPLLWFWASLSALIFAPFIFNPHQFAWEDFFLDYRDYIRWLSRGNNKYHRNSWIGYVRMSRSRVTGFKRKLVGDESEKSAGDASRAHRTNLIMAEIIPCAIYAAGCFIAFTFINAQTGVKTTDEDRVNSTLRIIICTLAPIVIDIGVLFFCMGLSCCSGPLLGMCCKKTGSVMAGIAHGIAVVVHIVFFIVMWVLEGFSFVRMLIGVVTCIQCQRLIFHCMTVLLLTREFKNDHANTAFWTGKWYSTGLGYMAWTQPTRELTAKVIELSEFAADFVLGHVILIFQLPVICIPKIDKFHSIMLFWLKPSRQIRPPIYSLKQARLRKRMVRRYCSLYFLVLIIFAGCIVGPAVASAHVPKDLGSGLTGTFHNLVQPRNVSNNDTGSQMSTYKSHYYTHTPSLKTWSTIK

SEQ ID NO: 309 - protein, 1894 aa, Candida glabrata
MANWQNTDPNGNYYYNGAENNEFYDQDYASQQPEQQQGGEGYYDEYGQPNYNYMNDPQQGQMPQQQPGGYENDGYYDSYYNNQMNAGVGNGLGPDQTNFSDFSSYGPPPFQNNQANYTPSQLSYSNNGMGSNGMNMSGSSTPVYGNYDPNAIAMTLPNDPYPAWTADPQSPVSIEQIEDVFIDLTNKFGFQRDSMRNIFDLFMTLLDSRTSRMSPDQALLSVHADYIGGDTANYKKWYFAAQLDMDDEVGFRNMNLGKLSRKARKAKKKNKKAMEEANPEDAAEVLNKIEGDNSLEASDFRWKTKMNMLTPIERVRQVALYMLIWGEANQVRFTSECLCFIYKCASDYLESPLCQQRTEPIPEGDYLNRVITPIYQFIRNQVYEIVDGPFMSKREKEKDHNKIIGYDDVNQLFWYPEGITKIVLEDGTKLTDIPSEERYLRLGEVAWNDVFFKTYKETRTWLHLVTNFNRIWIMHVSVYWMYVAYNSPTFYTHNYQQLVNNQPVPAYRWASAALAGTVASAIQLFATVCEWWFVPRKWAGAQHLSRRFWFLCGILGVNLGPLIFVFAYEKDTVQSKAGHAVAAVTFFIAVATVLFFSIMPLGGLFTSYMQKSSRRYVASQTFTASFAPLQGLDRWLSYLVWVTVFAAKYSESYFFLILSLRDPIRILSTTTMRCTGEYWWGSKLCRHQSKIVLGFMIATDFILFFLDTYLWYIVVNTVFSVGKSFYLGISILTPWRNIFTRLPKRIYSKILATTDMEIKYKPKVLISQIWNAIIISMYREHLLAIDHVQKLLYHQVPSEIEGKRTLRAPTFFVSQDDNNFETEFFPRNSEAERRISFFAQSLATPMPEPLPVDNMPTFTVLTPHYSERILLSLREIIREDDQFSRVTLLEYLKQLHPVEWECFVKDTKILAEETAAYENEEPQDPEKSDALKTQIDDLPFYCIGFKSAAPEYTLRTRIWASLRSQTLYRTVSGFMNYARAIKLLYRVENPEIVQMFGGNAEGLERELEKMARRKFKFLVSMQRLAKFKPHELENTEFLLRAYPDLQIAYLDEEPPLNEGEEPRIYSALIDGHCEMLENGRRRPKFRVQLSGNPILGDGKSDNQNHALIFYRGEYIQLIDANQDNYLEECLKIRSVLAEFEELNAEPVYPYTPGVKYEDQKTNHPVAIVGAREYIFSENSGVLGDVAAGKEQTFGTLFARTLAQIGGKLHYGHPDFINATFMTTRSGLSKAQKGLHLNEDIYAGMNALLRGGRIKHCEYYQCGKGRDLGFGTILNFTTKIGAGMGEQMLSREYYYLGTQLPVDRFLTFYYAHPGFHLNNLFIQLSLQMFMLTLVNLHALAHESILCIYDRNKPKTDVLYPIGCYNFSPAIDWIRRYTLSIFIVFWIAFVPIVVQELIERGLWKATQRFFRHILSLSPMFEVFAGQIYSAALLSDMTVGGARYISTGRGFATSRIPFSILYSRFASSAIYMGARSMLMLLFGTVAHWQAPLLWFWASLSALLFSPFIFNPHQFSWEDFFLDYRDYIRWLSRGNNKYHKNSWIGYVRMARSRITGFKRKLIGDDSEKAAGDANRAHRTNLILAELIPTAINAGSCFIGFTFINAQTGVKATDDDRVNSVLRVVLCTLGPIAVDVGVLFFCLGMSCCSGPLFGMCCKKTGAVMAAVAHGVSVVIHIGFFIVMWVLEGFNFTRMLVGVATVIQCQRFIFQLMTILLLTREFKNDHANTAFWTGKWYGSGFGYMAWTQPMRELTAKVIEMSEFAADFVLGHVILFAQFPVLCIPAIDKFHSIMLFWLKPSRHIRPPIYSLKQSRLRKRMVKRYLTLYIIIFLVFAGAIVGPAVARLAHVPQDIGHTLTGPFHNIVQPRNKSNNDTGLQISTYSNHYYTHTPSLKTWSTIK

SEQ ID NO: 310 - protein, 1905 aa, Aspergillus nidulans
MSGYPQGSGYQHGNYDDGYDHQGHGDAYYQDDHHAQAGYYDNQDYGDGYYDRGGYGDHGYQHDGYYDAGHHDDYYGDQYYAQGGQGRGRHGRDSEEESETFSDFTMRSETARAADMDYYGRGDERYNSYTDSQYGHGGYGYRPPSSQVSYGGNRSSGASTPVYGMDYGNGLPAGQRSREPYPAWASDGQVPVSKEEIEDIFIDLVNKFGFQRDSMRNMYDHLMTQLDSRASRMTPNQALLSLHADYIGGDNANYRRWYFAAHLDLDDAVGFANMKLGKADRKTRKARKAAKKKAQENPEDVEGTLEALEGDNSLEAAEYRWKTRMNRMSQHERVRQLALYLLCWGEANQVRFLPEALCFIFKCADDFYNSPECQNRVEPVEEFTYLNEIITPLYQYCRDQGYEILDGKYVRRERDHNQIIGYDDMNQLFWYPEGIERIVLEDKTRLVDIPTAERWTKLKEVNWKKVFFKTYKETRSWFHLVTNFNRIWVIHLGAFWFFTAYNAPTIYTKNYRQQLNNKPPGAYYWSAVGFGGALVSFIQIMATIFEWMYVPRRWAGAQHLTKRLLFLLLVFVINLAPGVVVFGFSSVLPGKVPLVVGIVHFFIALATFFFFSIMPLGGLFGSYLKKHGRQYVASQTFTASFPRLKGNDMWMSYGLWVCVFGAKLAESYFFLTLSIKDPIRYLSPYHVHQCAGVKYIGDKICYYQPQILLGLMFFMDLTLFFLDSYLWYIICNTIFSVARSFYLGVSIWSPWRNIFSRLPKRIYSKVLATTDMEIKYKPKVLISQVWNAIIISMYREHLLAIDHVQKLLYHQVPSEQEGKRTLRAPTFFVSQEDQSFKTEFFPRGSEAERRISFFAQSLSTPMPEPLPVDNMPTFTVLIPHYSEKILLSLREIIREDEPYSRVTLLEYLKQLHPHEWDCFVKDTKILADETSQFNGDYEKNEKDAAKSKIDDLPFYCIGFKSAAPEYTLRTRIWSSLRSQTLYRTVSGMMNYSRAIKLLYRVENPEVVQMFGGNSEKLEHELERMARRKFKICVSMQRYAKFTKEERENTEFLLRAYPDLQIAYLDEEPPANEGEEPRLYSALIDGHCELLENGMRKPKFRIQLSGNPILGDGKSDNQNHSIIFYRGEYIQVIDANQDNYLEECLKIRSVLAEFEELTTDNVSPYTPGVASSSEAPVAILGAREYIFSENIGVLGDVAAGKEQTFGTLFARTLAQIGGKLHYGHPDFLNGIFMTTRGGISKAQKGLHLNEDIYAGMNAMVRGGRIKHCEYFQCGKGRDLGFGSILNFTTKIGTGMGEQMLSREYYYLGTQLPLDRFLSFYYAHPGFHINNMFIMLSVQMFMIVLINLGALKHETINCNYNSDLPITDPLMPTFCAPLTPIINWVNRCVISIFIVFFISFVPLAVQELTERGLWRMATRLAKHFGSFSFMFEVFVCQIYSNAVHQNLSFGGARYIATGRGFATARIPFGVLYSRFAGPSIYTGFRLLIMLLFSTSTTWTASLIWFWVSLLALCISPFLFNPHQFAWNDFFIDYRDYIRWLSRGNSRSHASSWIGFCRLSRTRITGYKRKLLGVPSEKGSGDVPRARITNIFFSEIVAPLVLVAVTLVPYLYINSRTGVSADVDGGNDPHDAILRIAIVAFGPIGINAGVAAVFFGMACCMGPILSMCCKKFGAVLAAIAHAIAVIILLVIFEVMFFLEHWSWPRCVMGMIAMAAIQRFVYKLIIALALTREFKHDQSNIAWWTGKWYNMGWHSLSQPGREFLCKITELGYFSADFVIGHLLLFIMLPALCVPYIDKFHSVILFWLRPSRQIRPPIYSLKQSKLRKRRVVRFAILYFAMLILFLVLLIAPLIARNQDLNLKMSGILLELMQPLDSNNNDTMTSYTGSGVPKGMEPIASPSSYLTNLNN

SEQ ID NO: 311 - protein, 1903 aa, Aspergillus fumigatus
MSGYQQGGGHYNDGYGHQEHGDSFYQDEHGQAYYDHDYGDGYYDRSGYYGPDGNHNQQEGGYYDAGQPHDDYYGDHYYDQGNGQQGYDNRGRRRGDSEEDSETFSDFTMRSETARAADMDYYGRGDERYNSYADSQYGGRGYGYRPPSSQISYGANRSSGASTPVYGMDYGNALPAGQRSREPYPAWASDGQVPVSKEEIEDIFLDLVNKFGFQRDSMRNMYDHLMTMLDSRASRMTPNQALLSLHADYIGGDNANYRRWYFAAHLDLDDAVGFANMKLGKADRKTRKARKAAKKAAQQNPENVEETLEALEGDNSLEAAEYRWKTRMNKMSQHDRVRQLALFLLCWGEANQVRFLPECLCFIFKCADDYYNSPECQNRVEPVEEFTYLNEIITPLYQYCRDQGYEIVDGKYVRRERDHNQIIVSDMNQLFWYPEGIERIALEDKTRLVDIPPAERWTKLKDVVWKKAFFKTYKETRSWFHMITNFNRIWVIHLGAFWFFTAFNAQSLYTDNYQQQVNNKPPGYRIWSAVGFGGALSSFIQIAATICEWMYVPRRWAGAQHLTKRLMFLILVFVINLAPGVFVFAYSKSMGISKTIPLIVGIVHFFVALATFVFFSVMPLGGLFGSYLKKHGRQYVASQTFTASFPRLHGNDMWMSYGLWVCVFGAKLAESYFFLTLSFKDPIRILSPMQIHQCAGVKYIGNVLCHKQPQILLGLMFFMDLTLFFLDSYLWYIICNTVFSVARSFYLGVSIWSPWRNIFSRLPKRIYSKVLATTDMEIKYKPKVLISQVWNAIIISMYREHLLAIDHVQKLLYHQVPSEQEGKRTLRAPTFFVSQEDQSFKTEFFPPGSEAERRISFFAQSLSTPMPEPLPVDNMPTFTVLIPHYSEKILLSLREIIREDEPYSRVTLLEYLKQLHPHEWDCFVKDTKILADETSQFNGEPEKSEKDVAKSKIDDLPFYCIGFKSAAPEYTLRTRIWSSLRSQTLYRTVSGFMNYSRAIKLLYRVENPEVVQMFGGNSEKLERELERMARRKFKIVVSMQRYAKFNKEERENTEFLLRAYPDLQIAYLDEEPPVNEGEEPRLYSALIDGHCELLENGMRKPKFRIQLSGNPILGDGKSDNQNHSIIFYRGEYIQVIDANQDNYLEECLKIRSVLAEFEELTTDNVSPYTPGIPSTNTNPVAILGAREYIFSENIGVLGDVAAGKEQTFGTLFARTLAQIGGKLHYGHPDFLNGIFMTTRGGISKAQKGLHLNEDIYAGMNAMIRGGRIKHCEYYQCGKGRDLGFGSILNFTTKIGTGMGEQMLSREYYYLGTQLPLDRFLSFYYAHPGFHINNMFIMLSVQMFMIVLINLGALKHETITCRYNPDLPITDPLRPTYCANLTPIVDWVNRCIISIFIVFFISFVPLAVQELTERGVWRMAMRLAKHFGSVSFMFEVFVCQIYANAVHQNLSFGGARYIGTGRGFATARIPFGVLYSRFAGPSIYAGARSLLMLLFATSTVWTAALIWFWVSLLALCISPFLFNPHQFAWNDFFIDYRDYLRWLSRGNSRSHASSWIGFCRLSRTRITGYKRKLLGVPSEKGSGDVPRARLTNIFFSEIIAPLVLVAVTLVPYLYINSRTGVRDNPETTDAILRLAIVAAGPIAINAGVAGVFFGMACCMGPIFSMCCKKFGAVLAAIAHAIAVIVLLAIFEVMFFLESWSWPRMLIGMIAAAAIQRFIYKLIIALALTREFKHDQSNIAWWTGKWYNMGWHSMSQPGREFLCKITELGYFSADFVLGHVLLFAMLPALCVPFIDKFHSVMLFWLRPSRQIRPPIYSLKQSKLRKRRVIRFAILYFGMLILFLVLLIAPLVVRSMGLVKTPNLPFNLLQPLDKDNNDTMVTYTGNNIPAGFEPVESASSVATATS

SEQ ID NO: 312 - protein, 220 aa, Neurospora crassa
ALIDGHCEILDNGRRRPKFRVQLSGNPILGDGKSDNQNHALIFYRGEYIQLIDANQDNYLEECLKIRSVLAEFEELNVEQVNPYAPGLRYEEQTTNHPVAIVGAREYIFSENSGVLGDVAAGKEQTFGTLFARTLSQIGGKLHYGHPDFINATFMTTRGGVSKAQKGLHLNEDIYAGMNAMLRGGRIKHCEYYQCGKGRDLGFGTILNFTTKIGIGMGEK

SEQ ID NO: 313 - protein, 1902 aa, Coccidioides posadasii
MSAYPQGAGGGGGGGGGGGGAQDPYDDYHQGHGDAYYQDQGYYDQADYSQHGDGYYDRNGYDPNNPYQQDGYYDNQYGYQDDYYNDQYYDQGSGPSNNWQGGYPRRGDSEEDSETFSDFTMRSETARAADMDYYGRGDDRYNSYSDSQMGGRGYRPPSSQISYGGNRSSGASTPIYGDYSNVLPPGQRSREPYPAWASDAQIPVSKEEIEDIFLDLVNKFGFQRDSMRNMYDHFMTQLDSRASRMTPNQALLSLHADYIGGDNANYRRWYFAAHLDLDDAVGFANMKLGKTNRRTRKARKAAKKAQSDPNNEEQALESMEGDNSLEAAEYRWKTRMNRMSQHERARQIALYLLCWGEANQVRFMPECLCFIFKCADDYLRSPECQNRVEPVPEFTYLNEIVTPLYQYCRDQGYEILDGKYVRRERDHNKIIGYDDINQLFWYPEGIERIILEDKTRLVDVPPAERYMKLKDVNWKKVFFKTYKETRSWFHMLVNFNRIWVMHVTGFWFYTAFNSKPLYTPNYEQRLDNQPKAAATWSAVGLGGAIASLIMIGATLAEWAYVPRQWAGAQHLTKRLLFLIVVFVINLGPSVYVFGIRQDDKIALVLGIVQFFIALATFIFFSVMPLGGLFGSYLTKNSRRYVASQTFTASFPRLRGNDMWMSYGLWVCVFTAKFVESYFFLTLSIKDPIRILSIMTIHRCAGDAILKDILCKYQPKILLGLMLFTDLVLFFLDTYLWYIILNTIFSVARSFYLGVSIWTPWRNIFSRLPKRIYSKVLATTDMEIKYKPKVLISQIWNAVVISMYREHLLAIDHVQKLLYHQVPSEQEGKRTLRAPTFFVSQEDHSFKTEFFPSQSEAERRISFFAQSLSTPIPEPVPVDNMPTFTVLIPHYSEKILLSLREIIREDEPYSRVTLLEYLKQLHPHEWDCFVKDTKILADETSQFNGEYEKSEKDAAKSKIDDLPFYCIGFKSAAPEYTLRTRIWASLRSQTLYRTISGFMNYSRAIKLLYRVENPEVVQMFGGNSEKLERELERMARRKFKICVSMQRYAKFSKEERENTEFLLRAYPDLQIAYLDEEPPVNEGEEPRLYSALIDGHSEIMENGLRRPKFRIQLSGNPILGDGKSDNQNHAIIFYRGEYVQLIDANQDNYLEECLKIRSVLAEFEEMTTDNVSPYTPGLPPTKTNPVAILGAREYIFSENIGILGDVAAGKEQTFGTLFARTMAQIGGKLHYGHPDFLNGIFMTTRGGVSKAQKGLHLNEDIYAGMNALLRGGRIKHCEYYQCGKGRDLGFGSILNFTTKIGTGMGEQMLSREYYYLGTQLPLDRFFSFFYAHPGFHINNLFIMLSVQMFMICLINLGALRHETIPCVYKKGVPITDPLKPTGCADINPVRDWVQRCIVSICIVFLISFVPLVVQELTERGCWRAATRLAKHFGSFSPLFEVFVCQIYANSLHNNLSFGGARYIGTGRGFATARIPFGVLYSRFAGPSIYLGARSLMMLLFATATVWAAWLLYFWASLLALCISPFLFNPHQFAWNDFFIDYRDYLRWLSRGNSRSHASSWIAFCRLSRTRITGYKRKVLGSPSEKLSADAPRAHLSNIFFSEIVGPLVLVAVTLIPYLFINAQTGVQDNPKPTNSLIRVGIVALAPIAINAGVLAALFGMACCMGPILSMCCKKFGSVLAAIAHGVAVIALLALFEVMFFLEGWSFPRALIGMIAATAIQRFVFKLIISLALTREFRQDSSNIAWWTGKWYNMGWHSISQPGREFLCKITELGLFAADFILGHVLLFFMLPALCIPFVDKFHSVILFWLRPSRQIRPPIYSLKQSKLRKRRVIRFAILYFLMLILFVILIAGPLIARRFITEFPDIPFDLLQPINQDNDDTTNEETGSGLPDMASATARMMLL

SEQ ID NO: 314 - protein, 1926 aa, Paracoccidioides brasiliensis
MSAHPQGGRNGYDDGYGHNPQADAYYQDGYYDQNDYSQHDGYYDNRGNGDNSYQPQDGYYDNNHQGYEDEYYNDQYYDQGAAGYQYGPQQGRRRGHDSEEDSETFSDFTMRSETARAADMDYYGRGDERYNSYNDSQMGGRGYRPPSSQISYSVNRSSGASTPVYGYDYGNALPAGQRTREPYPAWTSDSQIPLSKEEIEDIFLDLVNKFGSQRDSMRNMYDHFMTLLDSRASRMTPNQALLSLHADYIGGDNANYRRWYFAAHLDLDDAVGFANMNLGKASRKTRKARKAAKKAAGGGPQNEEQTLADLEGDNSLEAAEYRWKTRMNRMSQHERARQIALYLLCWGEANQVRFMPEALCFIFKCADDFYHSPECQNRVEPVQEFTYLNEIITPLYQYCRDQGYEIFDGKYVRRERDHNKIIGYDDINQLFWYPEGIERIVMNDKSRIVDIPPAERYQKLKDVNWKKVFFKTYKETRSWFHMMVNFNRVWVIHVGAFWFYTAFNSPTLYTRNYKQRENTQPTAAARWTASGLGGAVATFIMIFATICEWAYVPRAWTGAQHLTKRLIFLIGIFIINVGPAVYVFGVNQDNKIAHILGIVSFFFNLLTFFMFSIMPLGGLFGSYLTKNSRKYVASQTFTASYPRLHGNDMWMSYGLWVCVFGAKLAESYFFLTLSFRDPIRILSQMRISKCAGDALFGASRDVLCKQQPKILLGLMFFTDLSLFFLDTYMWYIILNAIFSVARSFYLGVSIWTPWRNIFSRLPKRIYSKVLATTDMEIKYKPKVLISQVWNAIVISMYREHLLAIDHVQKLLYHQVPSEQEGKRTLRAPTFFVSQEDHSFKTEFFPTQSEAERRISFFAQSLSTPIPEPVPVDNMPTFTVLIPHYSEKILLSLREIIREDEPYSRVTLLEYLKQLHPHEWDCFVKDTKILADETSQFNGEEKNEKDAAKSKIDDLPFYCIGFKSAAPEYTLRTRIWASLRSQTLYRTISGFMNYSRAIKLLYRVENPEVVQMFGANSEKLERELERMARRKFRIVVSMQRYAKFNKEERENTEFLLRAYPDLQISYLDEEPPANEGEEPRLYSALIDGHSEIMENGLRRPKFRVQLSGNPILGDGKSDNQNHAIIFYRGEYIQLIDANQDNYLEECLKIRSVLAEFEEMNTDNVSPYVPGLPPSKTNPVAILGAREYIFSENIGMLGDVAAGKEQTFGTLFARTLAQIGGKLHYGHPDFLNGVFMTTRGGVSKAQKGLHLNEDIYAGMNALLRGGRIKHCEYYQCGKGRDLGFGSVLNFTTKIGTGMGEQMLSREYYYLGTQLPLDRFLSFYYAHPGFHINNLFIMLSVQMFMICLINLGALKHETIPCIVKKGVPITDPILPTGCADTIPIQEWVQRCTASICIVFLLSFLPLVVQELTERGSWRAITRLAKHFGSLSPFFEVFVCQIYANSLHNNLSFGGARYIGTGRGFATARIPFGVLYSRFAGPSIYFGSRLLMMLLFGTLTVWTGWLLYFWASLLALCISPFLFNPHQFAWNDFFIDYRDYLRWLSRGNSRSHASSWIAFCGLSRTRITGYKRKVLGSPSEKLSGDAPRAQFTNIFFSEIVGPLVLVVVTLIPYLFINAQTGVKEDEAKPTNSIIRLAIIAFAPIAVNAGLLAVLFAMACCMGPVLSMCCKKFGSVLAAIAHGVAVVMLMAFFEVMFFLEGWVFVKALLGMIAVIATQRFIYKLIISLALTREFRQDTSNIAWWTGKWYNMGWHSMSQPGREFLCKITELGMFSADFILGHVLLFFMLPPLCIPYVDKGHSVMLFWLRPSRQIRPPIYSMKQSKLRKRGVIRFAILYFVMLVIFLALIVGPIVASRFLSPLPSIPMNLLQPTGLNNNDTTSELTGLALRGVTDQRRPVSRGCEVVLVWGKTIREWGIGGLIEGWVSRKTNV

SEQ ID NO: 315 - protein, 833 aa, Saccharomyces cerevisiae
MLISKSKMFKTFWILTSIVLLASATVDISKLQEFEEYQKFTNESLLWAPYRSNCYFGMRPRYVHESPLIMGIMWFNSLSQDGLHSLRHFATPQDKLQKYGWEVYDPRIGGKEVFIDEKNNLNLTVYFVKSKNGENWSVRVQGEPLDPKRPSTASVVLYFSQNGGEIDGKSSLAMIGHDGPNDMKFFGYSKELGEYHLTVKDNFGHYFKNPEYETMEVAPGSDCSKTSHLSLQIPDKEVWKARDVFQSLVSDSIRDILEKEETKQRPADLIPSVLTIRNLYNFNPGNFHYIQKTFDLTKKDGFQFDITYNKLGTTQSISTREQVTELITWSLNEINARFDKQFSFGEGPDSIESVEVKRRFALETLSNLLGGIGYFYGNQLIDRETEFDESQFTEIKLLNAKEEGPFELFTSVPSRGFFPRGFYWDEGFHLLQIMEYDFDLAFEILASWFEMIEDDSGWIAREIILGNEARSKVPQEFQVQNPNIANPPTLLLAFSEMLSRAIENIGDFNSDSYHQVMFNSRTAKFMTNNLEANPGLLTEYAKKIYPKLLKHYNWFRKSQTGLIDEYEEILEDEGIWDKIHKNEVYRWVGRTFTHCLPSGMDDYPRAQPPDVAELNVDALAWVGVMTRSMKQIAHVLKLTQDEQRYAQIEQEVVENLDLLHWSENDNCYCDISIDPEDDEIREFVCHEGYVSVLPFALKLIPKNSPKLEKVVALMSDPEKIFSDYGLLSLSRQDDYFGKDENYWRGPIWMNINYLCLDAMRYYYPEVILDVAGEASNAKKLYQSLKINLSNNIYKVWEEQGYCYENYSPIDGHGTGAEHFTGWTALVVNILGRF

SEQ ID NO: 316 - protein, 954 aa, Saccharomyces cerevisiae
MVLLKWLVCQLVFFTAFSHAFTDYLLKKCAQSGFCHRNRVYAENIAKSHHCYYKVDAESIAHDPLENVLHATIIKTIPRLEGDDIAVQFPFSLSFLQDHSVRFTINEKERMPTNSSGLLISSQRFNETWKYAFDKKFQEEANRTSIPQFHFLKQKQTVNSFWSKISSFLSLSNSTADTFHLRNGDVSVEIFAEPFQLKVYWQNALKLIVNEQNFLNIEHHRTKQENFAHVLPEETTFNMFKDNFLYSKHDSMPLGPESVALDFSFMGSTNVYGIPEHATSLRLMDTSGGKEPYRLFNVDVFEYNIGTSQPMYGSIPFMFSSSSTSIFWVNAADTWVDIKYDTSKNKTMTHWISENGVIDVVMSLGPDIPTIIDKFTDLTGRPFLPPISSIGYHQCRWNYNDEMDVLTVDSQMDAHMIPYDFIWLDLEYTNDKKYFTWKQHSFPNPKRLLSKLKKLGRNLVVLIDPHLKKDYEISDRVINENVAVKDHNGNDYVGHCWPGNSIWIDTISKYGQKIWKSFFERFMDLPADLTNLFIWNDMNEPSIFDGPETTAPKDLIHDNYIEERSVHNIYGLSVHEATYDAIKSIYSPSDKRPFLLTRAFFAGSQRTAATWTGDNVANWDYLKISIPMVLSNNIAGMPFIGADIAGFAEDPTPELIARWYQAGLWYPFFRAHAHIDTKRREPYLFNEPLKSIVRDIIQLRYFLLPTLYTMFHKSSVTGFPIMNPMFIEHPEFAELYHIDNQFYWSNSGLLVKPVTEPGQSETEMVFPPGIFYEFASLHSFINNGTDLIEKNISAPLDKIPLFIEGGHIITMKDKYRRSSMLMKNDPYVIVIAPDTEGRAVGDLYVDDGETFGYQRGEYVETQFIFENNTLKNVRSHIPENLTGIHHNTLRNTNIEKIIIAKNNLQHNITLKDSIKVKKNGEESSLPTRSSYENDNKITILNLSLDITEDWEVIF

SEQ ID NO: 317 - protein, 702 aa, Saccharomyces cerevisiae
MVSMFSLFLLLIEQSPLVASLQQSQRHIVGVPWEKQHLYDSNEPDLTKWHCLNHEDIVLDISQINDGVCDCPDGSDEPGSAACVEDIFKSVAEGGGKVNKYFYCDNKGFIPRYIRKSEVADGICDCCDCSDELLSGYELFDAGSNCSQLKNEFDIMASKELSSYREGKEALEELERKYGTKEEAITRGNCLEEDKEKASAEIKVLSNRLSENRAKLEQLRGEYFNQLSHDPILYQFEQLNSTRLGSDILTSFTMVSRVSKGYQDIFKILSDLSEAYTPSLNDKVVNDNIKKFRKVRRRAEKAKINADSKIDDEQADNLYLYFTEEVPQIFLKRESENTLRYVIGKSNFVQALVEGKINYTNDILEYIREFRLIMDDISQNYNVNFQDAGVKSAVDSYKNYLGEYGELAELEPAHPSESLLRSLSEVTSFVNENAPKVLPPDAVESEQDTNSDHIGTSGDLRNKLKEILSKLNIFSSRKDLVSLEKRFRSCESQVSLLENELKQKMDYKKLLDETEDEGTNSTAGNLTELLELMGSQSYCLDDILDNYVYTICFQRPMTEGVIYQAEDKVDGKKVLIGRFKTSGFNVDLNMEKYAEHLKATYDEKSDLISNLAAIQDDDGNMQHYVFGNLNELNNGLVLEYENGDQCWNGPRRSATVFVRCSDKFKIRSVHEATKCNYIFDVVGPLGCNKTFEYEPPKFNLSE

SEQ ID NO: 318 - protein, 502 aa, Saccharomyces cerevisiae
MKFSAYLWWLFLNLALVKGTSLLSNVTLAEDSFWEHFQAYTNTKHLNQEWITSEAVNNEGSKIYGAQWRLSQGRLQGSAWDKGIAVRTGNAAAMIGHLLETPINVSETDTLVVQYEIKLDNSLTCGGAFIKLMSGFMNVEALKHYAPDTEGVELVFGPDYCAPEINGVQFAINKVDKITHESKLRYLQEMPLSKLTDTSQSHLYTLIIDESAQSFQILIDGKTVMVREHIEDKKKVNFEPPITPPLMIPDVSVAKPHDWDDRIRIPDPEAVKLSDRDERDPLMIPHPDGTEPPEWNSSIPEYILDPNAQKPSWWKELEHGEWIPPMIKNPLCTAERGCGQQIPGLINNAKYKGPGELNEIINPNYMGEWHPPEIENPLYYEEQHPLRIENVISGVILEFWSGSPNMLISNIYVGKNVTEAQIIGNKTWLMRDRAFRGSDGPTERKFMNSRLGNLQTTFHNERESPNPFDRIIDRILEQPLKFVLTAAVVLLTTSVLCCVVFT

SEQ ID NO: 319 - protein, 720 aa, Saccharomyces cerevisiae
MPLRNLTETHNFSSTNLDTDGTGDDHDGAPLSSSPSFGQQNDNSTNDNAGLTNPFMGSDEESNARDGESLSSSVHYQPQGSDSSLLHDNSRLDLSQNKGVSDYKGYYSRNNSRAVSTANDNSFLQPPHRAIASSPSLNSNLSKNDILSPPEFDRYPLVGSRVTSMTQLNHHGRSPTSSPGNESSASFSSNPFLGEQDFSPFGGYPASSFPLMIDEKEEDDYLHNPDPEEEARLDRRRFIDDFKYMDKRSASGLAGVLLLFLAAIFIFIVLPALTFTGAIDHESNTEEVTYLTQYQYPQLSAIRTSLVDPDTPDTAKTREAMDGSKWELVFSDEFNAEGRTFYDGDDPYWTAPDVHYDATKDLEWYSPDASTTVNGTLQLRMDAFKNHGLYYRSGMLQSWNKVCFTQGALEISANLPNYGRVSGLWPGLWTMGNLGRPGYLASTQGVWPYSYESCDAGITPNQSSPDGISYLPGQKLSICTCDGEDHPNQGVGRGAPEIDVLEGETDTKIGVGIASQSLQIAPFDIWYMPDYDFIEVYNFTTTTMNTYAGGPFQQAVSAVSTLNVTWYEFGEYGGYFQKYAIEYLNDDDNGYIRWFVGDTPTYTIHAKALHPDGNIGWRRISKEPMSIILNLGISNNWAYIDWQYIFFPVVMSIDYVRIYQPSNAISVTCDPSDYPTYDYIQSHLNAFQNANLTTWEDAGYTFPKNILTGKCTSSKFKLSS

SEQ ID NO: 320 - protein, 771 aa, Saccharomyces cerevisiae
MSVRNLTNNRHSNSENSVSGSENSFYSSNEQSRQSSSLEPADGQNVRVSGNPFLGSEEFDEDYNSPSGDDERRGANEYSSSSSINYNNDPNSDTSLLANEKNSPERNGQRMSDYKGYYAKTNLTSANNLNNHNNNNYKNIISSSNDNSFASHLQPPDRNLPSHPSSNNMSSFSNNSLIKSPPPFDRYPLVGTRHISAAQSQSQNLINEKKRANMTGSSSSAHDSSLSSTNLYMGEQDFSPFGGYPASFFPLTLDEKEDDDYIHNPNVEEEAKLDRRRFVDDFKHMDRRSFLGLLGILFLFMAGIFIFIVLPAITFSGVVYHHEHVHAANSAGSSSSNTTSKSLTEYQYPQLAAIRTTLVDPDTPDSAKTRVAKDGSKWQLVFSDEFNAEGRTFYDGDDQFWTAPDIHYDATKDLEWYSPDAVTTTNGTLTLRMDAFRNHDLYYRSGMVQSWNKLCFTEGALEVSANLPNYGRVTGLWPGMWTMGNLGRPGYLASTQGVWPYSYEACDAGITPNQSSPDGISYLPGQKLSVCTCDNEDHPNQGVGRGAPEIDILEGEADTILGVGVASQSLQIAPFDIWYMPDYDFIEVYNFTTTTMNTYAGGPFQQAVSAISTLNVTWYEFGEEAGYFQKYAIEYLNDDDNGYIRWFVGENPTFTLYATSLHPSGNIDWRRISKEPMSAILNLGISNNWAYIDWQYIFFPVTMSIDYVRLYQPKGSTSITCDPEDYPTYDYIQSHLNAYYNANLTDWEQAGYTFPKNILTGGCSSSKFSLS

SEQ ID NO: 321 - protein, 276 aa, Saccharomyces cerevisiae
MRLQRNSIICALVFLVSFVLGDVNIVSPSSKATFSPSGGTVSVPVEWMDNGAYPSLSKISTFTFSLCTGPNNNIDCVAVLASKITPSELTQDDKVYSYTAEFASTLTGNGQYYIQVFAQVDGQGYTIHYTPRFQLTSMGGVTAYTYSATTEPTPQTSIQTTTTNNAQATTIDSRSFTVPYTKQTGTSRFAPMQMQPNTKVTATTWTRKFATSAVTYYSTFGSLPEQATTITPGWSYTISSGVNYATPASMPSDNGGWYKPSKRLSLSARKINMRKV

SEQ ID NO: 322 - protein, 268 aa, Saccharomyces cerevisiae
MLIVLFLTLFCSVVFRTAYCDVAIVAPEPNSVYDLSGTSQAVVKVKWMHTDNTPQEKDFVRYTFTLCSGTNAMIEAMATLQTLSASDLTDNEFNAIIENTVGTDGVYFIQVFAQTAIGYTIHYTNRFKLKGMIGTKAANPSMITIAPEAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 323 - protein, 313 aa, Saccharomyces cerevisiae
MMRRTLLHSFATLLLSLSLWSAAVMAAVTTQVTVVTNVAGALVTETTIWDPATAAAAATTTAQTGFFTTVFTTTNDVGTTVTLTQTVNRATMLPTTTTSTSSTGKTTTTVPTATSSLSSGLYLSTVTTTNDLGTTVTLTQTFTHSSTSATSSASSSVSSSVSSSGSSSSVKTTTSTGSAVAETGTRPDPSTDFTEPPVSAVTSLSIDSYITITEGTTSTYTTTRAPTSMWVTVVRQGNTITVQTTFVQRFSSQYVTVASPSVGSIGMGTLTGTVGVIKSAIKKTVSHNEAQHLGMSSFTSILGGLLTVLIWFL

SEQ ID NO: 324 - protein, 933 aa, Aspergillus fumigatus
MNPQHLADRTPSPGRPLNTYQLSDNPYVHDHLQMPSSDRLAEQPTYSVERIPNSYGHNEAYEQRHHEQYPAYDYAVNPEAHHDAYYTQPYEPTVTPQDDYDLGQYHEQHQPYQDDQVPILQPENPFGPDPYSEEYHDDPAAVPTPSPAPIRRWKTVKEVQLFHGNLVLDCPIAPKLLSQVPHAEPPGRDEFTHMRYSAATCDPADFYEERFTLRQKLFAKPRHTELFIVITMYNEDDFLFARTLIGVFKNIEYMCNRTQSKTWGKDAWKKIVVCVISDGRAKINPRTRAVLAGLGVYQDGIAKQQVNGKDVTAHIYEYTTQVGLELKGTQVHIKGRSACPVQMIFCLKEKNQKKINSHRWFFQAFGRVLDPNICVLLDAGTKPGRDSIYQLWKAFDVEPMCGGACGEIKVMLSHGKKLLNPLVAGQNFEYKLSNILDKPLESAFGFISVLPGAFSAYRYVALQNDKNGQGPLERYFLGEKMHGANAGIFTANMYLAEDRILCFEIVTKRNCRWLLQYVKSSTGETDVPDRMAEFILQRRRWLNGSFFAAVYAIAHFYQIWRSDHSFMRKFMLLVEFIYQTINMIFAWFNIGNFFLVFHILTTYLGDAELLGTTGKVLGVVFEWLYLATLVTCFVLSLGNRPGGSNKFYMTMVYFWIGIMIYLTFAAIFVTVKSIQKEVADNSFSVGQLFSNSQFFSIFVSLGSTYVMWLLASLIFLDPWHMFTSFIQYMLLTPTYINVLNIYAFCNTHDITWGTKGDDKAEKLPSANMKPGGKVDVDIPQDDGDLNAQYEAELAKFAQKPPKETKVISEEERQADYYKGFRSAVVLAWVFCNFALGAVVLSAAGLDRFNSDKNATDDDRATIYMAVVLWSVAGLSIFKFIGAMWFLVVRMVCSRIFDFSILLSHANASHSSEAFDVISLVFSFPCDCTHPALY

SEQ ID NO: 325 - protein, 1084 aa, Aspergillus fumigatus
MSSNSSRMYPPAPNYEEEPPAYGNYGETTSFLADHDSSPRHQGVTMRLLPNSTDVDDDLSVDVERGASHHYGIEYSDDESTRANVQYVPYSGNANGGYNRFYGYNAEESPSRPASSLGNVPSIPPPAVSAVEVPQYSSRPASPLRPWSPARAADWTRPPAPPSVTGSQYERADLNGSPRPGTPSSRYGGSPRRPLPPAPLFAGPGAATGQDTSIDIGDGNDPEDPFGGGGRTNNRHEHRGSIRSFMSDSTMITDEKEEMAKINLNEDDVVDVDPNMHYGPAPEKQSRRGVREAQMSKKEVQLINGELILECKIPTILHSFLPRRDDREFTHMRYTAVTCDPDDFTQRGYKLRQQIGSTMRETELFICVTMYNEDETHFTRTMHGIMRNISHFCSRSKSRTWGKDGWKKIVVCIIADGRKKVHPRTLNALAAMGVYQEGIAKNIVNQKQVTAHVYEYTTQVSLDSDLKFKGAEKGIMPCQVIFCLKEHNQKKLNSHRWFFNAFGRALQPNICILLDVGTKPEPTALYHLWKAFDQDSNVAGAAGEIKAGKGKNMMGLLNPLVASQNFEYKMSNILDKPLESVFGYITVLPGALSAYRFFALQNDADGNGPLNQYFKGETLHGKDADVFTANMYLAEDRILCWELVAKREERWVLKFVKSAVGETDVPDTIPEFISQRRRWLNGAFFAAVYSLVNVKQLWKTDHSVPRKILLQIEAFYQFLNLLFTYFGLANFYLAFFFIAGSLSDERIDPFGHNMGKYIFFVLRYACILVMCLQFIISMGNRPQGAKKLYMSGIIVYSIIMVYTAFCALYLVVLELMAKAGVGKKELAVSDSLFINIVVSLLSTVGLYFYSSFLYLDPWHMFTSSAQYFALLPSYICTLQVYAFCNTHDVTWGTKGDNTINNDLGAARIINGTTVEVEMPSEQLDIDSGYDAALRNLRDRLEVPPPPVSENQQQEDYYRAVRTYMVSIWMVANVILAMSVSEIYGVDSGGTNVYLGIILWSVAVLALIRAVGSTTYAILLVVQKIVEGKTKFDAGNIVNSNAATSSYVSSRSTAQYGGGTSFKDKVTEAGWTLKRTAGKAMFWKK

SEQ ID NO: 326 - protein, 859 aa, Aspergillus fumigatus
EALMGTPRPYSAHSPQESRSSFYSQPSQSPTPTYGRDDAEDQQQSLLRRSLASPNGWSYDDPNVSTDSLRRYTLHDPGITAFAPPYPESEAADVRSARMSGYSGIEMDAWQRRQGVKPSALRRYGTRKINLVQGSVLSVDYPVPSAIQNAIQAEYRDAEEAFHEEFTHMRYTAATCDPDEFTLRNGYNLRPAMYNRHTELLIAITYYNEDKVLTARTLHGVMQNVRDIVNLKKSEFWNKGGPAWQKIVVCLVFDGIEPCDKNTLDVLATIGVYQDGVMKKDVDGRETVAHIFEYTTQLSVTPTQQLVRPQPNDPSNLPPVQMLFCLKQKNSKKINSHRWLFNAFSRILNPEICILLDAGTKPGSKSLLALWEAFYNDKTLGGACGEIHAMLGRGWRNVLNPLVAAQNFEYKISNILDKPLESAFGYVSVLPGAFSAYRYRAIMGRPLEQYFHGDHTLSKRLGKKGIEGMNIFKKNMFLAEDRILCFELVAKAGYKWHLTYVKASKGETDVPEAAPEYISQRRRWLNGSFAASLYSIMHFGRIYKSGHSFVRMFFLHIQMIYNCCQLIMTWFSLASYWLTSSVIMDLVGTPSSHNKYKAWPFGNDASPIVNFFVKYGYLLVLMLQFVLALGNRPKGTKLAYTMSFLWFSLVQFYVLILSFYLVANAFMGGMIDFDFDQGVGNFLSSFFSSTGGGIVLIALVSTYGIYIVASILYMDPWHILTSSWAYFLGMTTSINILMVYAFCNWHDVSWGTKGSDKADALPSAQTKKADGSKSNFIEEIDKPQADIDSQFEATVKRALAPYQEPKEDSTISLDDSYRNFRTSLVLLWILSNLLVSLLITNDGIRKMCLTVRLGSPGCA

SEQ ID NO: 327 - protein, 911 aa, Aspergillus fumigatus
MAYQGSGSHSPPHYDDNGHRLQDLPHGSYEEEASRGLLSHQQGPFTGPFDDPQQHGSSTTRPVSGYSLSETYAPEAAYHDPYTQPSPGSVYSAQSAENPAAAFGVPGRVASPYARSDTSSTEAWRQRQAPGGGPGGLRRYATRKVKLVQGSVLSVDYPVPSAIQNAIQAKYRNDLEGGSEEFTHMRYTAATCDPNEFTLHNGYNLRPAMYNRHTELLIAITYYNEDKTLTSRTLHGVMQNIRDIVNLKKSEFWNKGGPAWQKIVVCLVFDGIDPCDKDTLDVLATIGVYQDGVMKRDVDGKETVAHIFEYTTQLSVTPNQQLIRPTDDGPSTLPPVQMMFCLKQKNSKKINSHRWLFNAFGRILNPEVCILLDAGTKPGPKSLLSLWEAFYNDKDLGGACGEIHAMLGKGWKNLINPLVAAQNFEYKISNILDKPLESSFGYVSVLPGAFSAYRFRAIMGRPLEQYFHGDHTLSKQLGKKGIEGMNIFKKNMFLAEDRILCFELVAKAGSKWHLTYVKASKAETDVPEGAPEFISQRRRWLNGSFAAGIYSLMHFGRMYKSGHNIVRMFFLHIQMLYNIFSTVLTWFSLASYWLTTTVIMDLVGTPSDNNGNKAFPFGKTATPIINTIVKYVYLGFLLLQFILALGNRPKGSKFSYLASFVVFGIIQVYVVIDALYLVVRAFSGSAPMDFTTDQGVGEFLKSFFSSSGAGIIIIALAATFGLYFVASFMYLDPWHMFTSFPAYMCVQSSYINILNVYAFSNWHDVSWGTKGSDKADALPSAKTTKDEGKEVVIEEIDKPQADIDSQFEATVKRALTPYVPPVEKEEKTLEDSYKSFRTRLVTFWIFSNAFLAVCITSDGVDKFGFTNSATDRTQRFFQALLWSNAVVALFRFIGACWFLGKTGLMCCFARR

SEQ ID NO: 328 - protein, 1182 aa, Aspergillus fumigatus
MSLPQRPGKVSPRREETQAFRDTSRRRRRDIESGDNETLSSPHRHHHRRHSQSSRKTRDMDEERLEPGGHRKSQVRPERSRIDENHPNYHYRQKSQNMPVYPSTTGNEPLIEGDELNRDSSQSTEHRGREGDFATHGNINKPMERAPSRHRSKRKKSRKLSRRAATEEKRRQKAMEQVRPPSPWSAYCAIITFWAPNFILKCFGMPQKAQREAWREKIGLISLILLIAAFVGFLTFGFTATVCSAPPLRLKINQVDRGYMIFHGEAYDLSKSKHPAAAGIPADSNVLYDLPHKYGGQDGSFFFQQVNGACKDLITLKPGSDIPSNSDGDLAWYFPCTAFNQDGSSKPNFTSPYYNGWGCHTSGAARKAFYGLRSSGDVYFTWADTRNKSRNLAVYSGNVLDFDLLNWLDESQLNIPAKFTELRTNPDVRGVDLTYYLQAGEDKRIGKCLSQIIKVGTIDTDTVGCIASKVVLYVSLIFILSIVIVKFVFALFFQWFLSPRYAASKTSMGADSKTRKQEIEDWSNDIYRPGPRLADQHLPDRPNKRASFLPTTSRFSSPYTVSNGGKQKPQYITMASQNSTSRLLPSTAGSMYKQSHNSSGGSLHLEPSRLNPAASGTSLAVGAESDVLGSSAYIHEAVVPQPPPEWQPYGFPLAHALCLVTCYSEGEEGIRTTLDSIAMTDYPNSHKTIIVICDGIIKGKGEEYSTPDIVLRMMRDPVIPTDEVEAFSYVAVATGSKRHNMAKVYSGFYDYGETSVIPPEKQQRVPMMIVVKCGTPAEATQAKPGNRGKRDSQIILMSFLQKVMFDERMTELEYEMFNGLWNVTGIPPDFYEVVLMVDADTKVFPDSLTHMISAMVKDPDVMGLCGETKIANKTDSWVTMIQVFEYFISHHQSKAFESVFGGVTCLPGCFCMYRIKAPKGGQNYWVPILANPDVVEHYSENVVDTLHKKNLLLLGEDRYLSTLMLRTFPKRKQIFVPQAVCKTVVPDKFMVLLSQRRRWINSTVHNLMELVLVRDLCGTFCFSMQFVVFIELVGTLVLPAAIAFTFYVVIISIIKKPVQIIPLVLLALILGLPGVLIVVTAHRLVYVLWMFIYLLSLPIWNFVLPTYAYWKFDDFSWGDTRKTAGEQDKGHEAGEGEFDSSKITMKRWRDFERDRRLKMQSGWAQPAVGGGYPAQYEPYSDY

SEQ ID NO: 329 - protein, 1848 aa, Aspergillus fumigatus
MAAPSPAGGAPSHAQSSLPSLPAHLQSDTHLTAHLASRFHVGLPTARLSSQALISLNTYTTSTKGPDGGKEGSAMGEAEDLAKRAFTRLGARGENQAVVFLGESGSGKTTIRSHLLSAFLSFSSTPLSSKLSYAAFLFDTLTTTKSLTTQTASKAGLFLELQYDGSSSVNPTLIGGKIIDHRLERSRITSVPTGERSFHVLYYLLAGTSPAEKAHLGFDKAVHVSTSSGAIGHKRWRYLGHPTQLKVGVNDVEGFQHFKTALRKLEFPRSEIAEICQILATILHIGQLEFASGQATTTHAEESGGYSHEGGETVTIVKNKDVLSIIAAFLGLSVEDLENSFGYRTKTIHRERVTVMLDPKGARQNADELARTIYSLLVAYVIEAVNQRICAAEDSVANTISIVDFPGFAQACATGSTLDQLFNNAATELLYNFCLQSFFDRKADELEREEVSVPATSYFDNTDAVRGLLKHGNGLLSILDDQTRRGRTDNQLLESLRRRFENKNPTIIVEGSKRTSLISQNARSAFTVKHFAGEIDYSVNGLIEENGEFISGDLMRLMKSTKSDFVRELFGQAALQTVTHPKEKTAIMQAQVSSKPLRMPSMARRKTSPSSRLAFDAGDADEVESQAESIAKDSSSGRRKSAMLTSGIQGAAGQFLSSLDIVNKCLSSTNLNPYFIFCLKPNDRRIANQFDSKCVRAQVQMFGIAEISQRLRNADFSVFLPFAEFLGLAEIGNIVVGSDKEKAEVVLDEKRWPGNEARVGSTGVFLSERCWADLAKVGERVVPVYAADMSDEGGDGLLHPRSTGYGDSKVRLLNPADQSPGAFIYGDEAKQGYFGSRDLDGRSDAGNSAFNSGDMFRNHETREQMLEKGNEKKMEEVDDAPISGSRKRWIALVYLLTFYIPDFAIKLFGRIKRKDVRMAWREKFAINLIIWFSCGVAIFFIVAFPGLVCPTQHVYSAAELSSHNGKDGHSSFIAIRGVVFDLDKFMPGHYPHIVPESALKKYAGVDATGLFPVQVSALCQGKSGSVDPMVLLDYRPTNISGSATTISGTDTNSVYHDFRHFTNDSRPDWFYEQMVMLKANYLKGYVGYTPKYLNTLGKKSQSIGSINGKVYDLTSYIAGGRLTKAPPGETVPSDVDTDFMDNSVVSLFQSLPGQDLSKHWENLKIDPALRRRMQLCLDNLFFVGHVDTRNSAQCEFARYFILAISVLICSIIVFKFLAALQFGRKNVPENLDKFIICQVPAYTEDEESLRRAIDSMARMRYDDKRKLLVVICDGMIIGQGNDRPTPRIVLDILGVPESVDPEPLSFESLGEGQKQHNMGKVYSGLYEVQGHIVPFLVIVKVGKPSEVSRPGNRGKRDSQMVLMRFLNRVHYNLPMSPMELEMHHQIRNVIGVNPTFYEFILQVDADTVVAPDSATRMVAAFLNDTRLIGVCGETALTNAKNSAVTMIQVYEYYISHNLTKAFESLFGSVTCLPGCFTMYRIRSAETAKPLFVSKEVVDAYAEIRVDTLHMKNLLHLGEDRYLTTLLLKHHSKYKTKYISSAKAWTIAPESWTVFLSQRRRWINSTVHNLIELIPMQQLCGFCCFSMRFVVFVDLLSTVIQPVTLAYIIYLIYWLVKDTSTIPYTSLILLAAIYGLQALIFIIRRKWEMVGWMIVYLLALPVFSLALPLYSFWHMDDFTWGNTRIITGEKGRKVVISDEGKFDPASIPKKKWEEYQTELWEAQTSRDDRSEVSGISYGTKSYHPAQSEYGFPGSRPMSQLDLPRFGSRMSLAPSEMMSRHADMEMENLSHLPSDDAILAEIREILRTADLMSVTKKSIKLELERRFGVNLDLKRPYINSATEAVLAGAL

SEQ ID NO: 330 - protein, 725 aa, Aspergillus fumigatus
MIVLFTLLRGIFLPVMIVTLPLPVHLRRRFPAQMVLMLQWFAFGMFSVLLIIPWLLCVYRLVTHSPGRTKRIKQVLDDRTAPKTVVVMPVYKEAPETLIRAIDSVVDCDYPANCIHVFLSYDGCLIDESYLRLIEHLGIPITLESYPQSIDVTYKDARITVSRFKHGGKRHCQKQTFRLIDMVYADYLERHDNLFVLFIDSDCILDRVCLQNFMYDMELKPGSKHDMLAMTGVITSTTDRGSLLTLLQDMEYVHGQLFERSVESSCGAVTCLPGALTMLRFSAFRKMAKYYFADKAEQCEDFFDYGKCHLGEDRWLTHLFMVGARKRYQIQMCAGAFCKTEAVQTFSSLLKQRRRWFLGFITNEVCMLTDVRLWKRYPLLCLVRFMQNTIRTTALLFFIIALSLITTSSSINDLPVGFIAISLGLNYVLMFYLGAKLKRYKAWLFPLMFILNPFFNWLYMVYGILTAGQRTWGGPRADAATADEHTSPEEAVELAKAQGDELNVDLTTFRSRGDEKSVPIHPSEKIDGRFSAPELPDGYDSNLNDSNAALTELMTPLPSVPRIGIHTYPSSDSILTSDSLSSIHLPLKVEELTGDNDNMKPYPDRQPRDTSSLHQMQRTCSNGIVASDSCSSQDDASEMVNKPEILSPSAHILPHPSQATESSSGEDIYPLHLPSPHQHEAHFAPLNASTRGSMEGNTPEVQRPRRKLPGIPRPIRAQKDPESMV

SEQ ID NO: 331 - protein, 983 aa, Aspergillus nidulans
MSYNRLGDPYGDDRDARSPIMNPSSLSNRSPSPGRPLDGYQLSDAPYGHHHHIEMPSSDRLAEQPTYSVERIPQSYGHNEAYEAQHQHYPGYEYSVDPEAHHDAYYTQPYQPTVTPGHDDYDLGQYPGHQHSYQDDEPILQPEDPFQAQNPYSDDYQEDMTIAPTPSPAPLRRWKTVKEVQLFQGNLVLDCPIAPKLLNQIPHAENGQRDEFTHMRYSAATCDPKDFFEERFTLRQKLFAKPRHTELFIVVTMYNEDDFLFARTMVGVFKNIEHMCSRTRSKTWGKDAWKKIVVCVISDGRAKINPRTRAVLAGLGCYQDGIAKQQVNGKDVTAHIYEYTTQVGMELKGNQVHLKPRSGVPVQMIFCLKEKNQKKINSHRWFFQAFGRVLDPNICVLLDAGTQPGKDSIYRLWKAFDVEPMCGGACGEIKVMLDHGKKLFNPLVAGQNFEYKLSNILDKPLESAFGFISVLPGAFSAYRYIALQNDKNGQGPLERYFLGEKMHGANAGIFTANMYLAEDRILCFEIVTKRNCRWLLQYVKSSTGETDVPDQMAEFILQRRRWLNGSFFAAVYAITHFYQLWRSDHSFIRKFMLLIETIYQTINMLFAWFGIGNFFLVFHILTTYLGDADLLGTAGKVLGVVFEWLYLATLVTCFVLSLGNRPGGSNKLYMTMVYFWVFIMIYLAFAAVFVTVRSIQEEVKDGSFTFSTLFTNSTFFSIIVSLGSTYVMWFIASIIFMDPWHMFTCFIQYILLTPTYINVLNIYAFCNTHDITWGTKGDDKAEKLPSANLKPGGKVDVNIPQDDGDLNAQYEAELMKFAQKPPKEIKTISEEERQADYYKGFRSSVVLVWVFCNFALGAVVLSSAGLDRFSDDAEAAETDRNNRAMIYMAVVLWSVAGLSIFKFLGAMWFLVVRMVSIFSRFISSVSTASNMICSSEVSNLFHRSRITLQAFNGRRFLSIPAGSAYRNDDKDNGLWNVIVFMSD

SEQ ID NO: 332 - protein, 916 aa, Aspergillus nidulans
MAYHGSGPQSPGEHTYDDGHQLRDLSHSNTSYEEEASHGLLSSQQSPFAGPFDDPHQQRGLTASPVQRPTSGYSLTESYAPDAAYHDPYSANQSVYSGHSENPAAAFGVPGRVASPYARSETSSTEAWRQRQAGARRGGNGLRRYATRKVKLVQGSVLSVDYPVPSAIQNAIQAKYRNDLEGGSEEFTHMRYTAATCDPNEFTLHNGYNLRPAMYNRHTELLIAITYYNEDKTLTARTLHGVMQNIRDIVNLKKSEFWNKGGPAWQKIVVCLVFDGIDPCDKDTLDVLATVGIYQDGVMKRDVDGKETVAHIFEYTTQLSVTPNQQLIRPTDDGPSTLPPVQMMFCLKQKNSKKINSHRWLFNAFGRILNPEVCILLDAGTKPGPKSLLYLWEAFYNDKDLGGACGEIHAMLGKGWKKLLNPLVAAQNFEYKISNILDKPLESSFGYVSVLPGAFSAYRFRAIMGRPLEQYFHGDHTLSKQLGKKGIEGMNIFKKNMFLAEDRILCFELVAKAGSKWHLSYVKASKGETDVPEGAPEFISQRRRWLNGSFAAGIYSLMHFGRMYKSGHNIVRMFFLHLQMLYNWFSTFLTWFSLASYWLTTSVIMDLVGTPSSSNGYTAFPFGKTATPIINTLVKYIYLAFLLLQFILALGNRPKGSKLSYLASFVAFGIIQLYVVVDALYLVVRAFTGGAPMDFNTDDGIGAFLSSFFGSSGAGIIIIALAATFGLYFVASFMYLDPWHMFTSFPAYMAVQSSYINILNVYAFSNWHDVSWGTKGSDKADALPSAKTTGGKGEEAVIEEIDKPQADIDSQFEATVKRALTPYVPPEEKEEKSLDDSYKSFRTRLVTLWLFSNGLLAVCITSEGLDKFGFTNTSTERTSRFFQALLWSNAVVALIRFIGATWFLGKTGLLCCFARR

SEQ ID NO: 333 - protein, 1852 aa, Aspergillus nidulans
MVGTLPAGHTPSHVQSSLPSLPAHLQSDTHLTAHLASRFHVGLPTARLSSHALISLNNYTSSSKGPDGGKEGSAMGETEDLARRAYTRLGARGENQAIVFLGESGAGKTTLRSHLLSSFLSFSSTPLSSKLSYAAFIFDTLTTTKSLTTPTASKAGLFLELQYDASSSVNPTLIGGKIIDHRLERSRIASVPTGERSFHVLYYLLAGTSAAEKAHLGLDSPIHVTTAGGRLSSADHKRWRYLGHPTQLKVGINDADGFQHFKTALRKLEFPRSEIAEICQILAAILHIGQLDFGSGQATLTGAEESGGYSHEGGETVTVVKNKDVLSIIAAFLGLGVGELEASFGYRTKTIHRERVTVMLDPKGARRSADELSRVLYSLLVAYVIENVNQRICAAEDSVANTVSIIDFPGFAQACSTGSTLDQLLNNAACESLYNFCLRSFFDRKADMLEREEVAVPATSYFDNTDAVRGLLKQGNGLLSILDDQTRRGRTDAQFVEAVRRRFENKNPAITAGASGSGNGYGMVSQNARSSFTVKHFAGEVDYSATGLLEENGEVISGDLMNLMKSTRSDFVRELFGQEALQTVAHPKEKTAIMQAQVSSKPLRMPSMARRKTSPASRLTFDATPAEDPYETESQTGSSAKNSSAKRKSGMLMGGMQCAAGQFLSSLDIVNKCLTSGNLNPYFVFCLKPNDRRIANQFDSKCVRTQIQTLGIAEISQRLRNADFSVFLPFAEFLGLAEVGNVVVGSDKEKSEVVLDEKRWPGNEARVGSTGVFLSERCWADLAKVGERVIPSFAAEDDGGDALLHPRTANYADSKVRLLNPSDHSPGAYIYGDESKQASNTSRDFDGRSDAGYSAFNSGDMFHNLETREQMLEKGNEKQMEEVDEVPVSGSRKRWMAIVWLLTFYIPTPAIRYIGRMKRKDIQIAWREKFAINLLIWLACAIAVFIIVGFPSLICPTQHVYSPAELSSHDGKDGHSSYTSIRGLVLDLGEFMDSHYPGIVPDSALKKYAGVDSTALFPVQVSALCLGKDGNVDPKVLLDYKPTNFSGSVTSTSSGDPNSVYHDFRYFRDDYRPDWYAEQMIYLRANYYKGWIGYSSEYLHTLASKSQNVASINGKIYDLTSYIAGGRRIQGREGDDTTGIDTDFMDSLVVDLFQQKAGEDITKYWEDLPLTPKLRVDMMDCLNNLFIVGHVDTRNSTQCQFARYFILAISVLICSVIVFKFFAALQFGKKNVPENLDKFIICQVPAYTEDEESLRRAIDSMARMQYDDKRKLLVVICDGMIIGQGNDRPTPRIVLDILGVPESVDPEPLSFESLGEGMKQHNMGKVYSGLYEVQGHIVPFLVVVKVGKPSEVSRPGNRGKRDSQMVLMRFLNRVHYNLPMSPMELEMHHHIRNIIGVNPTFYEFILQVDADTVVAPDAATRMVSSCLNDTRIIGVCGETSLTNAKTSAVTMIQVYEYYISHNLTKAFESLFGSITCLPGCFTMYRIRSAESGKPLFVSKEIVEAYSEIRVDTLHMKNLLHLGEDRYLTTLLLKHHPKFKTKYNFRAQAYTIAPESWTVFLSQRRRWINSTVHNLVELIPLQQLCGFCCFSMRFVVFIDLISTIIMPVTVAYIVYLIVWLVRDTSTIPWTSFLLLAAIYGLQAIIFIVRRKWEMIGWMIIYILAIPVYSLALPLYSFWHMDDFSWGNTRIITGEKGRKIVISDEGKFDPASIPKKRWEEYQAELWEAQTSRDDRSEISGISYGTKYHPATQSEYGFPGSRPMSQLELPRHMSRMSLAPSEMMSRHMDMELEDVNLPSDDAILSEIRDILRTADLMTVTKKNIKQELERRFGVNLDAKRPYINSATEAVLSGNL

SEQ ID NO: 334 - protein, 1739 aa, Aspergillus nidulans
MSNRFSVYSTQSAGLPGGRPSNQLSTTTLLNALHAHYTSGLPYQLDAGTSVVVNNWLTAAQTGADGHNGGTFDRELAARAWEHARRRAEDGCIVLSSTHQSTPSIFEPFLTTLPLSTPSVTFTALSALKPFLRAVTAFNPSYSLYSALSANFTFTLKGDLVALTLALSTSGLNVQKGLLDIPTEPGYRAFDVFYYLLTTTSTQAEREFLALREPSAYALLNKSGTYDPPSYIPTADDAAAAEDFRAALKAIGIKGASLRNLLSVLAGLLKLGNAAGFLVDEEELEQTCEDVGDLLGVDPEILLHKCATDERELLITGIYEALVDWVISKANEAIAGELEELNANGSGEHWNDDDTVSISVVDIPRPAFGKAVALRNVFDDSLGINAEMKEDGIPAPPVGQAILNEMAAAVEQFGPDLGISTDPTKEYELDKRQGVLEKVGIDLDADSFLRQILIPVESQGIAVGKKGRFDLASTLGSSRVWHHISVHPSDDLPGALNTSAPTAAWTASAVSRQIREWRLVEWANRRLKQFDFTADFDVDEFVNRYSRLGCADGRDGVESWLMERGWTNGDAFVGHQRIWMRENAWWEAETMIDLKADEPPSTHSYFSNSMLDPHSGGTPMAESASLLGGSQSNLLHRQSAMAPSVMAKSIAPSVPPTMNMAGDYGLGSKGDDKKWDNIYYDGDAEGGDRKHLEKDEITLGRRVWTAFVWALTFWIPSFVLRYVGRMKRPDVRIAWREKVVLVLLILLFNGIVCFYIIAFGDLLCPGKDKVWNEKEVSWRSTSSNFYVSIHGYVYDITKFAKVTHGDTSPEATPSLMEPLAGKVLDAYFPPPLTRMCGNYVNDLAINLQNNDTSATEDQPLAVHKSGPRNRPDTTTKLHNITWYEQDFLPKINEYYKGKLVWSKDTVKKQAESSSERKWVIAHNKIYDLTDYFYTLDMMNSESSYDWLPSAITDLVKNNPGQDVSDKWPLMSSPFREAQSCLDYVFYKGDTDFRDGPRCTVNNWILLAFTILICAVVLVKFLAALQLGSKRRPAPQDKFVICMVPAYTEGEDSLRKGLDSLTALQYDNKRKLIFVICDGMIVGGGNDRPTPKIVLDILGVDPKIDPPALPVKSIGQGNEQLNYGKVYSGLYEYEGNVVPYVVVVKVGKESEQNKSKPGNRGKRDSQVLLLNFLSRVHHRAPMSPLELEVFHQINNVIGVDPELYEYCLMVDADTSVREDSLNRLVAACANDARIAGICGETSLQNEERSWWTMIQVYEYFISHHLAKAFESLFGSVTCLPGCFCMYRLRTADRGRPLIISEKLLEEYSDNNVDTLHKKNLLALGEDRYLTTLMTKHFPTMSYKFIPDAFASTAAPETWSVLLSQRRRWINSTIHNLVELAALKDLCGFCCFSMRFVVMVDLLGTIILPATCVYLGYLIYRVASDTGPFPMISIVMLAGIYGLQAIIFIIKRQWQHIGWMIIYLCAYPIYSFILPLYSFWKQDDFSWGNTRVVIEEKGSKRIVAVEDEQFDPRSIPLQRWDDYALANNLPGRRGDYAVGQEKAFYGGRYMDDTAMEMDDMHSQYSSVKPASTILTGFPGQGRHSYMPPQSPAPFGGNVPGNRNSHFSTFSRYTDQPLQSNSHLQTRHMSMGNLSQLESSGMTNRHSVGMMQSTDNLLRPNSRSPVGFNSRPASAFDFRAGMNGPDEGAITEAIRSCLAEVDLDTVTKKQVRALVEQRLQTTLVGDKRTFLDRQIDNELANM

SEQ ID NO: 335 - protein, 557 aa, Pseudomonas savastanoi
MYDHFNSPSIDILYDYGPFLKKCEMTGGIGSYSAGTPTPRVAIVGAGISGLVAATELLRAGVKDVVLYESRDRIGGRVWSQVFDQTRPRYIAEMGAMRFPPSATGLFHYLKKFGISTSTTFPDPGVVDTELHYRGKRYHWPAGKKPPELFRRVYEGWQSLLSEGYLLEGGSLVAPLDITAMLKSGRLEEAAIAWQGWLNVFRDCSFYNAIVCIFTGRHPPGGDRWARPEDFELFGSLGIGSGGFLPVFQAGFTEILRMVINGYQSDQRLIPDGISSLAARLADQSFDGKALRDRVCFSRVGRISREAEKIIIQTEAGEQRVFDRVIVTSSNRAMQMIHCLTDSESFLSRDVARAVRETHLTGSSKLFILTRTKFWIKNKLPTTIQSDGLVRGVYCLDYQPDEPEGHGVVLLSYTWEDDAQKMLAMPDKKTRCQVLVDDLAAIHPTFASYLLPVDGDYERYVLHHDWLTDPHSAGAFKLNYPGEDVYSQRLFFQPMTANSPNKDTGLYLAGCSCSFAGGWIEGAVQTALNSACAVLRSTGGQLSKGNPLDCINASYRY

SEQ ID NO: 336 - protein, 455 aa, Pseudomonas savastanoi
MHEIITLESLCQALADGEIAAAELRERALDTEARLARLNCFIREGDAVSQFGEADHAMKGTPLWGMPVSFKDNICVRGLPLTAGTRGMSGFVSDQDAAIVSQLRALGAVVAGKNNMHELSFGVTSINPHWGTVGNPVAPGYCAGGSSGGSAAAVASGIVPLSVGTDTGGSIRIPAAFCGITGFRPTTGRWSTAGIIPVSHTKDCVGLLTRTAGDAGFLYGLLSGKQQSFPLSRTAPCRIGLPVSMWSDLDGEVERACVNALSLLRKTGFEFIEIDDADIVELNQTLTFTVPLYEFFADLAQSLLSLGWKHGIHHIFAQVDDANVKGIINHHLGEGAIKPAHYLSSLQNGELLKRKMDELFARHNIELLGYPTVPCRVPHLDHADRPEFFSQAIRNTDLASNAMLPSITIPVGPEGRLPVGLSFDALRGRDALLLSRVSAIEQVLGFVRKVLPHTT

SEQ ID NO: 337 - protein, 549 aa, Clostridium thermobutyricum
MKTTVGNYLIDSLKEYGVKHIFGVPGDYNLSFLDQIDDSEDIEWIGNCNELNASYAADGYGRIKGMAAIATTFGVGELSAVNGIAGSYAENVPVVKIVGIPSSKVVENRKLVHHTLGDGEFYRFNEMFKEVSVAQTILNEINAKEEIDRVLRECYLYKKPVYIGMPVDLATKVINVSEKTSYNLESDKNSLNSFISNVKSLMSNSKKQMILADFEVNRYNLNKELQEFVEASNLPVSSLAMGKGVIDETHPNFVGVYSGSLSNENITKLVKSCDLAFLIGVKLTDSITAGFSYINKNITLVEVHPLYCRIGENLFSNILMKDALESLKNLNVEFSKNDTPHVSLINNFEATNTPLTQKRFFQGIESFLNENDILIAEQGTSFFGSCLVNMKKGCTFIGQPLWGSIGYTVGALLGTQIADRNRRNILLVGDGSFQLTAQEVSTMIRENLSPIIMVINNDGYTVERLIHGPNRKYNDINMWDYSKLVSVFDLEGNRSISFKAKTEIELMNALKEADNNKDKLTFIEVCMDKMDSPQLLKDLGELFSKQNSY

SEQ ID NO: 338 - protein, 862 aa, Clostridium acetobutylicum
MKVTTVKELDEKLKVIKEAQKKFSCYSQEMVDEIFRNAAMAAIDARIELAKAAVLETGMGLVEDKVIKNHFAGEYIYNKYKDEKTCGIIERNEPYGITKIAEPIGVVAAIIPVTNPTSTTIFKSLISLKTRNGIFFSPHPRAKKSTILAAKTILDAAVKSGAPENIIGWIDEPSIELTQYLMQKADITLATGGPSLVKSAYSSGKPAIGVGPGNTPVIIDESAHIKMAVSSIILSKTYDNGVICASEQSVIVLKSIYNKVKDEFQERGAYIIKKNELDKVREVIFKDGSVNPKIVGQSAYTIAAMAGIKVPKTTRILIGEVTSLGEEEPFAHEKLSPVLAMYEADNFDDALKKAVTLINLGGLGHTSGIYADEIKARDKIDRFSSAMKTVRTFVNIPTSQGASGDLYNFRIPPSFTLGCGFWGGNSVSENVGPKHLLNIKTVAERRENMLWFRVPHKVYFKFGCLQFALKDLKDLKKKRAFIVTDSDPYNLNYVDSIIKILEHLDIDFKVFNKVGREADLKTIKKATEEMSSFMPDTIIALGGTPEMSSAKLMWVLYEHPEVKFEDLAIKFMDIRKRIYTFPKLGKKAMLVAITTSAGSGSEVTPFALVTDNNTGNKYMLADYEMTPNMAIVDAELMMKMPKGLTAYSGIDALVNSIEAYTSVYASEYTNGLALEAIRLIFKYLPEAYKNGRTNEKAREKMAHASTMAGMASANAFLGLCHSMAIKLSSEHNIPSGIANALLIEEVIKFNAVDNPVKQAPCPQYKYPNTIFRYARIADYIKLGGNTDEEKVDLLINKIHELKKALNIPTSIKDAGVLEENFYSSLDRISELALDDQCTGANPRFPLTSEIKEMYINCFKKQP

SEQ ID NO: 339 - protein, 417 aa, Clostridium sporogenes
MKFWRKYTQQEMDEKITESLEKTLNYDNTKTIGIPGTKLDDTVFYDDHSFVKHSPYLRTFIQNPNHIGCHTYDKADILFGGTFDIERELIQLLAIDVLNGNDEEFDGYVTQGGTEANIQAMWVYRNYFKKERKAKHEEIAIITSADTHYSAYKGSDLLNIDIIKVPVDFYSRKIQENTLDSIVKEAKEIGKKYFIVISNMGTTMFGSVDDPDLYANIFDKYNLEYKIHVDGAFGGFIYPIDNKECKTDFSNKNVSSITLDGHKMLQAPYGTGIFVSRKNLIHNTLTKEATYIENLDVTLSGSRSGSNAVAIWMVLASYGPYGWMEKINKLRNRTKWLCKQLNDMRIKYYKEDSMNIVTIEEQYVNKEIAEKYFLVPEVHNPTNNWYKIVVMEHVELDILNSLVYDLRKFNKEHLKAM

SEQ ID NO: 340 - protein, 578 aa, Clostridium beijerinckii
MNSYNNSNSPYQIDNPGECERHTMLEYILKLQNRLDDLENIIDLMSPPEEITNICPIGIAKDTKVAVIGAGEAGLAAAFELRKTGCNITLFEASQRIGGRVYTHYFDRNKKYYGELGPMSIPISHETTWHYINLFKLHTSPFVNNNDNALLYVRNERAVNDAKGKSVENNIYSKFNLSETEKKQIWFEFYGKIYEKYLKSLPTEVRRELIQVKAEYSDSIIDIDKLSYRNACKNMDVSQDFITMLGCLGGKEQFFNLSLTEMLQQYYTADFEYNYRITEGMINLPHSLYEALCDRNEEAYNGISKEQLGKIEIKMGFPICGIYNDSTKDKIILKYIDNRDNRKTSEEFDYVICAIPFSSLRRIEIEPLFTTKKIQAINEMNNETSHKIYLFLKERFWEMGNASKKIIGGCSFTDLPLTSIYYPSDHSKAVVNKYGKWVLKPGVTPNEEGVLLASYTWCQEAMRLGNESPELLIDDVIRYIEKVHGLTPHYLDDKVIDYKSLIWSDVQYIWTAGALSKPEDKTLFSYDVTVPEMENRVFFAGEHISQKHVSQQGALQTGMIAANEIAKQIKGKLNKENN

SEQ ID NO: 341 - protein, 327 aa, Clostridium saccharobutylicum
MSKQYPKFKAAAVQAAPVYLDLDATVEKSCKLIDEAASNGAKLVAFPEAFIPGYPWFAFIGHPEYTRKFYHELYKNAVEIPSLAIQKISEAAKRNKTYVCISCSEKDGGSLYLAQLWFNPDGDLIGKHRKMRASVAERLIWGDGSGSLMPVFETEIGNLGGCMCWEHQVPLDLLAMNSQNEQVHVASWPGYFDDEISSRYYAISTQTFVLMTSSIYSEEMKDMICLTPEQREYFDTFKSGHTCIYGPDGEPISEMIPAETEGIAYAEIDVEKIIDFKYYIDPAGHYSNQSLSMNFNQNPTPVVRKFGESKNKVISYEEINLSVGSEE

SEQ ID NO: 342 - protein, 472 aa, Clostridium tetani
MIIYYLKLEGFNMKIKYVAEPFRIKMVEPIKMLTREERELKIAEAKYNTFNLRGEDVYIDLLTDSGTNAMSDDQWAGVMKGDEAYAGGKSYFKLVDAVKDIFGYKFVQPVHQGRAAEKVLFGLLLGEGKYSISNMHFDTTRAHVELSGARAIDCVVPEASDPTVRIPFKGNMDVEKLEKLIKEHGADKIGVVVMTITNNSAGGQPVSIENMKETAEICKKYNIRLCIDAARYAENAYFIKQREPGYENKSIKEIIKEIFSYADIFTMSAKKDAIVNMGGLLGIKEDEELFQLCKGRTISFEGFITYGGLSGRDLESLAIGLYEGIDENYLRYRIGQMEYLAARLDEAGIAYQSPVGGHGVFVDAKSMFPHIPYNEFPGQVLAVELYKEAGIRTCEIGSYMLGNDPDTGEQLKADFEFTRLAIARRVYTQAHIDIMADALITIKERANTVKGYRITWEPPILRHFQASLEPLK

SEQ ID NO: 343 - protein, 462 aa, Citrobacter koseri [sequence omitted]

SEQ ID NO: 344 - protein, 471 aa, Shigella boydii
MENFKHLPEPFRIRVIEPVKRTTRAYREEAIIKSGMNPFLLDREDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 345 - protein, 471 aa, Escherichia coli
MENFKHLPEPFRIRVIEPVKRTTRAYREEAIIKSGMNPFLLDSEDVFIDLLTDSGTGAVTQSMQAAMMRGDEAYSGSRSYYALAESVKNIFGYQYTIPTHQGRGAEQIYIPVLIKKREQEKGLDRSKMVAFSNYFFDTTQGHSQINGCTVRNVYIKEAFDTGVRYDFKGNFDLEGLERGIEEVGPNNVPYIVATITSNSAGGQPVSLANLKAMYSIAKKYDIPVVMDSARFAENAYFIKQREAEYKDWTIEQITRETYKYADMLAMSAKKDAMVPMGGLLCMKDDSFFDVYTECRTLCVVQEGFPTYGGLEGGAMERLAVGLYDGMNLDWLAYRIAQVQYLVDGLEEIGVVCQQAGGHAAFVDAGKLLPHIPADQFPAQALACELYKVAGIRAVEIGSFLLGRDPKTGKQLPCPAELLRLTIPRATYTQTHMDFIIEAFKHVKENAANIKGLTFTYEPKVLRHFTAKLKEV

SEQ ID NO: 346 - protein, 473 aa, Vibrio vulnificus
MDNFKHLPEPFRIRVIEPVKRTTREYREEAILKAGMNPFLLDSEDVFIDLLTDSGTGAITQDMQAAMFRGDEAYSGSRSYHALANAVKDIFGYEFTIPTHQGRGAEQIYIPVLIKKREIEKGLDRSKMVALSNYFFDTTQGHTQINCCVAKNVYTEEAFDTGVKADFKGNFDLEKLEEAILEAGPANVPYIVSTITCNSAGGQPVSLANLKAVYEIAKRYDIPVIMDSARFAENAYFIQQREKDYQNWSIEEITRESYKYADGLAMSAKKDAMVQMGGLLCFKDESFLDVYTECRTLCVVQEGFPTYGGLEGGAMERLAVGLYDGMRQDWLAYRINQVEYLVNGLESIGVVCQQAGGHAAFVDAGKLLPHIPADQFPAHALACELYKVAGIRAVEIGSLLLGRDPATGKQHPCPAELLRLTIPRATYTQTHMDFIIEAFGKVKANAANVKGLEFTYEPQVLRHFTARLKEIDA

SEQ ID NO: 347 - protein, 454 aa, Symbiobacterium thermophilum
MPKGEPFKIKMVEPIRLIPREDRERALKEAHYNPFFLRSSDVYIDLLTDSGTGAMSQFQWSAMMLGDESYAGASSYYRLKETVTDITGYEYVIPTHQGRGAEKVAFSQLITRPGMYVLSNMFFDTTRGHVQLAGGRPVDLLIDVPTEEYHPFKGNMDTERLEQFIREHGAENIACIVMTVTNNSAGGQPVSMANIRETYQIARKYGVLVLFDVARYAENCHFIRMREEGYADKHPIDIAREMFSYGDGLMMSAKKDALVNIGGLLAFRDEELFTKVGAAVVPFEGFLTYGGLAGRDLEAMAVGLREALDPDYLAYRVGQVQYLGEMLRNAGIPIQWPVGGHAVFIDAAKFLPHVPWDQFPGHALTLALYLEGGVRTVEVGSLMIGRDPETGENVRGPFEFTRLAIPRRVYTNLHLEDVAETVINAFQKREEIRGVKFAREPKVLRHFTAWFDPA

SEQ ID NO: 348 - protein, 493 aa, Clostridium tertium
MNIKIQEKYQLYIGGEWKDSSDGTTIKTYNPANGQLLSEIADATEKDVDDAVKAAKKAFQTWGKTTPTERAIILNKIADIIDDNAEYLATIETMDNGKPIRETTGADIPLAADHFRYFAGVIRADEGVASNIDENTLNLILREPIGVVGQIVPWNFPFLMAAWKLAPVLAAGDTSVFKPSSTTSLSVLEFMKLIQDIVPKGVINIITGRGSKSGEYLQHNEGIDKLAFTGSTEVGREIGLSAAKRIIPATLELGGKSANIFFSDADMNMALEGIQLGILFNQGQVCSAGSRIFVQEDFYDEFIEKAVNAFEKVKVGNPLDPNTQMGAQVSEAQLNKILKYIEIGKNEGAKVITGGERFVEGDAKNGYFMKPTLLVDVNNNMRVAREEIFGPVGVVIKFKTEDEVIAMANDSNYGLGGGVFTRDINRAIRVAKSIRTGRVWVNTYNSFPAGATFGGYKESGIGRETHKSILDAYTQKKNIIVNLSEKPGGMYIK

SEQ ID NO: 349 - protein, 361 aa, Azospirillum brasilense
MELLSPRPGIGQIKPYRPARPPEDGAAWVDLSLTVNPLGPGKKALTAYRHMAAQIHRYPDWSQDRLRHAIARRYDLDAGHITCANGSDEMIHLVTQAFAGPGDEVLCHEHGYRGFMKAIRAAGATPVIAAERDLVVDVEAMIDRANERTKLCFLANPNNPTGTYIPSEMVLRLRAGLPSHTLLVLDSAYADYCRRDNYSDGTAIVENSDNVLMVRTFSKLHGLAGLRVGWAYGPAGVIEAVNQTRGPFNVGIAAQAAAEAAVGDTEHEEATFAHNSAWLPWLSHELEQLGVRVYPSVCNFILARIPTDPSLGVQAVLDHLARRGILVKPTLDYGLADCLRITVGREDENRALVAALGEILS

SEQ ID NO: 350 - protein, 550 aa, Pantoea agglomerans
MSTFTVGDYLLTRLQEIGIKHLFGVPGDYNLQFLDRVIAHPEISWVGCANELNAAYAADGYARCNGAGALLTTFGVGELSAINGTAGSYAEYLPVIHIVGAPATQAQLQGDCVHHSLGDGDFQHFIRMAAEVSVATALLTADNATAEIDRVIISALQARRPGYLSLAVDVAAMAVQPPAQPLNTHQPASADARRAFRAAAERLLAPAQRVSLLADFLALRWQQQSALAALREQSAIPCASLLMGKGVLDEQQPGYVGTYAGAASAGQVCEQIEQVDAAICVGVRFTDTITAGFTQQFATERLIDLQPFSASVGNERFAPLSMADALSELQPLFEHYGQQWQPAAAIPAAQPAEPTAVISQHAFWQAMQGFLQPGDLILAEQGTAAFGAAALRLPSRAQLVVQPLWGSIGYTLPAAFGAQTANPDRRVILIIGDGSAQLTIQELGSMLRDGQRLIIFLLNNDGYTVERAIHGATQRYNDIAPWNWTALPHALSLQGQAQSWRISETVQLDEVMTRLAAPQWLSLVEVVMLKDDLPPLLRKVTACLNQRNGG

SEQ ID NO: 351 - protein, 545 aa, Azospirillum baldaniorum
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLAGLVDALLEGLPPSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDKAFATRGRFQLIEAMIPRGVLSDTLARFVQGQKRLHAAPRE

SEQ ID NO: 352 - protein, 486 aa, Azospirillum brasilense
MSLPSYDCFIDGQWRPAHSRETLEILDPADGAVLARIARGGASDIDEAVRAAQTALPGWADCVPVQRGRVLHAIARRILEEQDRLARLESQDTGKPLAQAQADAVAAARFFEYYAGVADKVLGSSIPLGPDYADFTVREPLGVTAQIVPWNYPLQIASRGLAPALATGNTVVLKPAELACLSVLELTRICHEEGLPPGVLNVVPGLGQEAGYALAAHPGVNLVVFTGSVATGAQVMRTAADNIVPVLLELGGKSPNIVLADADLDDALPVLLKAAFPNSGQTCSAGSRVLVQRARHRELVDRLAALCHGLKVGPGLQNSDIGPLVSRAQQGKVLDYIAIARDEGAEVITGGTPLPGADLSHGNFVSPTLLDGARPEMRVHREEIFGPVLTILPFDEVEEAAALANATDYGLVAGIWGRDVGATNWLARTVKAGQIFINCYGAGGGVELPFGGYRKSGFGREKGLDALLSYTQVKNICTRIALPRRS

SEQ ID NO: 353 - protein, 476 aa, Azospirillum sp.
MDFDTNYRMTIGGDLVDAPASFAVLNPATRERIAEVPDAGKAQFAAAVSAARTAFKSWSLTPLAERQAAVHRIGQAIEANAESFVALLTREQGKPRPGAQWEILGAAHWCRAVAGQSLADEVLVDDGDRRVVTRRTPLGVVGAITPWNFPVLLSIWKIAPALVAGNTIIVKPSPFTPLCMLKLAELCREFLPPGVFSAVTGGDDLGKWMTAHPGIDKIAFTGHTETGKHVMRSAAGTLKRLTLELGGNDPAIVLPDVDPKAIAPQLFWASFQNNAQFCNATKRLYVHESIYDEVLAELVAYTKTVKVGNGADPDSMLGPIQNGPQYEKVCEYIDDCITQGYRFAGGGRVDRDAPGWFVPVTLVDNPPEDSRIVAEEPFGPVLPVLKWRDEADVVARANATRYGLGASVWGRDLDVVQRIAERLEAGTVWCNEIHQYSPDQPFGGHKESGLGCENALDGLAEYTNWQTLTLNVKPAF

SEQ ID NO: 354 - protein, 366 aa, Cupriavidus necator
MTAMMKAAVFVEPGRIELADKPIPDIGPNDALVRITTTTICGTDVHILKGEYPVAKGLTVGHEPVGIIEKLGSAVTGYREGQRVIAGAICPNFNSYAAQDGVASQDGSYLMASGQCGCHGYKATAGWRFGNMIDGTQAEYVLVPDAQANLTPIPDGLTDEQVLMCPDIMSTGFKGAENANIRIGDTVAVFAQGPIGLCATAGARLCGATTIIAIDGNDHRLEIARKMGADVVLNFRNCDVVDEVMKLTGGRGVDASIEALGTQATFEQSLRVLKPGGTLSSLGVYSSDLTIPLSAFAAGLGDHKINTALCPGGKERMRRLINVIESGRVDLGALVTHQYRLDDIVAAYDLFANQRDGVLKIAIKPH

SEQ ID NO: 355 - protein, 458 aa, Paenarthrobacter nicotinovorans
MAIATIDPTTGITLKTFDAHTPEEVENRIARAEAAFRSLQNTSFEERARWMHKAADILESEADEVARLIATEMGKTLTTAKYEALKSATGMRHFADHAQRYLSPETPVPASEVNASNLHVQFDPLGVVLAVMPWNYPLWQAVRFAAPALMAGNTGLLKHASNVPQCALYLGDLFARGGFPEGAFQTLLVEGKDVIPLVDDARIRAVTLTGSVAAGSAIAEAAGRNIKRSVLELGGMDVFIVMPSADIEKAAAQAVIARLQNSGQSCIAAKRFYVHEDVYDRFEHLFVTGMAEAVAGDPLDESTSFGPLATERGRQDVHELVRDAREKGAAVQCGGEIPEGEGWYYPATVLTGVTEDMRIYREECFGPVACLYKVSSLQEAIALSNDSDFGLSSSVWTNDETEATEAARSIEAGGVFINGLTASFPAVPFGGLKDSGYGRELSAYGIREFVNIKTVWTS

SEQ ID NO: 356 - protein, 445 aa, Bacillus subtilis
MEQQVKDDIQRVFQLQKKQQKALRASTAEQRREKLQRFLDSVIAHEEEIIEAIRKDVRKPYHEVKKAEIEGTKKAIRDNMNNLEQWMAPKEVGSSLSPDANGILMYEPKGVTLILGPWNYPFMLTMAPLAASLAAGNSAIVKLSDFTMNTSNIAAKVIRDAFDEKEVAIFEGEVEVATELLDQPFDHIFFTGSTNVGKIVMTAAAKHLASVTLELGGKSPTIIDSEYDLMDAAKKIAVGKFVNAGQTCIAPDYLFIKKDVQDRFAGILQTVVNAGFMEDDHTPDRSKFTQIVNDRNFNRVKDLFDDAIERGAEVVFGGVFDASDRTISPTVLKNVTPDMKIMQEEIFASILPMMNYEDIDEVIDYVNDRDKPLALYVFSKNQDLIDNVLQHTTSGNAAINDVVVHFSDVNLPFGGVNTSGIGSYHGVYGFKEFSHEKGVFIQAAE

SEQ ID NO: 357 - protein, 483 aa, Pseudomonas oleovorans
MTIPISLAKLNSSADTHSALEVFNLQKVASSARRGKFGIAERIAALNLLKETIQRREPEIIAALAADFRKPASEVKLTEIFPVLQEINHAKRNLKDWMKPRRVRAALSVAGTRAGLRYEPKGVCLIIAPWNYPFNLSFGPLVSALAAGNSVVIKPSELTPHTATLIGSIVREAFSVDLVAVVEGDAAVSQELLALPFDHIFFTGSPRVGKLVMEAASKTLASVTLELGGKSPTIIGPTANLPKAARNIVWGKFSNNGQTCIAPDHVFVHRCIAQKFNEILVKEIVRVYGKDFAAQRRSADYCRIVNDQHFNRINKLLTDAKAKGAKILQGGQVDATERLVVPTVLSNVTAAMDINHEEIFGPLLPIIEYDDIDSVIKRVNDGDKPLALYVFSEDKQFVNNIVARTSSGSVGVNLSVVHFLHPNLPFGGVNNSGIGSAHGVYGFRAFSHEKPVLIDKFSITHWLFPPYTKKVKQLIGITVKYLS

SEQ ID NO: 358 - protein, 495 aa, Staphylococcus aureus
MAVNVRDYIAENYGLFINGEFVKGSSDETIEVTNPATGETLSHITRAKDKDVDHAVEVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDVAKESDAQILAGGHRLTENGLDKGFFFEPTLIAVPDNHHKLAQEEIFGPVLTVIKVKDDQEAIDIANDSKYGLAGGVFSQNITRALNIAKAVRTGRIWINTYNQVPEGAPFGGYKKSGIGRETYKGALSNYQQVKNIYIDTSNALKGLY

SEQ ID NO: 359 - protein, 507 aa, Streptomyces coelicolor
MTRYAAPGTEGAIVSYQSRYDHFIGGEYVPPARGQYFENPSPVNGLPFTEIARGTADDVERALDAAHEAAPGWGRTSVTERSDILLKIADRMEANLERLAVAESWENGKPVRETLAADIPLAIDHFRYFAGAVRAQEGSLGEIDDDTVAYHFHEPLGVVAQIIPWNFPILMATWKLAPALAAGNAVVLKPAEQTPASIHYWLSLVADLLPPGVLNVVNGFGVEAGKPLASSPRVAKVAFTGETTTGRLIMQYASENIKPVTLELGGKSPNIFFEDVWARDDDFRDKALEGFTMFALNQGEVCTCPSRALVQRGVYAEFMEAAVARTELIKPGHPLDTDTMIGAQASNDQLEKILSYLDIGRQEGAKVLTGGERIEHDGELKGGYYVQPTIFEGHNRMRIFQEEIFGPVVSVTSFDDFDDAVKTANDTLYGLGAGVWTRDMNTAYRAGRAIQAGRVWTNCYHAYPAHAAFGGYKQSGIGRENHKMMLEHYQQTKNILCSYSPKKLGFF

SEQ ID NO: 360 - protein, 473 aa, Bacillus velezensis
MAYQDFREFLAALEKEGQLLTVDEEVKPEPDLGAAARAASNLGDKTPALLFNNIYGHHHAQVALNVIGSWPNHAMMLGMPKDTPVKEQFFEFAKRYDAFPVPVKREETAPFHENEITEDINLFDILPLFRINQGDGGYYLDKACVISRDLEDPDNFGKQNVGIYRMQVKGKDRLGIQPVPQHDIAIHLRQAEERGVNLPVTIALGCEPVITTAASTPLLYDQSEYEMAGAIQGEPYRIVKSKLSDLDIPWGAEVVLEGEILAGEREYEGPFGEFTGHYSGGRSMPVIKIKRVYHRNNPIFEHLYLGMPWTECDYMIGINTCVPLYQQLKEAYPNEIVAVNAMYTHGLIAIISTKTRYGGFAKAVGMRALTTPHGLGYCKMVIVVDEDVDPFNLPQVMWALSTKMHPKHDAVIIPDLSVLPLDPGSDPAGMTHKMILDATTPVAPETRGHYSQPLDSPLTTKEWEQKLMDLMNQ

SEQ ID NO: 361 - protein, 187 aa, Lactiplantibacillus plantarum
MKRIVVGITGASGTIYAVDLLEKLHQRPDVEVHLVMSAWAKKNLELETDYSLAQLTALADATYRANDQGAAIASGSFLNDGMVIVPASMKTVAGIAYGFGDNLISRAADVTIKEQRKLVIVPRETPLSVIHLENLTKLAKLGAQIIPPIPAFYNHPQSIQDLVNHQTMKILDAFHIHNETDRRWEGD

SEQ ID NO: 362 - protein, 624 aa, Fusarium oxysporum
MRFFSFNNKRDSHNHSKKDRTIPPSKPVFNSHFAKRQSSKIGEQKVRPQAWVDTPQIVYSAWNQAAGDIDQPLGTLPSNFSIALVGGGITNVVLAFNLVKAGADVTLIEATDDVGGRLRTIQTPDGVNVAEMGAMRFPPSEDLLYYYANEFNYTFIQNFPDPGKVPTVVFYQETPTSWVSQNVTVKGFEKVSNGWGSLISKGLTGGSQSITAATQLTKWLSSSDVDTRNQVIPEWQKYLDEFGNDSFYTALQRIFGENHEWDVPGGQVWTEDDFERFGTLGVGSGGFGAVYSAGFNSIFRLIVNGLESDQAIFAKMTDDGLQATGIRELANAIWQKATDLGLKTKFDTVAKITTGGGGDVDYVVIQETPSSDDGNSTADQAQYDLAVVGTSSRAMNFALADVSDTTNEPIMSSAVNRGITDLHMTASSKLFIRTKKFWSDQPADFPRVILSDTDLPQAYTLDYGHPDYGMVLLTYAWEDLSQTILAIQDPHKLLSILKEQIARIMRDSSYPNYADFLDPVTDDDVYLVHWPLDQYSYGAFSLGLPGQDKLISSMFYDYQKLNDTSSSRVLINSDCTSFLGGWVDGGLQPAHNSMAAIFERFGSLNPVAADFAPSVLLGASPYQY

SEQ ID NO: 363 - protein, 623 aa, Colletotrichum aenigma
MIPSFNYKKNTAYAPLTVRDTPSTNKKTSLYQLAKRQSTTPTEQKARPQAWVDTPQLIYSAWPQAAGDINQPLGTLPSDFKIGLVGAGITNVVLAFNLAKAGADVTLIEATDSVGGRLRSLPTPDGVNVAEMGAMRFPPSEDLLYYYANAFNYTFIQNFPDPGKVPTIVFYENNATDWVDSNTPPSGFEKVNNGWIKLISGGLTKGGSSALTAASKMTEWLSSSDATTRAQAVPEWQKYLDTFGDDSFYSALQRIFGENHEWDVPGGEVWTEDDFTRFGTLGIGSGGFGAVYTSGFNSVFRLVVNGLESDQAVFAKNTTSGLQPAGIRDLATTIWDKATELGVKTKFSTVAEVTSGGGDPLGGLAVGVRETTSSGTTDTEYDLVIVGTSNRAMTYAFTPVSETTEDPILSNEVQRGINDLHMTASSKLFIRTKKFWENQPAGFPRVILSDTNLPQTYTLDYGHPDYGMVLVTYAWEDLSLQMMAILDPKELLADLKTQVARIMQETDYAQYADYLTPVTDDDLYLIHWPLDRYSYGAFSLGLPGQDDDISAMFYDYEKFSINNQSSRVLINSDCTSFLGGWVDGGLQPAHNTLSAVFEQFGSLNPLAASLAPSALLNSSSYQY

SEQ ID NO: 364 - protein, 662 aa, Diplodia corticola
MPHIPNLRSYEKKTPHGIPKLIIGPPRTDSTDSTERGSVSVKPQGYLDNPSVIYSQWNQNAGGIEKRLGSFDSPPKVCLIGGGISNVVTAFELVKAGADVTLLEATGKVGGRLKSLAMPDSSDTNNVAEMGAMRFPPSEDLLYYYAEQNGFTFLPDFPDPGVKPTVISYQKSQYLWTNPKQPPPGFETVYGGWNEFISKGVTEHKGTEHVLMPSHQLQEMLKSPELSQRRAVIPHWQKYLEVFAHDSFYQGLQKIFGKKHQWDVPNGNVWTQDDFSRFAALGVGSGGFGPMFPISFNTIFRMIPNGLETEQQVFAKAQDSGPPSPAGIQDLAATILQKTIDLERKFTFKPNTTGDVVNLKGDPSSGVTHMTVDVSEAPTNGGSAATNTYNLVIVGTTTRAMDVNMSISNLDPEDQPYFSNSVCEAINDIHMASSSKLFIRTAKFWERDPPDPNFPRLILSDTKLPQLYTLDYGNRDYGMVLVTYAWEDLSTKISAQTDPMALLAVLKKQAASIMKHTHYPAWASNLVPVNSGDDGFLVHWQLDPQMEGAFALGYPGQDGLTHRMFFDFTKLVTGKEALAPVLLGGDSISFTGGWIEGGLQCAMNNVSAVLKAYGTLEPRAAKFAPVNLMRSEDYGYKEPRGGARGAVRDTKGGGGKVDEFVR

SEQ ID NO: 365 - protein, 599 aa, Yarrowia lipolytica
KPAFNSHFAKRQSSKIGEQKVRPQAWVDTPQIVYSAWNQAAGDIDQPLGTLPSNFSIALVGGGITNVVLAFNLVKAGADVTLIEATDDVGGRLRTLQTPDGVNVAEMGAMRFPPSEDLLYYYANEFNYTFIQNFPDPGRVPTVVFYQETPTSWISQNVTVKGFEKVSNGWGSLISKGLTGGSQSITAATQLTKWLSSSDVDTRNQVIPEWQKYLDEFGNDSFYTALQRIFGEKHEWDVPGGQVWTEDDFERFGTLGVGSGGFGAVYSAGFNSIFRLIVNGLESDQAIFAKMTDDGLQATGIRELANAIWQKATDLGLKTKFDTVAKITSGGGGDVDYVVIQETPSSDDGNSTADQAQYDFAVVGTSSRAMNFAFADVPDTTNEPIMSTAVNRGITDLHMTASSKLFIRTKKFWSDQPADFPRVILSDTDLPQAYTLDYGHPDYGMVLLTYAWEDLSQTILAIQDPHKLLSILKEQIARIMRDSSYPNYADFLDPVTDDDVYLVHWPLDQYSYGAFSLGLPGQDKLISSMFYDYQKLNDTSSSRVLINSDCTSFLGGWVDGGLQPAHNSMAAIFERFGSLNPAAADFAPSALLGASPYQY

SEQ ID NO: 366 - protein, 623 aa, Colletotrichum aenigma; identical to SEQ ID NO: 363

SEQ ID NO: 367 - protein, 649 aa, Fusarium proliferatum
MNSKHALVMLWPTAIAALTVSNSSSSSILLDNQDQIFSADDSQYLAVTSDILSSVSYSSDTAQGPVTYISGLLSSTTADELEDVIKSSLEQDDVFTEAFLGTVLVSAGDEGDIDSSVVSYFSSLNATVIYGGKDGPSLCGNSTLTPCPMFGLADGDSLRLSKVFRLYVDTYRTFMVGIYEAEDGYRTLPYSNSEWGAPSIPVPSRLYSIEDDRPLAGKRIGVKDIYDLEDIQTTAGSLAYASLHSKADTTAPALQRIIDQGGVVVGKQKTAQFASPQSPWDWNNAFYPRNPRGDTFLTCSASSAGSACSIAAYDWLDFAVGTDTGKSIREPAAVAGIFGNRPSQGMISMDNIITNAFNTDTAGVFARDPVAWAKFAKAWYDPSLHQDTSINGLPALSVPDAQTFPKRLLYPVDHLPMQNPAAEAILQKFLDDVADAVGVTVDKINLTQTIEETLDRPLQGMLDDLTVLWTHDLITETAEPLISNYSPGFPPIDEPYRSFFRNAVSDDSSYKSAMANRTRDAALWHKQVLFSTNSSCSESILLYDIGTGGLPSFREKDLNDSPGAASPVDPRGPKAVSTISSYFGDVDITVPIGQVSYQSNVTFQEEVMPVTVNMVAKRGCDFVLFNLINKLVSKGVLSSVDTGKQAFQE

SEQ ID NO: 368 - protein, 589 aa, Thelonectria olida
MQNLQACLSAVTRDKLENIVERYLAEDDVFAAGFLNKVIVTSQSPGFIDIASIDDLQQSDLDIIHLNTEGYYAQGSSSSSDSTLPPGPLYAIANGTSLQLSKVYRLYEDSYRTFVGGVYESNGRQKSLNYFEPHWGYPMIPVPSRLYSIGDQRPLAGKRIGVKDIYDIEGIKTTRGSRAYSQVYGPANATASSIRRIIDLGGAVVGKQKTAQFASAAHAWEWTDAYYPQNPRGDGFLSCSASSSGGGCSIAAYDWLDVAIGSDTGQSVRQPAAFSGTYDNRPSQGLMALDCVMPIAYGTDTAGFFSRHPEEWIAFAKAWYDPSFYQDQSLNRLPELSVPDERTFPKRILYPVDHLPLPNGAAEEILQQFLKDVANLLDATVENFNLTETVEKATERSLPDILRDLDVLWYHDLRKDVAMPLLEKYKPGFPPLDKPFRDSFRKFAFNDAQYEAALQNRSRDAELWHEKVLYQTDESCSESIFIYDIGTGGLPSFREKELNQSPGAALPAACRTAGAAPIISSYFGDVDITIPIDQVAYFSNVTYEEVLMPVTVNLVARRGCDFVLFNLVGELAKKGIVKPVLTGRQAYAS

SEQ ID NO: 369 - protein, 644 aa, Tricholoma vaccinum
MLFGFFAVLYTLVVNCIFAAAVLEVIEDNASGSILRIGGIVYLAPHFPYATYKPKRSGIPSSPGFTAVTSIRTNLSPITKTHLQQQLTLFSEFDDVYSDRFMDSLFISYDGTGSAVFEADVGSWLESLKIQHLLKPSMSLRSREDHHLALFSLPRPRKEIFSTCTVHIACIKTNTKPSYDSGQQYIPVPSRLSVWTQSLPLTGTRFALKDIYNAQGLVTGAGSLAYARVHGEANTTAPSIQRLLALGATMVGKVRTSQFAHGANPWDFLDIPYCWNPRADGYLTASASSSGSACAIAAYEWLDFTVGSDTRGSVRKPATLVGAYGIRPSHGSMDLTGVLPLSEEMDTAGYFARDPRFFSEIGRLWLVDPLNPLLSYEGSPVKAKGRLSQLPSKLLYPIDHFPVKNPAAQRLFDSFADILHEHLNISKVPINFTDALLPYLPNGNFHEFQLLCDRLGEYRTWKSVGEPLIAKHQELFGSTPSFDIRPRAMFAQGSKLSDEDFAEAVTFKRTFAKSVSEHLIRADDKSCSDSIFMYDAGTGGLPSYRVEDFNSLSGSTPFVLTTTVAGSKASEYFTYIGSMGGLPEITVPIGQVGYYSQVSRHWEVLPVAVQLVAHPGCDEMLFQLVEDLAAAGVLKSVKVGTEAF

SEQ ID NO: 370 - protein, 548 aa, Emericella nidulans
MPQSWEELAADKRARLAKTIPDEWKVQTLPAEDSVIDFPKKSGILSEAELKITEASAADLVSKLAAGELTSVEVTLAFCKRAAIAQQLTNCAHEFFPDAALAQARELDEYYAKHKRPVGPLHGLPISLKDQLRVKGYETSMGYISWLNKYDEGDSVLTTMLRKAGAVFYVKTSVPQTLMVCETVNNIIGRTVNPRNKNWSCGGSSGGEGAIVGIRGGVIGVGTDIGGSIRVPAAFNFLYGLRPSHGRLPYAKMANSMEGQETVHSVVGPITHSVEDLRLFTKSVLGQEPWKYDSKVIPMPWRQSESDIIASKIKNGGLNIGYYNFDGNVLPHPPILRGVETTVAALAKAGHTVTPWTPYKHDFGHDLISHIYAADGSADVMRDISASGEPAIPNIKDLLNPNIKAVNMNELWDTHLQKWNYQMEYLEKWREAEEKAGKELDAIIAPITPTAAVRHDQFRYYGYASVINLLDFTSVVVPVTFADKNIDKKNESFKAVSELDALVQEEYDPEAYHGAPVAVQVIGRRLSEERTLAIAEEVGKLLGNVVTP

SEQ ID NO: 371 - protein, 545 aa, Aspergillus oryzae
MPSASWEDLAADKRARLEKSIPDEWKFKSVPIEGSVIDLPEKSGILSPSEIKITNSSATELVAQLANGTLKSVDVTLAFCKRAALAHQLVNCAHDFFPELALAQARELDRYFETHKKPVGPLHGLPISLKDQLRVKGTETCMAYISWLGKRDTSDSILTALLRKAGAVFLVKTSVPQTLMVCETVNNIIGRTSNPRNLNLSCGGSSGGEGAMIAMRGGAIGIGTDIGGSIRVPAAFNSLYGIRPSHGRLPYGGMTNSMEGQETIHSVVGPIAHSAQDVRLFLQSVLKEEPWKYDSKVIPLPWREAEENAAQAKIAEKSLNFAFYDFDGVVRPHPPITRGVEIVRSTLEKDGHTVAPWTPYKHAFAVDLANKIYAADGSTDVYKHINASGEPAIPNIKDLMNPNLPKADLNEVWDAQLQKWRYQCEYLDKWREWEERTGKELDAIIAPVAATAAVRHNQFRYYGYATVFNVLDYTSVVVPVTYADKAVDHRLADYQPVSDMDKAVYAEYDPEVYHGAPVAVQIIGRRLSEERTLAIAEYVGKLLGH

SEQ ID NO: 372 - protein, 530 aa, Gibberella moniliformis
MAEVNWQQLINQKRATREALIPEQWLLPATITSKVTPQSTASAFELLSEAGLLTEREIDITEKYTAVSLTAKIATGELSSYDVATAFCKRAAIVHQLTNSLTEIFFDKALERARWLDEYLSKEGKTVGPLHGLPITLKDMIHVKGQYSTMGFVGHLRHPPADENAVITDMLEAAGAVFYCKTNVPQTLFVCESFNNVFGRTLNPYKLCLSPGGSSSGEAAQLGLCGSIMGVGSDIAGSVRVPAIFTGVYGFRPTVNRLPWSKQAELALKGWQGVQPTLGPMARTAQDLTLFMKTIIQAEPWRYDSTALAIPWHDAPRKDKLTIGVWSQDPQFPVFPPIARTMASAVGRLRAAGHTIKIIEAPPTMKAMKIAMRWFALDQVNLPLKFVQDGAESPIADLDAMDPGKFLDPGYVADLSENISISADIHDYREEWAKIWREAGIDVLLCPASRGSAVPHGEFGPLMYTIPWNLLDFPSSVVPFGKADKTLDSKDGYDSTVVDGAPTGFQLVGWRFQDEQTLMATEVIADTLKA

SEQ ID NO: 373 - protein, 549 aa, Saccharomyces cerevisiae
MTVHSTWKEKVQLKKDQLNSKIKDEWKLNSTTITRLKNDKKNLIKNIDDLCSSSENQITHSTIMALRQALEAKELSCHEITAAFCHRAALIHQVVNCLSEIMFSEALRLADYYDSNRPAILPPLYGIPISLKDQCNVEGVDTSLGYLCRTFKPKTKNEESLIVSFLRDLGAIIFVKTTVPSSMMATDTQSNTFGYTYNSINLSFSSGGSSGGEGSLIGAHGSLLGLGTDIGGSIRIPSSYQGLFGLKPTFGRVPYLRVDNSFEGRETIPSVIGPLARDLSDLRYFMSCVINICQPWVQDVKCIPYHFDSSTSKLHDNYVVGIWYGDGVIDPPPSDIRALKTCEDLVNKTKGMKAVKWEPSSELSRELFDLANEADVADSGNEIKNEFEISGEPLLDILKPMVLENGRPPYTVNEWWDLTKRVYNAQQLMRDYYLSFPESERPDVIISPTTLMPFRPGDMLKTTLRYILLFNVLNFPSLSIPVGSVDCQIDGLMDTTSALNPEDKMIKTYWNDLIQSGEIDGFPIGLQVVSPTFNDNEVCKFASWLFSKI

SEQ ID NO: 374 - protein, 497 aa, Ustilago maydis
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 375 - protein, 482 aa, Leucosporidium creatinivorum
MSLGLFINNKFVPGVEGRTIDVLNPSNDKKIAVVSEAGAQDIDIAVDAAEKAFNTVWGEKVPGFERGRMLIALAEAFEANAETLASIEALDNGKAYGFAKGFDVAEAAACLRYYGGWADKNHGKTIETHDKKLAFTRHEPVGVVGQIIPWNFPILMFAWKLGPALATGNTIVIKVAETTPLSAFYAARLIADIFPPGVVNIVTGYGAIAGAAISSHMKISKVAFTGSTLVGRQIMKAAAQSNLKSVTLELGGKSPNIIFDDADLEQAVSWSTFGLFFNHGQCCCAGSRIYVQESVYDKFLELLTAKVKSIKVGSPFAADTFQGPQTSQLQFDRISEHIKSGKDEGATVHIGGERHGTEGYFLQPTIFTDVKPHMRIVKEEIFGPVVVVAKFKDEADIIAQANDTMYGLAAAVFSRDVSRALNTAKQLKAGTVWVNCYNQLHSQTPFGGYKQSGIGRELGEYALANYTSVKAVHINLEQPHPL

SEQ ID NO: 376 - protein, 482 aa, Ustilago maydis
MTVGVASKLLDAPFSHVINGKSVDTQGFKTLDVIDPATEKAIAQVPIATKETVDQAVDAAHAAFPSWSKTTWDERAKLLEQYGEEYKAMLPELVKLLTAEQGKSIQFAQHECETILPWFTELAKVRLDEKVVHENDTHKAIERYVPLGVCAGIVPWNFPVLLMLWKVTQAIVTGNCIIIKPSPFTPLCDIRIIEAAQKVFPPGVVQIVVGDDNLGPWITEHPRIQKISFTGSTATGKLVAKSCSATLKRFTLELGGNDPLVVLPQQKDLAATAQNVLLAAFFNSGQVCIAAKRIYIHEDIYDEFKATLAQVVQHFKVGPGNEEGVMFGPINNKMQYNKVGEFFEEAKKNNFNLVAGGQVEEKPGFFYPLTIVDNPPENSRLVQEEPFGPIVPLLKWKDEADLVKRINDSQWGLGASVWSSDIQAAERIGRQIESGTIWINCLVHHHPAVPFGGFKSSGIGAEHGKNGLGAYCQVQALWIPKA

SEQ ID NO: 377 - protein, 300 aa, Rhodotorula toruloides
MSTFSVHTLNDGNKVPGVAFGIGTAHFGNDDDNLVETLKTAISAGFRHLDGAEAYRNEGSLGKAIAQSGVPREELFVTTKAGTGLADIPSSFDESLKKLGLSYVDLYLIHWPYDFCKASYPSIQEAWKQMEAIKDSGRAKSIGVSNFRVRDLEKIYSLPDLKHPPAVNQIEFHPFMYEAGEELYQYMKNKQIALEAYGPTSPLTKLLNPGFEEALNNVTKSVASRARKDKVEPGQVLLRLAAQRGAIVVTTSGKDWRMREQLAAGALPELTQDEVDSLVKAAKPAPQRVFMKHMDGDDEY

SEQ ID NO: 378 - protein, 299 aa, Fusarium oxysporum
MGSVATKDVPTYKLNDGNEIPVLAFGLGTAQYKKDPESGLDQHVVDITTKAIKTGYRHLDGAEVYGNEEELGQAIKAGGVPREQLYVTTKIPAEKKGSAIDSFNVSLQKLGLEYVDLYLIHGPWFAETDEDLQQRWAELEQIKESGKAKSIGVSNFLQSHLEAVLKTAKIKPAINQIEYHPYLQHGDLVDFHKKHNIAVSAYGPLTPIVTAKGGPVDPFYTKLAEKYKVTESEVGLRWVIDQDIIALTTSNKVERLEGYLAKLPKFKLTQDEIAEISRLGAKKHFRGFWRNKFDENDRS

SEQ ID NO: 379 - protein, 788 aa, Scedosporium apiospermum
MAPVIDIGLDGRSPRLYITDEEDVRTAEYVTLSYYWGKSNGPARTTKNNLEARRREINTAELPQTIRDALLITKHLGVRFLWVDAICIVQPTDQDRSDWLNEAPKMGQYYSNAACTIAACVASDSAEGFLHERPLEKLQPERECPLEPWTPSPKLFPEPPAHVTVLKPSPSRLGFRVASSPLYKRGWTLQEQILSTRTMYWTKHALFWGCAEERAAEFRPDGLSASSFPGHITLSQFLSSNADKALGNMWLSVVAHYSSASLSHESDRLAALMGLASRLQDHFGDEYLFGIWKSQLLAGIAWQSVVRSHHRIREGMACTLPSWSWVSLRAPVIFPLDCPLEIEWLAEVVAVEGETNVLNPVGEKVFECRVRIKGKVILIDQVPPDTVQFGKEDQEWDLGGQRRTVEILMAEMDCSPKPHPNNDLGCLVLASWGMDQTATARIELSCLFLAGFSFFLGSLLPLSSLPRYSNNHPTNIVSRYPKVKSNMSAPKIPTIKLNDGHEIPVLAYGLGTARATRGGPLDTSLVELTKKAIATGFLHLDGAQMYGNEAELGEAIRTSPTPRSSLFITTKYSYYTAPTPATFSASLSKLGLDYVDLYLIHHPFCGGSSGTSLAPYDPAKLQQTWADLEQLQREGKIRSIGVSNFLREHLEVVLETAKVVPAVNQIEFHPYLQHRGLLDFHREKGIVTEAYGPLTPIVRAVEGPVAAIYNRLAEKYGVSESVVGLRWVIDRGVVAITTSSKEERLRSYIEKVPSFKLTEEEVKEISEAGLQKHYRAFFTNRYPEDDRS

SEQ ID NO: 380 - protein, 575 aa, Saccharomyces cerevisiae
MAPVTIEKFVNQEERHLVSNRSATIPFGEYIFKRLLSIDTKSVFGVPGDFNLSLLEYLYSPSVESAGLRWVGTCNELNAAYAADGYSRYSNKIGCLITTYGVGELSALNGIAGSFAENVKVLHIVGVAKSIDSRSSNFSDRNLHHLVPQLHDSNFKGPNHKVYHDMVKDRVACSVAYLEDIETACDQVDNVIRDIYKYSKPGYIFVPADFADMSVTCDNLVNVPRISQQDCIVYPSENQLSDIINKITSWIYSSKTPAILGDVLTDRYGVSNFLNKLICKTGIWNFSTVMGKSVIDESNPTYMGQYNGKEGLKQVYEHFELCDLVLHFGVDINEINNGHYTFTYKPNAKIIQFHPNYIRLVDTRQGNEQMFKGINFAPILKELYKRIDVSKLSLQYDSNVTQYTNETMRLEDPTNGQSSIITQVHLQKTMPKFLNPGDVVVCETGSFQFSVRDFAFPSQLKYISQGFFLSIGMALPAALGVGIAMQDHSNAHINGGNVKEDYKPRLILFEGDGAAQMTIQELSTILKCNIPLEVIIWNNNGYTIERAIMGPTRSYNDVMSWKWTKLFEAFGDFDG

SEQ ID NO: 381 - protein, 497 aa, Emericella nidulans
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 382 - protein, 532 aa, Saccharomyces cerevisiae
MSNDGSKILNYTPVSKIDEIVEISRNFFFEKQLKLSHENNPRKKDLEFRQLQLKKLYYAVKDHEEELIDAMYKDFHRNKIESVLNETTKLMNDILHLIEILPKLIKPRRVSDSSPPFMFGKTIVEKISRGSVLIIAPFNFPLLLAFAPLAAALAAGNTIVLKPSELTPHTAVVMENLLTTAGFPDGLIQVVQGAIDETTRLLDCGKFDLIFYTGSPRVGSIVAEKAAKSLTPCVLELGGKSPTFITENFKASNIKIALKRIFFGAFGNSGQICVSPDYLLVHKSIYPKVIKECESVLNEFYPSFDEQTDFTRMIHEPAYKKAVASINSTNGSKIVPSKISINSDTEDLCLVPPTIVYNIGWDDPLMKQENFAPVLPIIEYEDLDETINKIIEEHDTPLVQYIFSDSQTEINRILTRLRSGDCVVGDTVIHVGITDAPFGGIGTSGYGNYGGYYGFNTFSHERTIFKQPYWNDFTLFMRYPPNSAQKEKLVRFAMERKPWFDRNGNNKWGLRQYFSLSAAVILISTIYAHCSS

SEQ ID NO: 383 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 384 - protein, 515 aa, Talaromyces stipitatus
MAPNFPPIEEALPLHHDLFYDGKWQTPITDSRRETLNPSTGQVIGKIADASTTDVDKAVEAAHKAFLSWKKTTMAERQGYMRRAAAILREHAAELALVESYNTGNPVAAMVIDAERAANALDYFAGLIPMLRGEVLPGPFPTEDYLHYTVREPMGVVARFVASNHPFMFAGARMASVIAGGNTVIIKPPEQAPLSCLRLAELLENVFPPGVVNILPGGAECGQALTCHPLVRKVSLIGSVATGKIIMRNAGSLMKQTSMELGGKNALIAFPDADIDHLVRSVAAGMNFTWAGQSCGSTSRVFLHDSIHDEVLARVVEVVRKGFRPGLATDPTTTMGSLISKAAQDRVLNYIASAREEGARLVTGGGMFDDLAGTPVEGGFFVQPTIFADVTPDMKIAREEIFGPVMSVLRWSDESELIRIVNSTNYGLTGSIFTKDLATAQRMIRQVEAGFVWVNDVCKHFLNVPYGGIKDSGIGRDECIDELFAYTNIKSVNINLGGATHLGSRLSQAGQISNT

SEQ ID NO: 385 - protein, 496 aa, Davidiella tassiana
MTSVQLETPHSGKYEQPTGLFINNEFVKGQEGKTFDVINPSDESVITQVHEATEKDVDIAVAAARKAFEGSWRQETPENRGKLLNNLANLFEKNIDLLAAVESLDNGKAISMAKGDISMCVGCLRYYGGWADKITGKVIDTTPDTFNYVKKEPIGVCGQIIPWNFPLLMWAWKIGPAIACGNTVVLKTAEQTPLGGLVAASLVKEAGFPPGVINVISGFGKVAGAALSSHMDVDKVAFTGSTVVGRTILKAAASSNLKKVTLELGGKSPNIVFEDADIDNAISWVNFGIFFNHGQCCCAGSRVYVQESIYDKFVQKFKERAQKNVVGDPFAADTFQGPQVSKVQFDRIMEYIQAGKDAGATVETGGKRKGDKGYFIEPTIFSNVTEDMKIVKEEIFGPVCSIAKFKTKEDAIKLGNASTYGLAAAVHTKNLNTAIEVSNALKAGTVWVNTYNTLHHQMPFGGYKESGIGRELGEDALANYTQTKTVSIRLGDALFG

SEQ ID NO: 386 - protein, 497 aa, Aspergillus niger
MSDLFATITTPNGVKYEQPLGLFIDGEFVKGAEGKTFETINPSNEKPIVAVHEATEKDVDTAVAAARKAFEGSWRQVTPSTRGRMLTKLADLFERDAEILASIEALDNGKSITMAHGDIAGAAGCLRYYGGWADKIHGQTIDTNSETLNYTRHEPIGVCGQIIPWNFPLLMWAWKIGPAIATGNTVVIKTAEQTPLSGLYAANVIKEAGIPAGVVNVISGFGRVAGSAISHHMDIDKVAFTGSTLVGRTILQAAAKSNLKKVTLELGGKSPNIVFNDADIDNAISWANFGIFYNHGQCCCAGSRILVQEGIYDKFIARLKERALQNKVGDPFAKDTFQGPQVSQLQFDRIMEYIQHGKDAGATVAVGGERHGTEGYFIQPTVFTDVTSDMKINQEEIFGPVVTVQKFKDVEDAIKIGNSTSYGLAAGIHTKDVTTAIRVSNALRAGTVWVNSYNLIQYQVPFGGFKESGIGRELGSYALENYTQIKAVHYRLGDALF

SEQ ID NO: 387 - protein, 458 aa, Cryptococcus gattii
MTATTISTETVPQAPAPGTKTNGTLGKYNPRNYLSDRAKVTEIDGIRGLMACEGPGVVSFLAGRPNPDTFPFNSITLNLKPPLGLPESSNNMPVSITIEDPDLAIALQYAPSAGIPKLREWLADLQAHVHERPRGDYAISVGSGSQDLMFKGFQAVLNPGDPVLLETPMYAGVLPALRILKADYAEVDVDDQGLSAKNLEKVLSEWPADKKRPRVLYTSPIGSNPSGCSASKERKLEVLKVCKKYDVLIFEDDPYYYLAQELIPSYFALEKQVYPEGGHVVRFDSFSKLLSAGMRLGFATGPKEILHAIDVSTAGANLHTSAVSQGVALRLMQYWGIEGFLAHGRAVAKLYTDRRAQFEATAHKYLDGLASWVSPVAGMFLWIDLRPAGIEDSYELIRHEALAKGVLGVPGMAFYPTGRKSSHVRVSFSIVDLGDESDLGFQRLAEAIKDKRKALGLA

SEQ ID NO: 388 - protein, 470 aa, Tricholoma vaccinum
MLVTVSSRRPSPPVQNLLLHPLSKSSLQTFTPPFSLMLRIIVCPASVVRGLLPLEDTPGIISLLSGKPNPDTFPFTSFTFTARSPINSKEDTILTIEGKELAQGLQYGPTAGEKQLISWIEGLQEFSHGRKKNEGWRVSIGTGSQDLIFKAVTALVNPGDSVLLETPTYAPAFPVVPHLPLLNMGCKVVMGLIYLRAAIYRKLASRQAKAQGFVYSPCKDVDIRQKYGCNPTGMTATLERRKEVLLLAREHNFIILEGMYDPYYYLYYGTAPRYPSYFALELEEPEVGRVLRFDSLSKILSAGIRLGFVSGPAPLVQAIDQCTSTSNLQTPSLTQIIIYKLLNSWGYDGFKIHTENVSVFYREKRDIFERAMRTHLSGLVEWSPPVAGMFIWFKLLLNGEPGEEEDSYDVILSKGLERGVLALPGAGFFPNSRKTAYVRVSFSAAPEPEVDEALKRLREAIIAARATNKK

SEQ ID NO: 389 - protein, 381 aa, Tremella mesenterica
MTLNLKPSLDSTAPKGPTSITIQGTDLEDALQYGPSPGLVGLRGWLSGLQETVHKRPIGDSWGITMGTGSQDLMVKAFGAVLNRGDPILLEAPLYAGVLPSLKNLEAELIEVDVDDQGLSAKNLERVLASWPTDKRRPKAVYSNPTGCNPSGCSASRERKLEVLEVCRKYNLLMIEETDYLSSPLQPSYFELETEVFPHGGHVIRFDSVSKLFSAGMRLGFATGPKALINAIDVAHAANNLHTSSISQAVALALMQHWGIKGFLAHSTAVAHFYAERREKFEALAHKHLDGLATWVSPKAGMFLWIDMSPSGIDDSMELISKEALAKGVLAVPGFVFYPLKRKSAHVRVSFSLVDLDSEAELGFQRLAEAIRDKRRQMGFE

SEQ ID NO: 390 - protein, 479 aa, Ustilago maydis
MSSATSPALDYALLLSSSARNRMPSAIRSLFPAELIPGMVSLLSGKPNSETFPFQRISLELKPSIHLEGQTETVSIEGSDLDIALQYSATSGLPKLVDWIIKFQSRVHARKQVDEGNKPGEVWRCSFGNGSQDLLTKTFEALVDAGDSVVLESPAYSGILPSLVAHKANLFEAETDAEGVEPTALDTLLTNWKTDSATRDSRFPKFLYTTPTGANPSGTSASDNRKRAILDIIRKHNLLLLEDDPYYFLSFQGLEPGADAVKRTRGKSYFQLEAQDDYGVGRVVRFDSFSKILSAGLRLGFVTGPKEILDAIDLDTSSRNLQTSGTSQAIAYALLSKWGIDGFLHHADNVARFYQNRLERFEASAQAILTGSPSIASWVRPSAGMFLWIKLKLPPSPDSAEGDSFDLISNKAKAAGVLALPGVAFKPPSSSSTGGKRKTSAYVRTSFSQVPLDQVDTAFTRLRQVVEEAWREAGLQIPA

SEQ ID NO: 391 - protein, 513 aa, Saccharomyces cerevisiae
MTAGSAPPVDYASLKKNFQPFLSRRVENRSLKSFWDASDISDDVIELAGGMPNERFFPIESMDLKISKVPFNDNPKWHDSFTTAHLDLGSPSELPIARSFQYAETKGLPPLLHFVKDFVSRINRPAFSDETESNWDVILSGGSNDSMFKVFETICDESTTVMIEEFTFTPAMSNVEATGAKVIPIKMNLTFDRESQGIDVEYLTQLLDNWSTGPYKDLNKPRVLYTIATGQNPTGMSVPQWKREKIYQLAQRHDFLIVEDDPYGYLYFPSYNPQEPLENPYHSSDLTTERYLNDFLMKSFLTLDTDARVIRLETFSKIFAPGLRLSFIVANKFLLQKILDLADITTRAPSGTSQAIVYSTIKAMAESNLSSSLSMKEAMFEGWIRWIMQIASKYNHRKNLTLKALYETESYQAGQFTVMEPSAGMFIIIKINWGNFDRPDDLPQQMDILDKFLVKNGVKLVLGYKMAVCPNYSKQNSDFLRLTIAYARDDDQLIEASKRIGSGIKEFFDNYKS

SEQ ID NO: 392 - protein, 458 aa, Cryptococcus gattii; identical to SEQ ID NO: 387

SEQ ID NO: 393 - protein, 605 aa, Tricholoma vaccinum
MSSSEATLQAEVDRLRNEVQVLKEEQLGKSTKISIGNYILARLEQLGITVRQSMFGVPGDFNLGFLVRVFFVYQDLVEEHPTIDWVGNWYCLGLSLYLLYAADRTDRSNELNAAYAADGYARVKESIGVVLTTFGVGELSAINGIAGAFSEMVPVLHLVGVPSTAQQKDKPMLHHTLGDGRYVEIRHVTFFHRDSLLDTTHMTRLQNNSRIRGQARPVYLSVPTNLVLAKISSAPLRLPLNRNPPRNSRDEEAYVLDIISKQVEAAGGDVVVLVDACTIRHGVREEVNDFLRKTGFPVYAAPMGRTAIDEDYERFGGVYMGSITKRDVKRKVEFAKLILSIGSLKSDYNTGNFSYNIPTQRTIEYAMVAGVGMKELLPKLTEKLVSYRDRASHIEVPRFFNTVPNEGDDKITHSWFWPRVGDFLKPKDVIITETGTSNFGLLEVPLPPKSTLVNQVLWGSIGWATGDTLGASLAAREKGFERTILFTGDGSLQLTVQELSVMIRKGVKPIIFVLNNSGYTIERCIHGKTRKYNDISNWNWTALFSVFGDPDERLSSAFTVNTKGALSKLLDDATFAKAGKIQLVEVMMDKFDAPRALQEQAALSA

SEQ ID NO: 394 - protein, 571 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 395 - protein, 570 aa, Neurospora crassa
MVAQQQGKFTVGDYLAERLAQVGVRHHFVVPGDYNLILLDKLQAHPDLKEVGCANELNCSLAAEGYARANGISACVVTYSVGALSAFNGTGSAYAENLPLVLISGSPNTNDPSQYHILHHTLGHPDYTYQYEMAKKITCCAVAIPRAIDAPRLIDRALRAAILARKPCYIEIPTNLAGATCVRPGPISAITDPITSDKSALEAAAKCAAEYLDGKLKPVILVGPKAGRAGSEKELIEFAEAMGCAVALQPAAKGMFPEDHKQFVGIFWGQVSSDAADAMVHWADAMICVGAVFNDYSTVGWTAVPNIPLMTVDMDHVTFPGAHFSRVRMCEFLSHLATQVTFNDSTMIEYKRLKPDPPHVHTAEREEPLSRKEISRQVQEMLTDKTSLFVDTGDSWFNGIQLKLPPGAKFEIEMQWGHIGWSIPAAFGYALRHPDRHTIVLVGDGSFQVTAQEVSQMVRFKVPITIMLINNRGYTIEVEIHDGSYNKIKNWDYAMLVEAFNSTDGHAKGLLANTAGELADAIKVAESHKEGPTLIECTIDQDDCSKELITWGHYVAAANARPPRNMSVQE

SEQ ID NO: 396 - protein, 337 aa, Aspergillus niger
MTASTKVRVAVTQHEPVWLDLHATVDKTCRLIAEAAGNGAQLITFPECWLPGYPAWIWCRPVDMGLFTTYLKNSLSYDSEHMRRICNAAAQHKITVVLGLSERDGNSLYIGQCTIDSTGKIVMRRRKMKPTHMERTVFGESSGRSLLNVVDLPIGKVGALACWEHIQPLLKYHTMIQGEEIHVSAWPVLHPHMGGESLWGMSQEGGTGASQVYALESASFVLLTTAVLGPTCVKKMNLSPPWDTLGGGASAVIAPDGRRLTEPLPANEEGFVYADLDLDMILTCRHFVDACGHYSRPDLLWLGVDTREKTQHRPEGQADNAAYGLDVPSGLVEEEGA

SEQ ID NO: 397 - protein, 322 aa, Talaromyces marneffei
MSKIVRVGAVQSEPVWLDLEGSVDKTISLIEKAAADGVNVLGFPEVWIPGYPWSMWTSAVINNSHIIHDYMNNSMRKDSPQMKRIQAAVKEAGMVVVLGYSERDGASLYMAQSFIDPSGEIVHHRRKIKPTHIERTIWGEGQAESLTCVIDSPFGKVGGLNCWEHLQPLLRYYEYSQGVQIHIASWPAEFEMPDPKKIAWLYHETGEASYRASQFFAIEGQAFVLVASQILTEANVERNNLTGNPVTKTPGGGFSMIFGPDGKPLCEPVDAGAEAILTADIDLRDIDKPKAFIDVVGHYARPDLLSLLVNPTVDKHVTTMKK

SEQ ID NO: 398 - protein, 327 aa, Neurospora crassa
MATTIKVAVTQAEPIWLDLQASIQKAVSLVHEAASNGAKIVAFSETWAPGYPGWCWARPVDPALNTKYAYNSLTANSPEMEQLQQAAKEDSIAVVIGFSERSSSGSLYIGQAIISPQGEVALQRRKLKPTHMERTIFGDGSGPDLNCVAELDFGSELGSIKVGTLNCWEHAQPLLKFHEIQQGVVIHIAMWPPIDPYPGVEFPGLWSMTADGCQNLSQTFAVESGAFVLHCTAVCNESGIEAMDTRNGMVFREPGGGHSCVIGPDGRRLTQPLADKPSAEGIVYADLDLTRVVTNKSFQDIVGHYSRPDLLWLSYDKEKKDAAVHRN

SEQ ID NO: 399 - protein, 328 aa, Aspergillus niger
MLSQVRVAVTQAEPVWLDLEATVKKTCDLIAEAAANGAQLVTFPECWIPGYPAWIWARPVDMRLSSIYIQNSLKIDSPQMASIQQCAAENKIVVVLGFSENLHNSLYISQAIIASDGKILTTRKKIKPTHMERTIFGDSFGDCLQSVVDTSAGRVGALSCWEHIQPLLKYHTYAQREQIHVAAWPPLFPHSEDGSLFSMSTEGTSSIARTYAIESQSFVLHTTTVIGQSGIDRMATSTGALMSTPGGGCSAIFGPDGRQLSQPIPSAEEGIIYADLDFEHIYHSKAFVDVCGHYSRPDLLWLGVEGGVKRHVRDNATTATPQVEQQEE

SEQ ID NO: 400 - protein, 339 aa, Fusarium vanettenii
MACPIRVAVTQAEPVYLDLAASVKKACGLIAEAAQNGAKLVAFSECWLPGYPAWIWARPVDFELQTRYIYNSLPIESEAMELVKATAKEHSIAVALGFSEQSPSHSIYISQAIISPQGEVVMHRRKIKPTHMERTLFGDGSGADLNNVVEVDFGAEHGKIKVGCFACWEHTQPLLKYHSISQGEAIHISMWPPIDPSAGVDHPGLWSMTADGCQNLSQTYAIESTAYVLHSTSVCTQKGIETLKTQDGLSCRQPGGGHSCVIGPDGRRLTAPLGDGSPDAEGIVYADLDLTKVVATRGFLDIVGHYSRPDLLWLGVDREQKENIIAKQHKAAEQEAVQG

SEQ ID NO: 401 - protein, 333 aa, Aspergillus oryzae
MTTPQPSQVRVAVTQAEPVWLDLKATVDKTCSLIAEAASKGAQLVSFPECWIPGYPAWIWTRPVDQELHSRYIQNSLTVSSPEMTQICKSANENNVIVVLGFSENIHNSLYISQAIISNTGSILTTRKKIKATHMERTIFGDAFADCLDSVVETAVGRVGALSCWEHIQPLLKYHTCAQREAIHVAAWPPLFEWGGPEDESLFSMSRDGTIALARTYAIESSSFVLHTTAVISQEGVEKMRTATGAIMNMPGGGSSAIFGPDGRLLSKPLLPTEEGIIYADLEMHDIYKTKAFVDVLGHYSRPDLLWLGVGSCDRRHVKEDAEERREDRVEVL

SEQ ID NO: 402 - protein, 317 aa, Meyerozyma guilliermondii
MGAKVKVAVVQAEPVWFNLQETVKRVNELIESAYNKGAELIAFPEVFVPGYPTWIWTNAADLDRNLMYTKNSLTYDSPEFISIIETVKKYPIHVVLGFSEKDQGSLYISQCIIDNTGEIVLKRRKFKPTHVERVIWGDTADSNMKSVVTLNFKEAGPVEVGCLSCWEHMQPLLYYNSAAQHEKIHIGSWPALNDKDLGVYCFTKAGFHGLARAYANQVQSFYLFTSILGQRIQEALPDVKLSPYFEKGAGCGAVFAPDGSQITEDHPDDFDGVIISELDMDKILLQKNLVDIVGHYARPDMVSLSHNRPNTEFVNRK

SEQ ID NO: 403 - protein, 320 aa, Aspergillus kawachii
MSHDGPKTIRVAAVQAEPEWNNLQKGVEKTIRLIIEAGKNGANVMGFPEVWIPGYPWSIWNQSVVDNVEFMDEYFRNSLERDSEEMNRIRCAVKEAGIFCVLGYSERYQGSLYISQSFIDENGDIVHHRRKIKPTHVERGFWGEGQADSLKSVVKSSFGNIGGLNCWEHTQTLLRYYEYAQNVDIHIASWPLIFGACAEMQYHISSEMCGKLTQVMSMEGACFTLICSQVMSAENCERNKVDKWSFVKAPGGGFSMIYGPAGEPLVEAPDAGEEVILYADVKLAEKWRAKQNLDVVGHYSRPDLLSLKVTNNAASQVHFA

SEQ ID NO: 404 - protein, 316 aa, Fusarium oxysporum
MSQLKIASVQFENWSGSKDKNLAIIHRMASDAANRGCNVVAFHECSVTGYTFASRLSKEELLDLAEEVPTGPSTRSLVKIARELAITILAGLFEKDENGHIYNTYICVDSNRGFVATFRKLHPFISPHLSPGNEYVVFDLLGWKCGILICYDNNVVENVRATALLGAEIIFMPHVTMCTPSTRPGAGFVDPSLWTNRDQDPTSLRAEFSGLKGRQWLMKWLPARAYDNAVYVVFSNPIGMDDDQLKNGCSMILDPFGDILSECSLLGEDMAVATCSKDKLQLAGGFRYRQARRPELYRDILGSDHNSSLNVSWLGK

SEQ ID NO: 405 - protein, 241 aa, Aspergillus luchuensis
MVLAAVGQLCSTGSLAANLTQCKTLVRKAAAAGAKALFLPEAADYIASSPAETISLARSVQDSEFVLGLQKEAQLANLHINVGIHEPASNGRIKNTLVWINEKGDITQRYQKVHLFDVDIKGGPVLKESALALKRQNAQIITYPSAFTVPTGTAHWETLLRARAIETQSYVIAAAQAGPHNEKRRSYGHSMIVNPWGEVVAKLDDEYQEPQIAVADIDLDLLAKVRREMPLLRRTDIYPEV

SEQ ID NO: 406 - protein, 199 aa, Saccharomyces cerevisiae
MAKHIVAALQIGSCPGSTKDTLKKILSYEKEIKESGAKLVVIPEATLGGYPKGSNFGVYLGYRLQEGREEYAKYLAEAIEIGNGEKYPEISQLCALSKATDASLCVGCIERDGTTLYCTMVYIDPKDGYVGKHRKLMPTAGERLIWGQGDGSTLPVVDTAAGKIGGAICWENMMPLLRYAMYKKGVEIWCAPTVDARPI

SEQ ID NO: 407 - protein, 304 aa, Trichoderma lentiforme
MASNLKIALVQLYSKPLDVAGNFARAESYIRKAASQGANLVVLPEYHLGSWKPDSKILLATAKEQTPYLAKYQAIAKELGIAIAPGTILEPIPAEEGNASMTEGIANAAYFIGPDGAVLGRYQKKNLWHPERDHLTADGLTPHRAFDTPWGRVGLIICWDLAFPEACRALVADGAKFVVCPTFWLNSDGGDIGAEVNPECERLFLENVAVARAFENTCGFVFCNTGAPLGSGTSGKDEEGTEFIGLTQVAMPLQGALGKLGVEEAMTVVDVDLKVLDIAEEVYKVRADIAMEGWHYGHTLQPRE

SEQ ID NO: 408 - protein, 454 aa, Penicillium expansum
MNSPTASDPIVRTLDAPETKDMQEAFLPGESPQDVASVIQETMDIFDKRMRLTHPHCFCYVPSCPSPLAWVGDLFTSLYNVNAVSWDVSSGPSAMEQGMIRWLAQQVGLPPSAGGCFVSGGSMANLSAVVAARDKLLPPMRRAEGTIYTSDQTHISIKKCLHIIGFDEHQIRVIPTDHLFRMDTDILRRTIAADRQCGRLPFLVVASCGTTNTGSIDPLHALADVAEEEGLWLHVDGAYGASIALSDKYRHLVDGIGRADSISWDGHKWLFQTYGCGIVLTRDSASLAHSFAVDAEYINSTTPHGAVNFYNLSPELSRPARAMPLWFTLRVLGRRQMGEMIDQGFLLARTAEEEIRRYPHWVILAPVTASIVVFRYCPLGLKDDDLDTLNLALSARLLAENVASILTTNIRGRVALRFCATNPATQADTITKVVQQMDQMANTMPTCGLGMCKE

SEQ ID NO: 409 - protein, 523 aa, Alternaria panax
MDSSQFREAAKGAIDEIAKYYDTLEERPVLPSVKPGYLRPLLPSSTPEEGESWETIQADIDRVIMPGLTHWQSPKFMAFFPCNSSFEAMIGDMYSGAFNAAAFNWICSPAITELETVVMDWVAKLIALPKAFLSDGEGGGIIQGTASEVVLTALVAARERLIRRKVGDMPEGEERMDKAADIRGKLVALGSEYAHSSTQKAAVIAGTRYRSVPASKETNYSVTASALRKTIEECRAKGLEPFYFTVTIGSTGTCAIDDLEGIAALTKEFPDLWIHVDAAYAGSALVCPEYQHLCKPIASFDSFNFNLHKWLLVNFDCSAFFVKKRRDLMDTYSITPSYLRNPHSESGLVTDYRDWQIPLGRRFRSLKVWFVLRSYGVSGLRQFIRKHVKLGEYFHELLLSKPDLFDITTEPAFGLVTFQIKPKMASSTAAVAANQADPVHEALQNDFHADAEAQYKEMVNQKTKEVYENVNAKGDFFLTSTIVGGQYVIRVVSATLKSEEKWMKQLFDELVEVAEKKGGDKAT

SEQ ID NO: 410 - protein, 527 aa, Talaromyces stipitatus
MDREQFRAAAHAAIDDIINHFDSLPERRVLPTIEPGYLRPQIPENPPIEPQPWSEIQADIESKIQPGLTHWQSPNFMAFFPASVTYPSILGEMYSAAFTAPAFNWICSPACTELESIVMDWVAKALGLPKCFLSTSENRGGGVIQGTASESVATMLIAARERRARELTFAEGVKDNGSAEYEDHMCAHRAKLVALSSDQAHSSVAKAALVAGTRFRSIPTSLEDNVELTAKSLRATLTKVEEEQGLVPFFINFTMGTTNSCAVDRFAELKAVLNERESWRRIWVHIDAAYAGAALVEDEYQHIAQNFAEGVDSFNMNMHKWLLVNFDASCLFVRNRTDLTNALDITPAYLRNPYSETGTVVDYRNWQISLGRRFRSLKIWFVMRSYGLNGMKAHIRKGIKLGNLFAEKVQSRPELFEIVTKPAFALTVLRVRSSAASSAFTSNGTNGDNGTSEVAKHGVAQVDEKANEITKKVYELINSRGEVFLTSSVIAGIYVIRVVGVSPQADEAHTLRAFDILVKTTEEVLRG

SEQ ID NO: 411 - protein, 374 aa, Fusarium redolens
MLMWIPGQGRLLYDPAKTQGIPPLSEEDIATLADITIQLNEIASEIDVHQPWTHPKAKEWDRQTLSSWLDGFARDGTARGVIDMTNRAIMSAECEDVSLLSAVINVARTGDPETKGRMEMLTNVKNGSLEERIQGGPQNIATKLAERLGSDKVRLQAPVRQILQNDGTYLVVGDSFRVQASKVIIAIPPTLAGRIVYQPPLPAARDQLCQRVPMGSIGKVIAIYKTPFWRDQGLSGEVASLEGVSQSTFDSSPPDASFGALMGFLEANEMRRLDDASEEEIFAAVTEDFVRYFGPKAREVQSWVLQRWDNEEFSRGGHTGSFPPNVWTQFGPALTKPIGGIYFAGTEASSYWAGFMEGAVIAGEAAARKILSSS

SEQ ID NO: 412 - protein, 480 aa, Aspergillus welwitschiae
MALQLLSLLCLILTTAAFPVSEVDVAIIGAGLSGLSAAKDLAAAGRSFAILEARDRVGGRVLNVELPGGIVEEVGAEFVGPTQDRVLALAAELGLTTYPTYNTGNCTLLRNGTITNYPCELGSGSLPPLPTEALIEVFTLQQQLNALAAEIDVQAPWDHPNASIWDTMTLETFLASQLTLSDARFLLNTFVTGILATEANEPSLLYMLAYIAASGNETEVGTLDRLIDVVGGAQESRIVGGTQLIALRLADRLGAENIHLRSPVQRVQHNNGRYMVISNGTRISAKRVVVAMSPPMAARISYDPPLPPARDQLTQRMGMGSIGKAIAIYPTPWWREQGGNAQALADTGILRITFDNTPADASFGAIMGFIVGDEMRRVDKMNETEIEAAVIDSFVGMFGPQAAHPDRVIVQRWDWEEYSRGGPVAYAPPSVLTDYGVQIRESVDGIYFAGTEASFYWTGYMDGAVRSGERVAAEVLRSLQ

SEQ ID NO: 413 - protein, 935 aa, Aspergillus alliaceus
MYDISSQLVLKWDRLGPQHEIDMADDLTRLAFDTIGLCAFSYRFNEFYSEHMHLFAEQMGRVLLESGKRAFRLGVVNQVFAWSEQERQEDIHKMHAVADEIIADRKRNPQPENKDLLNTMLSVADPETGEKLSDENIRFNLVTFLIAGHETTSATLCFLYYNWLKNPLTLKKAQQEVDEVVGGSVLNVDHLPKLTYIDASIKETLRLSSPIPTFFVKPKNDTTVGERFKISSNTMVQCNMQGLHTDPAVWGDDAETFRPERMLNGGFASLPPNSWKPFGNGMRACIGRGFAEQEMLMNAALVLQRFQLEFADPSYELDVASTLTIKPRGFKIRVHRRPGKPAFFGVPGGGVVEAERKGINRSPNLDMIKSSRSPITILFGGNTGTCQSFALDLEDKLMCLGFVVTTKPLDAATQNLPTDRPVIVITASFEGNPPDNAKEFVEWLERAQEKDMLNGVQYAVFGVGNSDWPNTYHRIPRLVDSTMARLGASHILEIGVTDVKKDIIGPWEDWSEKLIQALAGPKTRAKGEAPSISVAIRPGELPQILGGKIVNIGTVINNYQLCGTEIGLAKRHMSIRLPEGQTYQAGDYLVVQPRNSEETARRVLRYFSISEHDTMVVQNSKKTFMPTKPVSVMEFLQNAVELGTPITKRQIEVLTTNTIKEHRAALEELKSEEIYPTLLDKRYSIIDVLEEYPSGLSFGTYIDMLQPLTPRQYSISSSPRHSTGSSYQVASITFDVHHSPARSGHGTFNGVASNYLATRCAGDQISCYTRPTSVGFRLPVDPDVPILMMAAGTGIAPMRAFLQERARIAEDGIQELAPAILFFGCRNDPMDFIYKNELRSWEDMGIVVVKLAFSRPSDGSTPQYIQDVIWENRQEVSDLFRRGGRIFVCGSAARLGRSVADVCIRIYLEETGQSDEEAEAWLQSVRTSRYISDVY

SEQ ID NO: 414 - protein, 1067 aa, Aureobasidium melanogenum
MSTPIPGPAGWPLLGNVNDIDPDVPIKSLMDIADKYGPIYSLSILGKRRVVVSSVELMNEICEERRFGKVVTAALGEVRNLTGDGLFTAHNGEQNWEIAHRVLIPAFGPLNIRGMFDDMRDIASQLVMKWARHGNDYKIHVTDDFTRLTLDTLALCSMDYRFNSFYAEQMHPFVDAMVNVLSESGSRIRRPGFLAALYRKEEYQYWKDIKYLRELSAELVQNRKKHPGSRKDLLHAMLHGKDPRDGSSLSDDSIIDNMITFLIAGHETTSGLLSFLFYYLLKNPSAYKKAQEEVDQVIGDATIKVEHLSKLPYINAVLRETLRLQPTAPAFSIQPNNEIDTIGGQYTVFRGEPIVALLPKIHRDVSVYGEDANDFKPERMLDENFNKLPPNAWKPFGNGSRACIGRPFAWQEAQLVVAMLLQYFDFTLDDAKYDLQIKSTLTIKPNHLYMHAKLRHGRTPTQLEQILSSNGAPTPAKQTHKSDVETATSAASDGNARPLTILYGSNTGTCQAFAQGLAADAPSHGFKVTKIDTLDSAKDNLPTDQAVAIITCSYEGEPADNAAHFFHWLKSLEGNSVKTQYAVFGAGHSDWKNTFHKIPTAIDDILLARGGERICSRGSANAANGDMFSEFEKWEDEVFWPAMSKKYGGDGGATDSAATQSLTVEVSSVRSSHLRADVYEARVVDAKLLSQPGSSEKRHIEIELPASVTYSSGDYLHVLPINPHESVQRVMRRFNLAWDSVLTIKAAVGTILPTNVPISANDLFGAYVELGQPATKRNVTLLLDACTDDETKKELTRLTGDAFSTEISEKRVSLLDLLNRFPSVQLPLGAFISSLPPMRTRSYSISSSSLVSPHRVTLTYAVLHQSHMSGMGEYVGVASNYLSKLATGDKLHVAVRPSNQAFHLPTDYEKTPVIMICAGTGLAPFRGFVQERAAQVEAGRKLAPALLVIGCRSPDQDELYREDFDLWEAKGAVKILRAYSRKPEASGGSKYAQDALWEHRQEARELWDAGSRVYVCGSRALERSVEKVCKAIYVERAKELGKDKTEQEAEEWFEGTRTLRFATDVFN

SEQ ID NO: 415 - protein, 1081 aa, Aspergillus flavus
MMRELRERLLCPGAVLRSNYPVTKMRRLLKMRQNDNEKQICPIPGPQGLPFLGNILDIDLDNGTMSTLKIAKTYYPIFKFTFAGETSIVINSVALLSELCDETRFHKHVSFGLELLRSGTHDGLFTAYDHEKNWELAHRLLVPAFGPLRIREMFPQMHDIAQQLCLKWQRYGPRRPLNLVDDFTRTTLDTIALCAMGYRFNSFYSEGDFHPFIKSMVRFLKEAETQATLPSFISNLRVRAKRRTQLDIDLMRTVCREIVTERRQTNLDHKNDLLDTMLTSRDSLSGDALSDESIIDNILTFLVAGHETTSGLLSFAVYYLLTTPDAMAKAAHEVDDVVGDQELTIEHLSMLKYLNAILRETLRLMPTAPGFSVTPYKPEIIGGKYEVKPGDSLDVFLAAVHRDPAVYGSDADEFRPERMFDEHFQKLPANSWKPFGNGKRSCIGRAFAWQEALMILALILQSFSLDLVDRGYTLKLKESLTIKPDNLWAYATPRPGRNVLHARLALQTNSTHPEGLMSLKHETVESQPATILYGSNSGTCEALAHRLAIEMSSKGRFVCKVQPMDAIEHRRLPRGQPVIIVTGSYDGRPPENARHFVKWLQSLEGNDLEGIQYAVFGCGHHDWSTTFYKIPTLIDTTMAEHGGARLAPRGSADTAEDDPFAELESWSERSVWPGLEAAFNLARHNSSDGTGKSTRITIRSPYTLRAAHETAVVHQVRVLTSAETTKKVHVELALPDTMNYRPGDHLAILPLNSRQSVQRVLSLFQIGSDTILYITSSSATSLPTDTPISAHDLLSGYVELNQVATPTSLRSLAAKATDEKTAEYLEALATDRYTTEVRGNHLSLLDILESYSVPSIEIQHYIQMLPLLRPRQYTISSSPRLNRGQASLTVSVMERADVGGPRNCAGVASNYLASCTPGSILRVSLRQANPDFRLPDESCSHPIIMVAAGSGIAPFRAFVQERSVRQKEGIILPPAFLFFGCRRADLDDLYREELDAFEEQGVVTLFRAFSRAQSESHGCKYVQDLLWMERVRVKTLWGQDAKVFVCGSVRMNEGVKAIISKIVSPTPTEELARRYIAETFI

SEQ ID NO: 416 - protein, 597 aa, Ustilago hordei
MSTKVSDNVLRWAHSHPIAAGILGLLLVATLYIGLKDATKGPSVWAHFPGPERSSYLLGYSRDSKKKFGVKNPKALDREPIIGDAGTDITDDPGVSNARLFEEHNTDHLVLPRPLGGELLVTRDAATMNHVLNDSYNYTRSSAGTKATKIIIGNGIVAVFGDGHKKQRRMLAPAFSVDSLKQLMPIFTHATNQMMDRFEKDTSLEKRWGHGVKDTVKWFGRVTLDIIGRAGFDYDFGAVEQGPNGEAVRSTFHAAMTSTMNVKPLDAIVGAFMFFVVPSLLYILPLTDNVRKLREMRSELIKTSQKIVEAKAKQIRKELEAGVDAKETFGGRKDILHLLMRANMSPDIREEDRLSDEVLAGQIITFIFAGHETTATTMSWCTYLLALNPEYQRKLRGKMQSALGALGKDGEAIGDLTYADLNSEEMRPLDHCIQETLRLRPPVVTTFRYCKKDDQLAVTRPFNTKDGRTLSSIPVTAGREIAISVTGNNLDEKYFGPETHLFQPERWNNLPELHAKSKLPSPYGSFVFNGGPKVCIGSKFAMTEMKIIMIRTLAKYRIEPVEGLKYKSVEAVVQRPAVIGFEKEGSQLPLRFISDPL

SEQ ID NO: 417 - protein, 501 aa, Levilactobacillus brevis
MDENKSEQQIDTQKANRITGFQLFSMTTSMVMTVYGFAAFAKQGPTAFFYLFLAGILWFLPVTRTSGEMASIDGWSKGGIFTWSRNMLGERAGWSALFYQWIHITVGMNTMMYFIIGCFSVTFGLPIITDNPLVKFILMMIILWGLIFLQQKGTSVTGKIAQWCFTLGVIIPVFFLLFLFILYLVQGNPAMIHVNMHTIFPSSWNGSVLVGFVPFILAFAGAEGSAPHVKDLDKPSIYPKVMMALAVAAICSDIIGSMAIAMTIPNNQIQLSNGIVYAYGALVARYGVGVVFVEKLTGFLLAVGVLGEISSWVVGPNAGMFEAAKAGYLPPRFSKANKYGIETNVMVLQGVIVSIVGALLTFGAGGNKASLSFQTAMSLTVALYTLMYMLMFISYLVLQFKYVDLHRDFVAAKSRWLRITYGILGFILSAFGFVVTFFPPADLSVASKHTYLMLLVSAFVVMLVLPFILYRFHDKWALQLGVNVDEVAAPTGHEALEKETK

SEQ ID NO: 418 - protein, 469 aa, Levilactobacillus brevis
MINNVDLEKTFLGSVEAGQSLPTNTLPDDPMAPDVAAQLVEHYRLNEAKANQNLATFCTTQMEPQADELMKNALNTNAIDKSEYPKTAAMENYCVSMIAHLWGIPDNEKIYDDFIGTSTVGSSEGCMLGGLALLHSWKHRAKAAGFDIEDLHSHKPNLVIMSGYQVVWEKFCTYWNVEMRQVPINGDQVSLDMDHVMDYVDENTIGIIGIEGITYTGSVDDIQTLDNLVSEYNKTATMPVRIHVDAAFGGLFAPFVDGFNPWDFRLKNVVSINVSGHKYGMVYPGLGWIVWRHNTADILPAEMRFQVPYLGKTVDSIAINFSHSGAHISAQYYNFIRFGLSGYKTIMQNVRKVSLKLTAALKTYGIFDILVDGSQLPINCWKLADDAPVGWTLYDLESELAKYGWQVPAYPLPKNRDDVTISRIVVRPSMTMTIADDFLDDLKLAIDGLNHTFGVTTTVDQDNKTTVRS

SEQ ID NO: 419 - protein, 458 aa, Pseudomonas aeruginosa
MSVPQRAVQLTEPSEFLKEHPEVQFVDLLIADMNGVVRGKRIERNSLNKVFEKGINLPASLFALDITGSTVESTGLGLDIGDADRICYPIPGTLSMEPWQKRPTAQLLMTMHELEGEPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLNHVNDALKACDHAVLLKRLVKNIAYDHEMDTTFMAKPYPGQAGNGLHVHISLLDKHGNNIFTSEDPEQNAALRHAIGGVLETLPASMAFLCPNVNSYRRFGSQFYVPNAPSWGLDNRTVALRVPTGSPDAVRLEHRVAGADANPYLLLAAVLAGVHHGLTNKVEPGAPIEGNSYEQMEPSLPNNLRDALRELDESEIMAKYIDPKYIDIFVACKESELEEFEHSISDLEYNWYLHTV

SEQ ID NO: 420 - protein, 491 aa, Pseudomonas sp.
MPALSAIPECCWSASAPPGDFPRLTGDSRCDVVVIGAGIVGLSAAMTLCEAGKSVVVLEAREVGGQVTGRSTAKITTQHALIYRYLIDTFGQELAQCYADANREAVERIRHWVTSHAIDCDYQRQSAFAYACSADWRSAIEEEAEAARRLGFSARVVDQPPLPFATAGALEFPDQAQFNPTRYLIGLANTLQARGGRIHQHTRAKSFERQERWRVGFDNGSVEADQVILATHMPVETPIDLVSPTQPRCHVAMAFRPQAGARLEGMFIGIDEPTHSIRMARDDEGPLFIVLGPRFRTGQDGNVAQRFVDLEHWAQRNLPVGEAVWSWCNEDYDTADRMAYVGEPDREQSPGLFVATGFNGWGISNGTAAGLGIARQIITGRRPWKHLYDPNRPSPDNFNQSSDSHSLVDDLDSIAPGEGGVVTRGDEKLAVWRDDAGILHAVSAACTHMGCSVTWNNADRTWDCPCHGSIFQADGEVIHGPAIEPLAARSL

SEQ ID NO: 421 - protein, 496 aa, Pseudomonas fluorescens
MTNTRSDWEQRFQSLTIEGRAFIDGQYCAAASGATFECISPVDGRFLANVASTDEADANAAVAVARRTFESGVWANLAPAERKRILIRFADLILANQEELALLETLDMGKPISDSMSIDIPATANAIRWTAEAIDKIYDEVAATPQDQLGLVTREAAGVVAAIVPWNFPLIMASWKFAPALAMGNSFILKPSEKSPLTAIRIAQLALDAGIPKGVFNVLPGYGHTVGKALALHMDVDVLAFTGSTAIAKQLMVYAGQSNMKRVWAEAGGKSPNVVFADAPDLRAAAQAAASGIAFNQGEVCTAGSRLLVERSIREQFIPLLVEALQAWKPGHALDPATTVGAVVDQRQLDNVLRYIGIGKEQGAELIAGGSRTLEDTGGLYVEPAIFDGVTNAMTIAREEIFGPVLSVITFDTFDEALAIANDSIFGLAAGVWTSNLSKAHTFARGLRAGSVWVNQYDGGDMTAPFGGFKQSGNGRDKSLHAFDKYTELKATWIKL

SEQ ID NO: 422 - protein, 250 aa, Pseudomonas aeruginosa
MSRLPLIGVTACTKQIGLHPYHIAGDKYLRAVVNGAGGLPLIIPALGELLDQATLLDSIDGLLFTGSPSNVEPRHYSGAASEPGTLHDPDRDATTLPLVRAAIDAGIPVLGICRGFQEMNVAFGGSLHQKVHEVGTFMDHREPADQPLEVQYAPRHAMHVQSGGVLAGIGLPSEFQVNSIHGQGVDRLAPGLRVEALAPDGLVEAISVEGAKAFALGVQWHPEWQVLTNPNYLAIFQAFGKACGKRAGQR

SEQ ID NO: 423 - protein, 459 aa, Enterobacter hormaechei
MNRLPSSASALACTAHALNLIEKRTLDHEEMKQLNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFSNSGTESVEAAIKLAKAYQSPRGKFTFIATSGAFHGKSLGALSATAKSTFRKPFMPLLPGFRHVPFGDINAMRIVLSECRKTGDDVAAVILEPIQGEGGVILPPQGYLPAVRQLCDEFGALLIFDEVQTGMGRTGKMFACEHENVQPDILCLAKALGGGVMPIGATVATEEVFSVLFDNPFLHTTTFGGNPLACAAALATINVLLEQNLPAQAEQKGDMLLDGFRQLGREYPDLVQDARGKGMLMAIEFVDNETGYSFASEMFRQRVLVAGTLNNSKTIRIEPPLTLTIEQCEQVLKAARKALAALRIAVTSA

SEQ ID NO: 424 - protein, 474 aa, Pseudomonas fluorescens
MQTKLLINGQLVNGEGPAQPVLNPALGEVLVEINEASEAQVDAAVRAADNAFAEWSQTAPKDRSLLLLKLADAIEAHGEELARLESDNCGKPYSAALNDEIPAIADVFRFFAGASRCMSGSAGGEYLPGHTSMIRRDPVGVIASIAPWNYPLMMVAWKIAPALAAGNTVVLKPSEQTPLTALRLAELASEIFPAGVLNLVFGRGPTVGSPLVTHPKVRMVSLTGSIATGSNIISSTADSVKRMHMELGGKAPVIIFDDADIDAAVEGIRTFGFYNAGQDCTAACRIYAQQGIYDKFVEKLGAAVSSIKYGLQDDPSTELGPLITAQHRDRVASFVERAVAQPHIRLITGGKAVDGNGFFFEPTVLADAQQDDEIVRREVFGPVVSVTKFTDEAQALEWANDSDYGLASSVWTADVGRAHRMSARLQYGCTWVNTHFMLVSEMPHGGQKLSGYGKDMSMYGLEDYTTVRHVMFKH

SEQ ID NO: 425 - protein, 258 aa, Escherichia coli
MRLSMENIMNNPVIGVVMCRNRLKGHATQTLQEKYLNAIIHAGGLPIALPHALAEPSLLEQLLPKLDGIYLPGSPSNVQPHLYGENGDEPDADPGRDLLSMAIINAALERRIPIFAICRGLQELVVATGGSLHRKLCEQPELLEHREDPELPVEQQYAPSHEVQVEEGGLLSALLPECSNFWVNSLHGQGAKVVSPRLRVEARSPDGLVEAVSVINHPFALGVQWHPEWNSSEYALSRILFEGFITACQHHIAEKQRL

SEQ ID NO: 426 - protein, 472 aa, Escherichia coli
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 427 - protein, 426 aa, Escherichia coli
MTEHTSSYYAASANKYAPFDTLNESITCDVCVVGGGYTGLSSALHLAEAGFDVVVLEASRIGFGASGRNGGQLVNSYSRDIDVIEKSYGMDTARMLGSMMFEGGEIIRERIKRYQIDCDYRPGGLFVAMNDKQLATLEEQKENWERYGNKQLELLDANAIRREVASDRYTGALLDHSGGHIHPLNLAIGEADAIRLNGGRVYELSAVTQIQHTTPAVVRTAKGQVTAKYVIVAGNAYLGDKVEPELAKRSMPCGTQVITTERLSEDLARSLIPKNYCVEDCNYLLDYYRLTADNRLLYGGGVVYGARDPDDVERLVVPKLLKTFPQLKGVKIDYRWTGNFLLTLSRMPQFGRLDTNIYYMQGYSGHGVTCTHLAGRLIAELLRGDAERFDAFANLPHYPFPGGRTLRVPFTAMGAAYYSLRDRLGV

SEQ ID NO: 428 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 429 - protein, 459 aa, Escherichia coli
MNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 430 - protein, 474 aa, Escherichia coli
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 431 - protein, 585 aa, Saccharomyces cerevisiae
MLHRHGSKQKNFENIAGKVVHDLAGLQLLSNDVQKSAVQSGHQGSNNMRDTSSQGMANKYSVPKKGLPADLSYQLIHNELTLDGNPHLNLASFVNTFTTDQARKLIDENLTKNLADNDEYPQLIELTQRCISMLAQLWHANPDEEPIGCATTGSSEAIMLGGLAMKKRWEHRMKNAGKDASKPNIIMSSACQVALEKFTRYFEVECRLVPVSHRSHHMLDPESLWDYVDENTIGCFVILGTTYTGHLENVEKVADVLSQIEAKHPDWSNTDIPIHADGASGGFIIPFGFEKEHMKAYGMERWGFNHPRVVSMNTSGHKFGLTTPGLGWVLWRDESLLADELRFKLKYLGGVEETFGLNFSRPGFQVVHQYFNFVSLGHSGYRTQFQNSLFVARAFSFELLNSSKLPGCFEIVSSIHESIENDSAPKSVKDYWEHPQAYKPGVPLVAFKLSKKFHEEYPEVPQAILSSLLRGRGWIIPNYPLPKATDGSDEKEVLRVVFRSEMKLDLAQLLIVDIESILTKLIHSYEKVCHHIELASEQTPERKSSFIYEMLLALASPQDDIPTPDEIEKKNKLKETTTRNYRGTC

SEQ ID NO: 432 - protein, 471 aa, Saccharomyces cerevisiae
MSICEQYYPEEPTKPTVKTESIPGPESQKQLKELGEVFDTRPAYFLADYEKSLGNYITDVDGNTYLDLYAQISSIALGYNNPALIKAAQSPEMIRALVDRPALGNFPSKDLDKILKQILKSAPKGQDHVWSGLSGADANELAFKAAFIYYRAKQRGYDADFSEKENLSVMDNDAPGAPHLAVLSFKRAFHGRLFASGSTTCSKPIHKLDFPAFHWPHAEYPSYQYPLDENSDANRKEDDHCLAIVEELIKTWSIPVAALIIEPIQSEGGDNHASKYFLQKLRDITLKYNVVYIIDEVQTGVGATGKLWCHEYADIQPPVDLVTFSKKFQSAGYFFHDPKFIPNKPYRQFNTWCGEPARMIIAGAIGQEISDKKLTEQCSRVGDYLFKKLEGLQKKYPENFQNLRGKGRGTFIAWDLPTGEKRDLLLKKLKLNGCNVGGCAVHAVRLRPSLTFEEKHADIFIEALAKSVNEL

SEQ ID NO: 433 - protein, 497 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNTLYTVSEALETGMVSCNTGVFSDCSIPFGGVKESGFGREGSLYGIEDYTVLKTITIGNLPNSI

SEQ ID NO: 434 - protein, 3598 aa, Bacillus mojavensis
MTKANSIQDIYPLSYMQEGMLFHSLLQKDSRAYVEQASFTIEGEVNLQFFQESINALVARHDIFRTIFISQNVSSPQQVVLRERTVSVLEEDIAHLDEAGQSAFVERIKEKDRAKGFHLQKDMLMRITLIRTGKRQYTCVWTFHHIMMDGWCLGIVLKEFLQIYASKIKGAPLSLEPVQPYGTYINWLMEQDKEKAVSYWDNYLSGIEQQTLLPKQKKTKSTSRQEQITFSFSKEDSSRLSELAVREEVTLSTIFHTLWGILLQKYNNSDDAVFGSVISGRPSDIEGIEQMVGLFINTIPIRLHGSKTPFLQLVKDMQKDRLAAEAYSYHPLYEIQSRSAVKQGLIDHILVFENYPVQKEIEMLNSQEPDSDLFQIHNFTVADETNYSFYLMVAPAEEIHIKMSYDAALHDRSFVLSVKEHLLNTVSQILDHPHLSPEDIDITTDTEKLQLIGEIKDHKPVYETIHAMFEKQAEKTPDARAVIDQAHSLTYKELNESANRLARHLRKKGVMRQEPVAIMMERSTEFVTGILGILKAGGAIVPIDPHYPSDRINYILNDCGCSHVVSQAHFAPLLETGLNVIYMEDIQIEDGSCLHSVNSADDLLYMIYTSGTTGKPKGVQFEHRNMANLLQFEFTRSGIDFENDVLQFATPAFDVCYQEIFSTLLGGGTLHIVPEAIKRDVPRLFAFIKEHQTTIVFLPTAFIKMIFSEQEFANAFPHDVKHLITAGEQLIVSSLLQDVLRQRSMYLHNHYGPSETHVVSAYTIYPGDQIPEFPPIGKPIDCTDLYILNRQKQLQPRGVSGELYISGSSVARGYINNDKLTREKFSPDPFRSGAVMYRTGDVARVREDGSFEYIGRADDQVKIRGYRIEPQEIEIALMNHPEVKEAAILIRQNQGEEHELCAYYCSMHRLDSSALRQYLENELPEYMIPAKWVWVDSIPLTPNGKVDQSALPKPEASISSNTYAAPRNLLEVKLSQLFEDVLKEAPIGIHDNFFDRGGHSLKATVLVSRIAKEFHVQVPLKDIFAHPTVEGLALIIRHAEENPFASVAQAKEQPTYPVSSAQKRMYVLQHLDNGGVGYNMPAVLELEGKLDREKLAAVFKELISRHEPLRTSFVPGEDAEPVQCIHSEVPFTLSEEASAAGFVRPFDLSQAPLFRAGLVKLANEKHLLLVDMHHIISDGVSVQLLIREFTERYANRTLKPLRIQYKDYAVWQQEFQKGDTYKKQETYWLRQFSGELPVLELPTDKRRPAERNFTGGKVLFQMNEDITSRLKELARKNESTLYMTLLALYSAFLSRLSGQEDIVIGSPIAGRPHADLEAVLGMFVNTLALRTHPAGNKTFTDFLKEVKQTALEAYEHQDYPFEELVDQLGVQREMSRNPLFDTTLVLQNMEKQTLKMNDLLLRWNDLQHPISKFDISLYVTEHEAELYCQFEYSTALFEEDTVQRWAGLFTTLVENTVSSPDMELDDIPILTLEEERSFIDSCQPLEETGYRLKQTLHHALEQQAAKTPDQPAVIVEDEEITYKELNEQANRVAWELIDRGVKAETTVAIMGRRSPEMLIGIYAILKAGGAYLPIDPDYPEERIRFLLKDSDSDILLIQSDNLDIPAFDGEIVHLSQLNSGLKRRLSNPNVEVYPDSLAYMIYTSGSTGRPKGVQVEHQSAVNFLNSLQFRYPLNQSDVILHKTSYSFDASIWELFWWPYAGASVYLLPQGGEKEPDMILKVIEEQQITAMHFVPSMLHAFLEYLKNGPVPIKTNRLKRVFSGGEQLGAHLVSRFCELLPDVTLTNSYGPTEATVEAAYFDCPLDEKLDRIPIGKPIHHVRLYILNQKQKMLPAGCIGELYIAGAGVARGYLNRPELTEERFLDDPFYPGERMYKTGDLARWLPDGQVEFLGRLDDQVKIRGYRIEPGEIEAALRSIEGVREAAVTVRTESGEAELCAYAEGLGRNEVRKQLETLLPGYMIPAHIIEMEQWPVTPSGKLDRKALPAPDGAADRETYTAPRNLTEMKLSQLWEEVLKSGPVGIHDNFFDRGGHSLKATALVSRIAKEFGVQVPLKDVFAHPTVEGLASVISEGTESPYEAIKPAEKCETYPVSSAQKRMYVLQQLEDGGTGYNMPAVLELEGKLDLTRMEAVFKKLIKRHESLRTSFTTDTDGEPVQRIHDEVPFTFRTSVLGGQTEQEAAAAFIQPFELSQAPLFRAGVVKVSDGRHLLLVDMHHIISDGVSVNTLIREFGELYANQELPALHIQYKDYAVWQEAFKKGDTYKTQEAYWLKQLEGELPVLDLPADYARPPVRSFAGDQVSFTLDQELTAGLHKLARENGSTLYMVLLAAYTALLARLSGQEDIIVGSPIAGRPHKDLEPILGMFVNTLALRTRPEGGKPFAQFLQEVRETALEAYEHQDYPFEELVDKLGVTRDMSRNPVFDAMLVVQNTEQQTFELADIQLQPAGVSHHVSKFDITLQASEGDEQIHLKFEYSTALFQEATIKQWTYHLTKLLSHIVKNPNTRLNNIDILTHEERNKLLNEFNSGQENEHKVQTIDQLFEKQAALTPNAPALVSRENTLTYQELDEWSNGIAWALRDRGVKPDTPVGIMMPRSFSMIAAILGVWKAGGCYVPIDPEYPAERKRYILGDSRTKLLITLPAADQEALKDFEGEIFAIENAKTYDGSPLPQVSRPQHLAYIIYTSGTTGQPKGVMVEHKGIANTLQWRRNAYALNETDTVLQLFSFSFDGFLTSMFTPLLSGAKTVLPDENEAKDILSIKHDLSHHRITHMIIVPVLYRALLDVIQPEDAKTLRVVTLAGEAADRELIDRSMAICPNTELANEYGPTENSVATTAMRHMERQKNVCIGRPIDNTEVLILNGDQLQPIGVAGELCIAGTGLARGYVNLSELTAKTFVQHPFQPEKRMYRTGDAARWMADGTIEYLGRMDDQVKIRGHRVETKEIESVIRRINGVKEAVVLARETAPAQTELCAYIVAEQDFNTEMLRAELNKQLPLYMMPAFIQTLDSLPLSPNGKLDRRALPEPAFNQVRTFHAPNSEMEQKLADIWGEVLGAEKIGIDDSFFELGGDSIKALQVSARLHRIGKQMSVKDLFSHPTIKELAAYIRDSDTSASQAPVEGEVQWSPVQKWFLSQDIKEKHHFNQSVMLHQSTSIQEDALRKTLKAITIHHDALRMVFTQSEQGKWVQYNRPVSHSDDALYSLQIINLKGSVVNQYESLIKQHVRDIQQNIDLEKGPLLQAGLFRTDDGDFLFLTAHHFIVDGVSWRVLLEDLATGYRQAVNGEDIDFPPKTSSFKAYAEKLADYAESRQLMKQLAYWREAEVYQTEALPFDQMDAQTANERKRDTVSFSLNTKETEALLKHVNSTYNTDTQDMLLASVILALRDWTKQSAVKLSLESHGREDVLDGIDVSRTVGWFTAIYPLFVKLDSDLTGKDQEEYLVHVLKTTKDTLRRVPDKGFGYGVLKYLTPPEKTGVDFTGTADISFNYLGQFENSRTTEATDENTFSFSPLGTGEDISTSWNREQTLDISAMAAEGKMTVKMTYETSRFQHKTIAQLCENCHHYLLKLIDHCLNKTETEKTISDFDDHELTEDALQEIADMLSFH

SEQ ID NO: 435 - protein, 1274 aa, Bacillus subtilis
MVKTKKIKNIYPLSHMQEGMLFHSFLHKEEGAYVEQSLFTIKGSLSYEMFQRSIQAIIDRHDIFRTVFLPHVSNLSGPRQVVMTERKFHLHTEDISSLQMNEQNDYIEQFKEKDKKKGFDLQKDMLMRISLLKTAENEHVCVWSHHHILMDGWCLGIILQEFMQIYQSIHTGNHLALEPVRPYSTYISWLTKQDKETAADYWRAYLKNYSTPSQLPRVTDREAKEGYYREELTFTLNQKLTDKLKETAKQTGVTLATFIQTVWGVMLQRYNRTDDVVFGAVVSGRPSEIPGVESMIGLFINTVPVRVKTGKEETFAELLSRCQQDMLDAEPFTCHPLFDIQANTALKQELIDHIIVFENYPLQQKMADSADQIDSPLQIDNVKVSEQSGYNFNLVVAPGDELVIKFSYNAHVYDAAWMTCIQRQLTQALQAAADHPDIPVADFSFLDPKEKEQILTQCNDTSTAYPKNKSVIDIFREQAVKTPDQTALVYGNRSISYRELDQKSDALARTLYENGLRRNGTAGILSGHSPEFIISVLAVLKAGGTYLPLDAELPPERISYMLDETKAAMLIVQKGLEPNTAFAGTFISADAEAMIEEHTKPLEIVTGPDDLAYIMYTSGSTGRPKGVMITNRNVVSLVCNSNYTSASVNDRFILTGSISFDAVTFEMFGALLKGATLHIIDKSTMLTPDRFGAYLIENNITVLFLTTALFNQLAQAQADMFHRLHTLYVGGEALSPELINAVRRACPKLSLYNIYGPTENTTFSTFFEIKRDYATPIPIGKPISNCTAFILDAKGCLLPIGVPGELCVGGDGVAKGYLNRDDVTAAVFSPDPFIPGERIYRTGDLARWLPDGNLEYISRIDRQIKIRGKRIEPAEIEARLLEIEGVREAAVTLLETDGEAQLYTHYVSDESRNEKEIRAALARVLPDYMIPQRWVRVDRMPLTGNGKINRSALPVPENESENRQDLTPPRNWVEQELAQIWKSVLGVKTIGIHDDFFGLGGHSLKALQVIHMLKHHQHIDIPIDVLFENPTIAQLAEKLYSNQLSAAGEQHVIQLNQQGGKNLFCFPPISGFGIYFKDLALQLNHKAAVYGFHFIEEDSRIEQYVSRITEIQPEGPYVLLGYSAGGNLAFEVVQAMEQKGLEVSDFIIVDAYKKDQSITADTENDDSAAYLPEAVRETVIQKKRCYQEYWAQLINEGRIKSNIHFIEAGIQTETSGAMVLQKWQDAAEEGYAEYTGYGAHKDMLEGEFAEKNANIILDILDKINSDQKVLPNKH

SEQ ID NO: 436 - protein, 2560 aa, Bacillus mojavensis
MKENTYGLTHAQRRVWFTELLEPGTSICNLTACVKFRGDVDLDALQLALNLSISRNDAIRFQLTEGIESESEPRLYLAEYKGLSLEIIDFTNAEMTETEQWIHDQARIPFKLLDSPLYQFYLLRIHPHEIWLYAKFHHIIMDGISLNLLGNQIIDLYQKIKKGEPVPDEQEPSYISYIEKERQYLQSSRFEKDHLFWTQTYQQPPVYHSLTGQSTSQKQSTSASRDTITLSPYLAHTIQAFCEEQKISMISLFMASFYICISRITSKTDLAIGTYYGNRGSKAEKEMLGMFVSSLPIRKTVDSDADFLSFARSVGREQLSVMRHQRFPYNLLVNELRKEHKDLHNLIGISMQYHPLQWQKADDLNYETALYFSGYTANELSVQIQERIDTGAIQLNFDYQNILFSLEDIKRIQHHLLTLLENALQNPHSTIKELDMAEKREKEKVLYEFNRTKAVSPVASTLHGLFERQAALTPDRTALRFSGGSLTYAQLDMYANRLAARLTAHGITKESIVGVLSERSPDMLTAVLAVLKAGGAYVPLDPVYPEERLSYMLKDSGAALLLTQPGLKAPGFSGKTLEVDMTALANEESECHSLHQADSDSLAYVIYTSGSTGRPKGVAVEHRQAVSFLTGMQMQFPLEEDDIIMMKTSFSFDASVWQLFWWTLSGASAYLLPSGWEKDPALMVKAIREEGVTTAHFIPAMLNSFLDQAEIEAPRSLKRVFAGGEPLAPHTAARFASLLPETSLVHGYGPTEATVDAAFYACDPELDKDRLRLPIGKPVPGARLYVLDPHLAVQPVGVAGELYIAGAGVARGYLNRPELTEERFLDDPFYPGERMYKTGDLAHWLPDGQVEFLGRLDDQVKIRGYRIEPGEIEAALRSIEGVREAAVTVRTESGEAELCAYAEGLGRNEVRKQLETLLPGYMIPAHIIEMEQWPVTPSGKLDRKALPAPDGAADRETYTAPSNLTEMKLSQLWEEVLKSGPVGIHDNFFDRGGHSLKATALVSRIAKEFGVQVPLKDVFAHPTVEGLASVISEGTESPYEAIKPAEKRETYPVSSAQKRMYVLQQLEDGGTGYNMPAVLELEGKLDLTRMEAVFKKLIKRHESLRTSFTTDADGEPVQRIHDEVPFTFRTSVLGGQTEQEAAAAFIQPFELSQAPLFRAGVVKVSDGRHLLLVDMHHIISDGVSVNTLIREFGELYANQELPALHIQYKDYAVWQEAFKKGDTYKTQEVYWLKQLEGELPVLDLPADYARPPVRSFAGDQVSFMLDQELTAGLHKLARENGSTLYMVLLAAYTAILARLSGQEDIIVGSPIAGRPHKDLEPILGMFVNTLALRTRPEGGKPFAQFLQEVRETALEAYEHQDYPFEELVDKLGVTRDMSRNPVFDAMFILQNMDKQDIHLGDIKARPANVIHQISVFDTTLMAAESDGVIKCDMEFSTDVFMRTTIERWTAHFTEFLRAATSNPNTTLSQVDILSEKEKQKILIELNKTHVECSQTDTVFHRMFEKRAEETPEHIAVIDGEKQISYRHLNEKANRLARTLQEKGKETQPIVAVLAERSIDAIVGILAVMKAGGVYIPIDSHYPKARVEYLLKDSGAEILLLQNEVKHLIAGSDIGDISRISLDDESFYEAKRCNLSSSPAPEDSAYIIYTSGTTGAPKGVIVTHRNFAHAVLAWRSIYQLDQMPVRLLQMASFSFDVFSGDLARTLANGGTLVICPDETRLEPAELYALMNRQRITIMESTPALIVPFMEYVYRNQLSLPDLDILILGSDMVKAHDFKTLADRFGNKMRLINSYGVTEATIDSSYYEMNMGEEYSGDSVPIGIPLPNVKLYVLSQTDQIQPIGIAGELCIGGAGVAKGYHGKFELTEKKFTENPFVPGERLYRTGDLACWLPNGTLRLLGRIDHQVKINGYRIETEEIESVLLQTGLVNEAVVAVQNDTNGQARLAAYILPSDADTTALRGALSKMLPAYMVPAHIIPLETMPLTLNGKLDRRALPAPNEAVSRPYTAPVNELQGMTAQIWEDVLSVSRVGIHDSFFELGGDSIKALQVSARLAAEGWSMTIQDLFRYPTVHELSGHITPLISQAEQRPIEGEADLTPIQSRFFDQRHAFRDHYNQSVMLFSEKGFHADALRQALRKLTEHHDALRMVFTQDHTGRVVQYNRGIQITENELFGLHLADWTKEQAKGTLLKEKFAAEEIVLQSNMNVKEGPLLQAGLFKTREGDHLLITIHHLAVDGVSWRILLEDLAAAYQQSLEQTEIKLPPKSDSYLSYANGLAQIAGSRQLLSEITYWQTILDAHNVFLPKDMAESDRHQSSAETAAFVLASDWTKKLLFETQQAYGTDANELLLTALGMALYEWSGHEQIVISAEGHGREGHVPNIDISRTVGWFTSIYPILLDMSAPHSSEDQLGYRIKGTKDRLRRVPHKGTGYGLLVQKGAIQHKEPEISFNYLGQFSEGESSDLFQLSSYQPRYEIAGEREREYELDITALITDGRLQVKAVYTRVFHENTIQCLMDSFHSHLIEIIEHCTKKKEREKTLSDFSNKELTPSALSSIENLVKDL

SEQ ID NO: 437 - protein, 2571 aa, Bacillus halotolerans
MTQATQIQDIYPLSYMQEGMLFHSLLDFSSKAYVEQTSFTITGSLCIDSFQKSLNLLVSRYDIFRTIFIKEVPDLTGPQQVVLTNRELTVQREDLSHLKHDEQLALIEDFMQQDREKGFHLQKDPLMRLTLFDRGDSTYTCVWTHHHIIMDGWCLGIILKEFFSMYDSLKNNRPVQLDSTVPYSRYIEWLGEQDQEETAAYWRDYLQEYGNTASIPKLKSRSANGEYEAANIRFSLEPAIVQKLTAAAQNWGVTLNTLFMSLWGVLLHRYNGTDDAVFGSVVSGRPSAIDGIESMVGLFINTVPVRIRSAEKMRFSTLVKSVQEDTLRSEQHGYYPLYEIQNRSALKQGLIDHILVFENYPVQLQQAVNRQSENDENALKLDDISMSEQTSYDLNVVIVPGESFYIKFSYNAAVYEREEVLRIQGHLMEAMDCILSNPDIAVDSINIVPTEERKLIQSFNETERHYPNKTLSQLFEEQALKTPDAAALRMGDECRTYRQLDERANQIAHALIEKGAGSGGIVAVMMERSMDMAAALLGIWKAGGAYLPLDPSYPKERLSFLLHDSQAALLLTEEELISSIPSGYEGSIVTSGHTTHYRTDSPDASIGELAYLIYTSGTTGRPKGVLVDHQGIANTLQWRREEYGMSEGDTALHLFSYVFDGCVTSLFTPLLSGACVLLTTDNEAKDVLALRRKIAQYKISHMLIVPSLYRVLLEVLTAEDAKSLRIVTFAGEAVTPDLLETSRKICPSAELANEYGPTENSVATTILRHLNEEERITIGHPIANTKVYILQGEQLQPIGAAGELCISGAGLARGYYKRTELTEKAFTDHPFLKGERLYRTGDAGRFLPDGTIEYIGRFDDQVKIRGYRIELSEIETVLRQASGVKEAAVLARDVSDEEKELVAYIVPEKGNGLPNLHQHLAGTLPSYMIPASIIKITQMPLTSSGKLDRSALPEPENTTSLTYMPPQTLMETELARIWEEVLNKNQIGIRDDFFQLGGQSLKAATLVSRIHKRLNIELPLSDVFSYPTVESMAAKLMSLHEHAFTQIEPADFRDVYPLSFSQKRLYALYQLADDSTGYNMPAVLELRGHLDRGRLRKVLTELVNRHESLRTAFELNNGEPVQKIHPTLTADLKELEIESEQMLQSAISSFIKPFDLTAGPLFRASLISLEKERAYLLLDMHHIIADGISMSTLVQEFTDLYCGKELPALNLHYKDFAVWQQEKFPETHYSKQEAYWLKQLGGSLPVLDLPLDKTRPLLPDFSGGTFEVNIDKRTAEELHRLMFETGTTMYMLLLAVYSIMLSKLSGQEDIVVGSPAAGRPHADLERVIGMFVNTLAMRCQPEGRKTFSSYLQEIRELALTAYEHQDYPFEELVNKLETKREVNRNPLFDAMLVLQNSEDFRFEVPGLSISSVTPSHNVSKFDLTLHAEEHSDGIRCRFEYSTALFEEETIARWASHFIELVKGITSDIHRKLSEMQLLSAPARELLLETMGQYADYPRDESIVRLFEKQAAEHPEHTAVVCDHIRLTYRDLNEKAERTAAMLMKQGVRSGDIIGLMFDRSPDMVIGVLSILKAGGAYLPIDPEYPQERISFMLNDSGARILLTEHGHNKPADYHGQILYLNDAENELISPDLKAQETLADQPAYVIYTSGTTGQPKGVVVEHRNVISLLKHQDLPFDFGSEDVWTLFHSYCFDFSVWEMFGALLNGSTLVVVSRETARDPNAFRLLLKNEGVTVLNQTPTAFYGLIHEEENHTDRLHVRYVIFGGEALQPGMLVTWNEKYPDTDLINMYGITETTVHVTYKKLTSADIEKNKSNIGKPLATLQAYVMDAHMNLQPTGVPGELYIGGEGVARGYLNRDDLTAARFVPNPYLPGDRLYRTGDLAKRLASGDLEYMGRIDDQVKVRGHRIELGEIQASLLQLPIIKEAAVITRDDEQGQSAVYAYLVAEDGQVVNEADIRAALRAVLPDFMVPARLIQIDSIPLTVNGKLDQKALPEPDKRAQAENDISPRNEIEKAMADIWEELLEAEEIGVSANFFELGGDSIKALQVCARLKQRGYETTVREMFEHQTLGELSARVRKAVRVIDQTPVEGELPWTPVQQWFFSQSLETHHFNQSVMLYRAERFDDIALRNVLRSLVTHHDALRMICRYKDGKPVQVNRGADLPDEELYAFDLFDIRDHRSNTAGNAQGLSAEAHKQIEEMANQIQRTIRLETGPLLHAGLFKAEDGDHLFLTIHHLVIDAVSWRILFEDFSIAYEQAVSGKPIVLPEKTDSYFTYAQTLADYSKSRRLQREIAYWNEREDRHIERIPTDHTITSNSFKDTEVIDFELSREDTELLLTAANNAYNTETNDILLTALGLALQEWTGFDHFKISMEGHGREGYLDNIDMNRTVGWFTSIYPVWLDMSDSDHTDEGERLGRHIKQTKDMLHRIPHKGAGYGVLKYINKIWDSEYSDPEISFNYLGQFDQDVQSKAFEISDIKTGNEISPDWERPYVLDISGAVASGCLHMHIIYNRLQFKKQTIQALADHFKHALENMIQHCAGKENREWSAADFTDEDLTLEDLSEIMGAVNKL

SEQ ID NO: 438 - protein, 2554 aa, Bacillus subtilis
MPQQPEIQDIYPLSFMQEGMLFHSLYDEQSRAYFEQASFTINGQLDLDRFQKSMDAVFDRYEIFRTTFIYKNVAKPRQVVLKNRSCHVHFEDISHLNEREKEHCTEAFKEQDKKRGFDLQSDVLMRISVLKWAPERYVCIWSHHHILMDGWCLGIIIKDFLHIYQALGEGRLPYLQPVQPYGTYIKWLMQQDREEAAAYWKKRLQHFEKASSLPKRNEQVSEGELQQVTFTISEKETSDLQKIAAASGATLNTVFQALWGILLQKFNRCDDAVFGSVVSGRPSELEDVENIVGLFINTIPIRVQSKALSFSGLVSRMQKEMTEAEAYSYFPLYDIQAQSALKQELIDHIIVFENVPTQQEIEGLNQTGSFGFSVENFAMAEETNYGCSVKVIPGRTLFVRINFHTGLYEPGIIAEIKDYLQHMISAVISDPSLPVSKMTLLDHDKTQKMVAEYNTTGAVSALAPTLHGLFERQVALTPDRTALRFSGGSLTYAQLDMYANRLAARLTAHGITKESIVGVLSERSPDMLTAVLAVLKAGGAYVPLDPAYPEERLSYMLKDSGAALLLTQPGLKAPVFSGKTLEVDMTALANEESECHSLHQADSDSLAYVIYTSGSTGRPKGVAVEHRQAVSFLTGMQMQFPLEEDDIIMMKTSFSFDASVWQLFWWTLSGASAYLLPSGWEKDPALMVKAIREEGVTTAHFIPAMLNSFLDQAEIEAPRSLKRVFAGGEPLAPHTAARFASLLPETSLVHGYGPTEATVDAAFYACDPELDKNRLRLPIGKPVPGARLYVLDPHLAVQPVGVAGELYIAGAGVARGYLNRPELTEERFLDDPFYPGERMYKTGDLARWLPDGQVEFLGRLDDQVKIRGYRIEPGEIEAALRSIEGVREAAVTVRTESGEAELCAYAEGLGRNEVRKQLETLLPGYMIPAHIIEMEQWPVTPSGKLDRKALPAPDGAADRETYTAPRNLTEMKLSQLWEEVLKSGPVGIHDNFFDRGGHSLKATALVSRIAKEFGVQVPLKDVFAHPTVEGLASVISEGTESPYEAIKPAGKRETYPVSSAQKRMYVLQQLEDGGTGYNMPAVLELEGKLDLTRMDAVFKKLIKRHESLRTSFTTDTDGEPVQRIHDEVPFRFHTSVLGGQTEQEAASAFIQPFDLSQAPLFRAGIVKVSDGRHLLLVDMHHIISDGVSVNTLIREFGELYANQELPALHIQYKDYAVWQEAFKKGETYKTQEAYWLKQLEGELPVLDLPADYARPPVRTFAGDQVSFTLDQELTAGLHKLARENGSTLYMVLLAAYTALLARLSGQEDIIVGSPIAGRPHKDLEPILGMFVNTLALRARPEGGKPFAQFLQEVRETALEAYEHQDYPFEELVDKLGMTRDMSRNPLFDVMFVLQNMDQESMQLKDLCLRPATNVEHQVSKFDLTLYAYEEANGSMMFQMEYSTDLYQKNTIEMWLHYLMNMLRAIIQDSEAALGTIHVLDENETHFLIHELNCTKREYPRHETISRLFELQAAQTPDAIAVAGDEQTLTYKELNIRANRIAAVLRRKGVGPETVVALLTTRTPEIAAGMLGILKAGGAYLPIAKDLPADRISYMLSDSGAKILLQSEKANNQRLDLELKCEKIVIEEIQGQGETKNFEAPAGPHSLAYIIYTSGSTGKPKGVMIEQRSVIRLVKNSNYIEFTPEDRLLLTSSLGFDVVTFEILGPLLNGAALHLTDKETFLDSHQLKRYIEQNGITTMWLTASLFNHLTEQNEKIFSRLINLIIGGEALSASHVNRIKQACPELSIWNGYGPTENTTFSTCFHIEKLYEHSIPIGRPIGNSTAFILNKWGMLQPIGAVGELCVGGDGVARGYLGRPDLTKEKFVPNPFAPGEQMYRTGDLARWLPDGTIEYVGRVDDQVKIRGYRVELGEIESALRHIDGVKEAAVLARTGQLGTKELYAYISVKEGTDAEQVRTHLSQMLPGYMMPAYVIEMDALPLTANGKLNRKALPEPDITSKQTYVPPRNDLEEQLAIIWQEVLGTQRIGIEDSFFELGGDSIKALQVSARLGRYGWSLHASDLFRHPKIKDLSAVIRKTERVIDQGSVQGAVPWTPIQHWFLSQDIKERHHFNQSVMLFSPDCLSENALRASLKKLAEHHDALRMIYREDSGQQMQINQDIHESKLYSLRISDLSDSGMDWETSIKEEVANLQQSINLQQGPLLHAAWFKTLSGDYLFLTIHHLVVDGVSWRILLEDLSAAYHQAASGQAIQLPPKTDSYQEYARRVQDYAQSSKLIREETYWRSVEEEKAAELPYEMPYMENMNSSERETLRFSLTEADTAVLLQKVNHAYGTDTQDILLTAASLAICDWTGGSKLRMAMEGHGREHILPDLDISRTVGWFTSIYPVLIDFENQADELGPAVKTVKDTLGRIPNKGVGYGMLKYLTPPEHKSMVFSKTPEIGFNYLGQFNDIESQDRFRPSGLGSGKDITPTWKREQLIEMSAMAAENQLHFQLSYPPARFHRGAMERLITMIECYLQDIMKHCAEKQNTEKTLSDFSSQSLTAEDLDSISSLVEDL

SEQ ID NO: 439 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALAIHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGAAFSKIGKEFVPVYLHRDYLNLGERAVKVSKEDQNCASFVEVGQPIDYCQLRISDETNERVEDGIIGHIQIKGDNVTQGYYNNPESTEKALTSDGWVKTGDLGFISESGNLVVTGREKDIIFVNGKNVYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLDGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKAAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLISGDCEMALAGGIRTSLLPICIGLDMESSDGYTKTFSKDSDGTGTGEGAAAVLLKPLQDAVRDGDHIYGVIKGSAMNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAAFTSGDEPLRGGISSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLNRAAELFVQGAVIDWRALYSGETVQKTPLPLYPFERSRCWAEADQLRLNEDEKRGEAALNINQSKAHIESFLKTVISNASGIRAEELDLNAHFIGLGMDSIMLSQVKKAIADEFGVDIPMDRFFDTMNNLQSVIDYLAETVPSSFAPAPLQENVPAQEIQVISEAQSESDRREGHQEHMLEKIIASQNQLIQDTLQAQLNSFNLLRNSGHHSDEKEHAKAQEKSIPSVKQGPPAVTAEKKAAQEAKPYVPFQPQNLHDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHFNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSAAHTADDIENIILAVKDTVEDLRRGGFIPEGPDSPGGGGRKKSGTRELSPEQKQLVMASHCGNEASAALNQSIMLKVKGELQYTSLKQAVRHIVDRHEALRTVIHPDNEVQQVQERMNIEIPVIDFTSHPHEHREPEIQKWLTEDAKRPFHFHEQKPLFRIHVLTSAHNEHLIVLTFHHIIADGWSIAVFVQELESNYAAIVQGKAISPKEADVSFRQYLDWQQAQIDSGHYEEGVRYWRRHFSEPIQQPILPSTASVRYPNGYEGDRCTVRLGRPLNEALRSLSIQMKNSVFVTMLGAFHLFLHRLTKQSGLVIGVPAAGQSHMKQHDLIGNCVNMIPVKNTSTSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLNAMIMFSDEEQHALQALYAEHQKRVSSIGSNTANFTEAYEAPVNETERQLARIWEELFGLERVGRSDRFLALGGNSLQATLMLSKVQKTFHQKVSIGQFFNHQTVKELARFIQNETKVVHLPMKAAEKKAYYPTSPAQQRVYFLHQLEPDQLAQNMFGHISITGKYDEQALISSLQQVMQRHEAFRTYFDIIDGDIVQKLENEVDFNVHVRAMSRDEFDAYSDRFVKPFRLDQAPLVRAELIKIENEQAELLIDMHHIISDGYSVNILTNELLALYHQKPLPDIEFEYKDFAEWQNQRLNEDAMKRQETYWLEQFQDEIPILDLSTDGSIAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLAEQPEMTLSSVPMLSETERHQLLTECNGTKTPYPHKETVYRWFEMQAEQSPDHEAVIFGNERYTYRQLNERANRLARTLRTKGVQADQFVAIISPHRIELIVGILAVLKAGGAYVPIDPEYPEDRIQYMLRDSRAEVVLTQRSLLDQLPYDGDIVLLDEENSYHEEHSNLESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKSVSEQFKGRLDIFNEYGPTEAVVGCMIYHFDAERDKREFVPIGTPAANTDIYVADASRNLVPIGVIGEIYISGPGVARGYWNRPDLTEEKFVENPYVPGAKMYKSGDLAKRLKDGNLVYIGRVDEQVKIRGHRIELGEIEAAMHNAEAVQKAAVTVKEEEDGLKQLCAYYVSDKPIAAAQLREHLSSQLPDYMVPSYFVRLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGAIDPERINAAFRKLIARHEALRTSFDLYEGEPAQRIHQNVDFTIERIQASEEEAEDRVLDFIKAFDLAKPPLMRAGLIEIEPARHLLVVDMHHIISDGVSVNILMKDLSRIYEGNEPDPLSIQYKDFAVWQQSDIQKRNIKSQEAYWLDQFHGDIPVLDIPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELTFDSLQLKPYPFHHPVAKFDLTLSIQADRDNYHGLFEYSKKLFKKSRIEVLSNDYLHILSAILEQPSILIEHIGLSGSNEEEENALDSIQLNF

SEQ ID NO: 440 - protein, 5362 aa, Bacillus subtilis
MSVFKTQETYWENLFDEEDGLSAFPYFKAADKASLVRTGYQEKCICRSLSPEVSQRIMTMANHSDMAAYLILLAGIECLLYKYTDRTSLILGIPTVSKQKAGQSAVNNIVLLKNTLSNESTFKTVFGQLKEAVNDSLKNQNLPFRKMARHLSVQYNDEHMPLIHTVVSLNEIHSLQCKEDTATDTLFHFDLENNGIHLKLFYNGNLYDERYINQIVSHLDQLLSVILFQPQAAIHTAEILPEAQKQKLLFDFNDTVRDFSGSRTVYQLFEEQAERTPENAAVKFKNDHLTYRELNEKASRLARTLRNCGVQPDTLVAILADRSLEMIVSIIAVWKAGGAYVPLDPEYPKERLQYLLHDADADVLLVQHHLKNSLAFDGPVIDLNDEASYHADCSLLSPVAGHSHLAYVIYTSGTTGKPKGVMVEHGGIVNSLQWKKAFFKHSPADRVLVLYPYVFDAFILNFFGPLISGATLHLLPNEENKETFAIQNAIKQERITHFSTSPRLLKTMIEQMNREDFIHVQHVVVGGEQLETDTVEKLHSLQPRIRINNEYGPTENSVVSTFHPVQSADEQITIGSPVANHQAYILGAHHQIQPIGIPGELYVGGAGVARGYLNRPELTEEKFVEHLHVPGQKMYKTGDLARWLPDGRIEYLGRIDHQVKIRGYRIEIGEVEAAMFNLENVREAAVVAREDADGAKQLYAYYVGEPSLTAAQFREELSRELPNYMIPSRFIPLERIPLTSNGKIDLKALPAADENTRAENEYIAPRNTIEELLASIWQEVLGAERIGILDNFFDFGGDSIKSIQVSSRLYQAGYKVDMKHLFKHPSIAELSQFVAPVSRVADQGEVNGGTKLTPIQHWFFEQKMPHAHHYNQAVMLYSAEGFKEGPLRRTMERIASHHDALRMIFEKTPDGYAPRITGTDESELFHLEVMNYKGETDPAQAIADKANEIQSSMVLDKGPLMKLGLFQCPDGDHLLIAIHHLLIDGVSWRILLEDFASGYEQAERRQTIQLPQKTDSFPFWADQLSKYAAETDMEEEIAYWTELSSIKPQPLPKDTISEGSLLRDSEEVTIQWTKEETEQLLKQANRAYNTDINDLLLTSLGLAVHKWTGTEDIVVNLEGHGREPIIPDADISRTIGWFTSQYPVVLRMEAGKNLSQRIKIVKEGLRRIPDKGMNYSIIKYISGHPEADSLQLKPEISFNYLGQFDQDLKHQALRISPFSTGLSMNENQERTAVLDLNGMIAEGTLSLTLSYSSKQYERSTMAQFARGLKESLQEVIAHCVSRQQTSLTPSDILLKDISIDELEQLLEQTRELGEAENIYPLTPMQKGMLFHSLFDPNSGAYFQQTMFDLHGDLEIDSFSKSLDGLSQKYDIFRTNFYRGWKDQPLQIIFKTKKIGFQFNDLREMKESQKEAMIQKYAREDKMRGFDLEKGALMRLFILRTDEKTYRFIWSFHHILMDGWCLPLITKEIFENYFALLQQKQPEQSSITPYSQYIEWLGRQDAKEAAAYWDQYLEGYEEQTGLPKDHHAAEDGRYVPEKVTCDISSDLTSKMKRTAGKHHVTLNTLLQTAWAVLLQKYNRSRDVVFGSVVSGRPAGIPNVETMIGLFINTIPVRFRCEAGTTFAELMKEAQERAVASQKFETHPLYDIQARTTQKQDLITHLMIFENYPVDQYMESIGRQNGTSITISNVQMEEQTNYDFNLTVIPGDEMNISFEYNANVYERASIERVREHFMQILHQVVTDADIRVDQAELLTEGERRTLLQTLNDTAAPFPQTPVHQLFEEQSQRTPDQAAVIDKDRQLTYGELNKRANRLARTLRAKGVQTDQPVAIITRNSIESVVGILAVLKSGGAYVPIDPEYPQDRIRYMLDDSQAGIVLMQRDVRKQLAYEGVTVLLDDESSYHQDGSDLAPISDVSHLAYVIYTSGSTGRPKGVLIEHGGLTNYIWWAKEVYVKGEKANFPLYSSISFDLTVTSIFTPLVTGNAIIVYDGEDKTALLESIVRDPRVDIIKLTPAHLQVLKEMNIADQTAVRRMIVGGENLSTRLARSIHEQFEGRIEICNEYGPTETVVGCMIYRYDAAKDRRESVPIGTAAANTSIYVLDENMKPAPIGVPGEIYISGAGVARGYLNRPELTAEKFVDDPFEPGAKMYKTGDLAKWLADGNIEYAGRIDEQVKIRGYRIELGEIEAALLQEEVIKEAVVTAREDVHGFKQLCAYYVSGGQTTAARLRKQLSQTLASYMVPAYFIELDEMPLTSNGKINKKGLPAPDFELQDRAEYKAPRTKAEEILVSAWESVLGAENVSILDNFFDLGGDSIKSIQVSSRLNQQGYKMEIKDLFQYATIAELSPHIKQNLRIADQGEVKGKVSLTPIQHWFFEQTTTDQHYYNQAVMLHAPEGFQETQLRQTLQKLAEHHDALRMTFRTTENGCEAQNEEIAQSGLYRLEVMNLKEDPDPGRTIEAKADEIQSSMHLSDGPLMKAGLFQCADGDHLLIAIHHLIIDGISWRILLEDIVSGYKQAENGRVIQLPQKTDSFQLWAKRLSEYAQSETIKQEQEYWTKIEQTEVKPLPKDFHETHTTAKDSETAAVEWTKEETELLLKQANRAYHTEINDLLLTSLGLSISHWSGLEQIPIHLEGHGREQIIQDIDISRTVGWFTSLYPVVLHAQPGKEISDYIKTTKEGLRQIPHKGIGYGIARYLSGGMPSKLNPEISFNYLGQFDQDLQRHGVQLSSYSCGSDSSGHQERPYVLNINGMITDGRLKLTISYSSKQYAKETIMRLSETIQSRLRTIITHCVHKEQSELTPSDILLKGISIDELDQLLIQLPHAGEVENVYPLTPMQKGMLFHSLLDEASSSYFEQASFDLQGELKIDWFKASLERLFETYAVLRTRFYSGWNDTPLQIVYKTQTPQIHFADLRDIEEHLREDAIAAYQREDKAKGFDLARDPLMRIAIFRMEDRKYHLIWSFHHIVMDGWCLSLITKEVFDHYSALQEGREPEPLSAVPYSDYIEWLDRQDQGAAKRYWSGYLEGYKGETTLLHKIAQHEQKEYAYANLICRFDHEQTKQLQQIANQHQVTLNTLIQTLWGVLLQKYSGSADVVFGSVVSGRPAEIPDVEQMIGLFINTIPVRIRCDEDSTFADTMQMVQQNALASQSYDTYPLYEIQAQTEQKQNLIDHIMIFENYPIGQQAEETGHHGTELNITNFHMQEHSHYDLNVVVIPGKQLAVHFGFNENEYEKSEVERLRGHFEKLMQQVLRQPSVKIEDLELLTQQEKEYLLSRFQSNDMHYPREKTIHELFEEQAHRTPDNTAVVFEGKQFTYEELNRRANQLARTLQAKGVQADQLVGIMTERSLEMVVGILGVLKAGGAYLPIDPDSPSERIRYILNDSSISVLLYCGKLQDDIGFSGTCIDLMEEHFYHEKDSSLALSYQSSQLAYAIYTSGTTGKPKGTLIEHRQVIHLIEGLSRQVYSAYDAELNIAMLAPYYFDASVQQMYASLLSGHTLFIVPKEIVSDGAALCRYYRQHSIDITDGTPAHLKLLIAAGDLQGVTLQHLLIGGEALSKTTVNKLKQLFGEHGAAPGITNVYGPTETCVDASLFNIECSSDAWARSQNYVPIGKPLGRNRMYILDSKKRLQPKGVQGELYIAGDGVGRGYLNLPELTDEKFVADPFVPEDRMYRTGDLARLLPDGNIEYIGRIDHQVKIQGFRIELGEIESVMLNVPDIQEAAAAALKDADDEYYLCGYFAADKTIQISELRKRMARHLPGYMIPAHFVQLDKMPLTPNGKLNRQLLPAPVKKRDSGIEYVPPQTSAEIQLTAIWEDVLGLEQVGIRDHFFEIGGHSLRATALIAKIQKQMHVQIPLRDVFRFPTIEQLARTITKTELTGYAAIPAIEKRPYYPVSSAQKRLYILNHLEGGELSYNMLGLMTVEGKLDRDKLQQAFRTLILRHESLRTGFKMADGEPVQYVLDHAAFEAEWYQGEEDDADLYIRQFIRPFHLDEPPLLRVGLIELQPDRGILMFDMHHIISDGTSMSVLIKEFIRIYEGETLPPLRIQYKDYAVWQTGEARLQQIQKQEAYWLELYSGDVPVLHLPADYIRPSARDFAGATMHFTLDKQKSDGLKQLASQTESTLYMVLLASYTLLLSKYSGQEDIIVGSPIAGRPHADLEPIIGMFVNTLAMRNYPEKGKTFSQYLSEVKENALKAYEHQDYPFEVLIDQLNIARDLSRNPLFDTMFVLQNTEQEQLEINDVTFKPYPNGHTMAKFDLTLTAVEEGAGIQFTLEYLTALFKPETIERMMGHFEQLVDSIIKQPEAELARLNMMTKEEERDIQQLFNDTAVAEKRIPTTIHQLFEQQAERNPDHEAVMFGNQTLTYRQLNERSNQLARVLQDKGACTDQVVAVLTDRSAHMIIGILAILKAGAAFLPIDPELPEKRRAFMLKDSGADVLLTCAGHAIPPLFEGEVLLLDDPLLYQGRTDNLNLSCSENDLMYVIYTSGTTGQPKGVQLEHKTMTNLLAYEQDHTQLRFDRVLQFAAMSFDVCYQEMFSALSSGGILFIIGNEAKRDIRQLNDFVRTHGIQTAFLPTAFLKLLASEKHYFEPFAECVDHIIAAGEQLIATRMLRDMLARHQVTLHNHYGPSETHVVTMYTVDPDTDQELQPIGKPISNTEIFILNEAGTLQPVGIVGELCISGVSLARGYHNRESLTLETFVPHPYDSNQRMYKTGDLARYLPEGNIEYAGRRDHQVKIRGYRVELGEVEAALLKHVQEAVVLAKENTDGQSDLYAYFTAEQSLSISQLKEKLAGQIPGYMIPSYFIQLEKLPLTGNGKVNRRALPMPEAGLQTGTDYVAPRTNMEEQLICIWQDVLKVKEIGVKDNFFDLGGHSLRGMTLIAKIHKQFSKNISLREVFQCPTVGEMAQAIAEAETNGPDYIPKAKAKDVYPVSSVQKMVYLTTQIIGGELPYNMTGILETEGKLPLNRLLTAFQRLMQGHEPLRTVVEMVREEAVQVIKSQVEFSMERYEATADEVEECFRAFVRPFDLSQAPLLRAGLIELEQDLHIFMFDMHHIITDGASMNIFVEKLIQLYDGKELAPLRIQYKDFTEWKHQKEQRERIKSQEEYWLGVFHEELPSFELPKDFARPPVRSFDGKRHNFTLDKTVTQGIKQLEELTGSTAYMILFSAYSILLAKYSGQDDIVVGTPIAGRPHADLEPIIGMFVNTLAIRTAPMAEKTFLDYITETKETMLKAFEHQEYPFEELVEKLGVKRDLSRNPLFDTMFVLQNTEQTDIEVDSLAVRPYEQTETAAKFDLQLNFLIDQDEIQGSFDYCTKLFKKKTIAVLAKDYVMILSAIMRNPSIPLKDIQLSEKVNKSKHLASTIELDF

SEQ ID NO: 441 - protein, 2618 aa, Bacillus subtilis
MSEFKQQELFWGRMFHTEDRPSAFPSFQMSDSTVKRDITSGSDCIHSSLSADVSRRILTMTNQTPMAVYLVLLIGIESLLYKYTGEEGVITGVPSFEDETDEDLRSDQLMLIKQHINSGSTFKSIFHELKHTLDEAILYQDVPFDKMAGQLRLNYNANHLPIIDTVVSLEQIHPDGFIETAAADALFQFAMGEDLIDIKLCFNEQVYDRQYMMQVLGHLNRLFSVILFQPELPLGQVNILPESETHSLLVDNQTAKTEYPRDKTVYQLFEEQMKRTPDQAAVIYGEKQFTYRQLNERANQLARTLRKKGVKTDRLTAIICEHEIELVVGILAVLKAGGAYVPIDPDYPKHRIQYIVEDSQADIVLTQSHLQKQLELAGTMVFLDQESSYHEDGSYLEPISSTKDLAYVIYTSGSTGKPKGVAIEHQGLTNYIWWARRVYVKGEKTNFPLYSSIAFDLTITSVFTPLITGNAIIVYGGENSTALLDSIIQDSRADIIKLTPAHLQLLKEINIPAECTIRKFIVGGDNLSTRLARSISGKFGGKIEIFNEYGPTETVVGCMIYSFDPQNDRRESVPIGTAADNMNIFVLDKSMKPVPAGVPGEIYISGDGIARGYLNRAELTAERFLQHPFVPEVKMYRTGDLARRLPDGNIEYLGRIDHQVKIRGYRIEIGEVESAFFQIPPIQEALVTAQETNGETSLCAYYTAQHSLTAGEIREHLSRQLPSYMIPAYFVQLAAMPLTSNGKIDRQALPAPTGNLTGNPYTAPRTELEKILAGVWESVLGAEQVGIDDHFFELGGDSIKSIQVTSSLYQAGYKLDIKHLFKHPTISGLAPFIKPVTRIAEQGEIKGRTLLTPIQHWFFARQYPDPHHYNQSVMLYFKEGLDESKLQKVMKKIAEHHDALRMVYVQGDHEYEARTCGISEGELFSLDVFSLLEENNLAETIEMIANDIQQSIHLADGPLMKLGLFQCQDGDHLLIAIHHLVVDGVSWRILLEDITSAYEQLQNGEAITLPKKTDSYLLWAERLKRYAESPEFEAKNQYWLEQKHISQQKLPKDNEHETGLAEDRETIIVQWTEEETERLLKKSNRAYTTDINDLLLTGLGMAVHRWTGHEEIHVHLEGHGRESVFQDVDISRTVGWFTTQYPVSLQIQADRDISQRIRTVKEQLRQIPQKGIGYGLMKYLSDHPKASEWTGHPEISFNYLGQFDQDFENGGIEVSPYSGGKIASDRHPIAYTLDINGMISDGRLSLAISYSGKQYRRETMETCAALLKNSLKEVIEHCAAQEHIHLTPSDISLKDITIEELDQFVKQTQHIGDIENIYPLTPMQKGMLFHSLIDSASRAYFEQAAFDLKGDLDIEAFTMSLSYLAESHEILRTHFYTEWKDQPLQIVFRKKPIEITVEDIRSMKNKQRNEFIAGFVQKDKARGFDLTQDALMRVSILRTEDDQVRLIWSFHHILMDGWCLPLITKEVFETYYELLERRQPEREAVTPYSRYIEWLEDQDHQNALAYWQKYLDGYEGQTVLLKEPVSNQAKGYQKQRLACRLGKQLSEEIRQTASKHHVTVNTFIQSAWGLLLQRYNNSQDVVFGSVVSGRPAEIPGIESMVGLFINTIPVRITAQPGMTVEQVLKMSQEQALASQAYDTFPLYEIQAQTEQKQQLISHIMVFENYPVEKQMEHMKPNRDALDIINFHMEEHTHYDFNFIVMPAGEIDIHFVYNSNVYDHASVKRMEEHFMQIIKQMVNSQAIRVQDLDILTGDERSLLIEAFNDTEADYPKEKTLHQLFEEQAQRTPDQTAVVYGESQLTYRELNERANQLARTLQSEGVQPDQPVGIMAERSLEMIVGLFGILKAGGAYVPIDPSYPVERIHYILEDSDTKLLLAQSHLRKSVPFTGKVLDLEDPRFSWEDGSNLKQTAGPNHLAYVIYTSGSTGRPKGVMVEHRSVINRLVWMQEHYPLDKQDVILQKTPITFDVSVWELFWWSMTGSKAVLLSNGGEKNPDVILDTIAQKNVTIMHFVPAMLHAFLESMEQKSDEELKRKLASLKYVFASGEALTPAHVAGFHRMITPAGEAQIINLYGPTEATIDVSYFECEAGETLNSVPIGKPISNIQLYIVQPGSEYFQPLGVAGELCIAGDGLARGYLNRPELTAEKFAAHPFEAGKRMYRTGDLARWLPDGNIEYLGRIDHQVKIRGYRIELGEIEASLLQLDAVKEAVVIAIEKEGSKQLCAYLSGDESLNTAQLKRHLLNKLPAYMIPAYFVQVEKMPITANGKIDRKALPAPEGNRLTGTEYTAPGTLIEKQLADIWKDILALPDPGIKDHFFDVGGHSLKVLQLIHQINAGMGLNMHYQAVYDFPTIETMARAIQAAVFESETDHNVFVKLNQEDSIPVFCFPPLIGYGLVYNEMAKRLDGVSTVYAADFLEEPSHEKEIVDRYAESMIRIQEQGPFVLLGYSSGSNLAFEAAKALEKRGRTVSDVIMLDSKITTSVTHLSEEEIEEIVHLNMDIIPDYYREILTIPSIKDKIRGYLAYHNEVINSGAVNANIHHLLCGDVTDDRGWTQSTAQHYLEYKLKGDHVTIFEPHNIEENAEAIRSIIKRIEERHHHGLVLEEQLSMGSFAGNTKFDNM

SEQ ID NO: 442 - protein, 224 aa, Bacillus subtilis
MKIYGIYMDRPLSQEENERFMSFISPEKREKCRRFYHKEDAHRTLLGDVLVRSVISRQYQLDKSDIRFSTQEYGKPCIPDLPDAHFNISHSGRWVICAFDSQPIGIDIEKTKPISLEIAKRFFSKTEYSDLLAKDKDEQTDYFYHLWSMKESFIKQEGKGLSLPLDSFSVRLHQDGQVSIELPDSHSPCYIKTYEVDPGYKMAVCAAHPDFPEDITMVSYEELL

SEQ ID NO: 443 - protein, 3587 aa, Bacillus subtilis
MEITFYPLTDAQKRIWYTEKFYPHTSISNLAGIGKLVSADAIDYVLVEQAIQEFIRRNDAMRLRLRLDENGEPVQYISEYRPVDIKHTDTTEDPNAIEFISQWSREETKKPLPLYDCDLFRFSLFTIKENEVWFYANVHHVISDGISMNILGNAIMHIYLELASGSETKEGISHSFIDHVLSEQEYAQSKRFEKDKAFWNKQFESVPELVSLKRNASAGGSLDAERFSKDVPEALHQQILSFCEANKVSVLSVFQSLLAAYLYRVSGQNDVVTGTFMGNRTNAKEKQMLGMFVSTVPLRTNIDGGQAFSEFVKDRMKDLMKTLRHQKYPYNLLINDLRETKSSLTKLFTVSLEYQVMQWQKEEDLAFLTEPIFSGSGLNDVSIHVKDRWDTGKLTIDFDYRTDLFSREEINMICERMITMLENALTHPEHTIDELTLISDAEKEKLLARAGGKSVSYRKDMTIPELFQEKAELLSDHPAVVFEDRTLSYRTLHEQSARIANVLKQKGVGPDSPVAVLIERSERMITAIMGILKAGGAYVPIDPGFPAERIQYILEDCGADFILTESKVAAPEADAELIDLDQAIEEGAEESLNADVNARNLAYIIYTSGTTGRPKGVMIEHRQVHHLVESLQQTIYQSGSQTLRMALLAPFHFDASVKQIFASLLLGQTLYIVPKKTVTNGAALTAYYRKNSIEATDGTPAHLQMLAAAGDFEGLKLKHMLIGGEGLSSVVADKLLKLFKEAGTAPRLTNVYGPTETCVDASVHPVIPENAVQSAYVPIGKALGNNRLYILDQKGRLQPEGVAGELYIAGDGVGRGYLHLPELTEEKFLQDPFVPGDRMYRTGDVVRWLPDGTIEYLGREDDQVKVRGYRIELGEIEAVIQQAPDVAKAVVLARPDEQGNLEVCAYVVQKPGSEFAPAGLREHAARQLPDYMVPAYFTEVTEIPLTPSGKVDRRKLFALEVKAVSGTAYTAPRNETEKAIAAIWQDVLNVEKAGIFDNFFETGGHSLKAMTLLTKIHKETGIEIPLQFLFEHPTITALAEEADHRESKAFAVIEPAEKQEHYPLSLAQQRTYIVSQFEDAGVGYNMPAAAILEGPLDIQKLERAFQGLIRRHESLRTSFVLENSTPRQKIHDSVDFNIEMIERGGRSDEAIMASFVRTFDLAKAPLFRIGLLGLEENRHMLLFDMHHLISDGVSIGIMLEELARIYKGEQLPDLRLQYKDYAVWQSRQAAEGYKKDQAYWKEVFAGELPVLQLLSDYPRPPVQSFEGDRVSIKLDAGVKDRLNRLAEQNGATLYMVMLSAYYTLLSKYTGQDDIIVGTPSAGRNHSDTEGIIGMFVNTLAIRSEVKQNETFTQLISRVRKRVLDAFSHQDYPFEWLVEDLNIPRDVSRHPLFDTMFSLQNATEGIPAVGDLSLSVQETNFKIAKFDLTVQARETDEGIEIDVDYSTKLFKQSTADRLLTHFARLLEDAAADPEKPISEYKLLSEEEAASQIQQFNPGRTPYPKDKTIVQLFEEQAANTPDHTALQYEGESLTYRELNERANRLARGILSLGAGEGRTAAVLCERSMDMIVSILAVLKSGSAYVPIDPEHPIQRMQHFFRDSGAKVLLTQRKLKALAEEAEFKGVIVLADEEESYHADARNLALPLDSAAMANLTYTSGTTGTPKGNIVTHANILRTVKETNYLSITEQDTILGLSNYVFDAFMFDMFGSLLNGAKLVLIPKETVLDMARLSRVIERENISILMITTALFHLLVDLNPACLSTLRKIMFGGERASVEHVRKALQTVGKGKLLHMYGPSESTVFATYHPVDELEEHTLSVPIGKPVSNTEVYILDRTGHVQPAGIAGELCVSGEGLVKGYYNRPELTEEKFVPHPFTSGERMYKTGDLARWLPNGDIEFIGRIDHQVKIRGQRIELGEIEHQLQTHDRVQESVVLAVDQGAGDKLLCAYYVGEGDISSQEMREHAAKDLPAYMVPAVFIQMDELPLTGNGKIDRRALPIPDANVSRGVSYVAPRNGTEQKVADIWAQVLQAEQVGAYDHFFDIGGHSLAGMKMLALVHQELGVELSLKDLFQSPTVEGLAQVIASAEKGTAASISPAEKQDTYPVSSPQKRMYVLQQLEDAQTSYNMPAVLRLTGELDVERLNSVMQQLMQRHEALRTTFEIKDGETVQRIWEEAECEIAYFEAPEEETERIVSEFIKPFKIDQLPLFRIGLIKHSDTEHVLLFDMHHIISDGASVGVLIEELSKLYDGETLEPLRIQYKDYAVWQQQFIQSELYKKQEEHWLKELDGELPVLTLPTDYSRPAVQTFEGDRIAFSLEAGKADALRRLAKETDSTLYMVLLASYSAFLSKISGQDDIIVGSPVAGRSQADVSRVIGMFVNTLALRTYPKGEKTFADYLNEVKETALSAFDAQDYPLEDLIGNVQVQRDTSRNPLFDAVFSMQNANIKDLTMKGIQLEPHPFERKTAKFDLTLTADETDGGLTFVLEYNTALFKQETIERWKQYWMELLDAVTGNPNQPLSSLSLVTETEKQALLEAWKGKALPVPTDKTVHQLFEETAQRHKDRPAVTYNGQSWTYGELNAKANRLARILMDCGISPDDRVGVLTKPSLEMSAAVLGVLKAGAAFVPIDPDYPDQRIEYILQDSGAKLLLKQEGISVPDSYTGDVILLDGSRTILSLPLDENDEENPETAVTAENLAYMIYTSGTTGQPKGVMVEHHALVNLCFWHHDAFSMTAEDRSAKYAGFGFDASIWEMFPTWTIGAELHVIEEAIRLDIVRLNDYFETNGVTITFLPTQLAEQFMELENTSLRVLLTGGDKLKRAVKKPYTLVNNYGPTENTVVATSAEIHPEEGSLSIGRAIANTRVYILGEGNQVQPEGVAGELCVAGRGLARGYLNREDETAKRFVADPFVPGERMYRTGDLVKWTGGGIEYIGRIDQQVKVRGYRIELSEIEVQLAQLSEVQDAAVTAVKDKGGNTAIAAYVTPESADIEALKSALKETLPDYMIPAFWVTLNELPVTANGKVDRKALPEPDIEAGSGEYKAPTTDMEELLAGIWQDVLGMSEVGVTDNFFSLGGDSIKGIQMASRLNQHGWKLEMKDLFQHPTIEELTQYVERAEGKQADQGPVEGEVILTPIQRWFFEKNFTNKHHWNQSVMLHAKKGFDPERVEKTLQALIEHHDALRMVYREGQEDVIQYNRGLEAASAQLEVIQIEGQAADYEDRIEREAERLQSSIDLQEGGLLKAGLFQAEDGDHLLLAIHHLVVDGVSWRILLEDFAAVYTQLEQGNEPVLPQKTHSFAEYAERLQDFANSKAFLKEKEYWRQLEEQAVAAKLPKDRESGDQRMKHTKTIEFSLTAEETEQLTTKVHEAYHTEMNDILLTAFGLAMKEWTGQDRVSVHLEGHGREEIIEDLTISRTVGWFTSMYPMVLDMKHADDLGYQLKQMKEDIRHVPNKGVGYGILRYLTAPEHKEDVAFSIQPDVSFNYLGQFDEMSDAGLFTRSELPSGQSLSPETEKPNALDVVGYIENGKLTMSLAYHSLEFHEKTVQTFSDSFKAHLLRIIEHCLSQDGTELTPSDLGDDDLTLDELDKLMEIF

SEQ ID NO: 444 - protein, 3583 aa, Bacillus subtilis
MSKKSIQKVYALTPMQEGMLYHAMLDPHSSSYFTQLELGIHGAFDLEIFEKSVNELIRSYDILRTVFVHQQLQKPRQVVLAERKTKVHYEDISHADENRQKEHIERYKQDVQRQGFNLAKDILFKVAVFRLAADQLYLVWSNHHIMMDGWSMGVLMKSLFQNYEALRAGRTPANGQGKPYSDYIKWLGKQDNEEAESYWSERLAGFEQPSVLPGRLPVKKDEYVNKEYSFTWDETLVARIQQTANLHQVTGPNLFQAVWGIVLSKYNFTDDVIFGTVVSGRPSEINGIETMAGLFINTIPVRVKVERDAAFADIFTAVQQHAVEAERYDYVPLYEIQKRSALDGNLLNHLVAFENYPLDQELENGSMEDRLGFSIKVESAFEQTSFDFNLIVYPGKTWTVKIKYNGAAFDSAFIERTAEHLTRMMEAAVDQPAAFVREYGLVGDEEQRQIVEVFNSTKAELPEGMAVHQVFEEQAKRTPASTAVVYEGTKLTYRELNAAANRLARKLVEHGLQKGETAAIMNDRSVETVVGMLAVLKAGAAYVPLDPALPGDRLRFMAEDSSVRMVLIGNSYTGQAHQLQVPVLTLDIGFEESEAADNLNLPSAPSDLAYIMYTSGSTGKPKGVMIEHKSILRLVKNAGYVPVTEEDRMAQTGAVSFDAGTFEVFGALLNGAALYPVKKETLLDAKQFAAFLREQSITTMWLTSPLFNQLAAKDAGMFGTLRHLIIGGDALVPHIVSKVKQASPSLSLWNGYGPTENTTFSTSFLIDREYGGSIPIGKPIGNSTAYIMDEQQCLQPIGAPGELCVGGIGVARGYVNLPELTEKQFLEDPFRPGERIYRTGDLARWLPDGNIEFLGRIDNQVKVRGFRIELGEIETKLNMAEHVTEAAVIIRKNKADENEICAYFTADREVAVSELRKTLSQSLPDYMVPAHLIQMDSLPLTPNGKINKKELPAPQSEAVQPEYAAPKTESEKKLAEIWEGILGVKAGVTDNFFMIGGHSLKAMMMTAKIQEHFHKEVPIKVLFEKPTIQELALYLEENESKEEQTFEPIRQASYQQHYPVSPAQRRMYILNQLGQANTSYNVPAVLLLEGEVDKDRLENAIQQLINRHEILRTSFDMIDGEVVQTVHKNISFQLEAAKGREEDAEEIIKAFVQPFELNRAPLVRSKLVQLEEKRHLLLIDMHHIITDGSSTGILIGDLAKIYQGADLELPQIHYKDYAVWHKEQTNYQKDEEYWLDVFKGELPILDLPADFERPAERSFAGERVMFGLDKQITAQIKSLMAETDTTMYMFLLAAFNVLLSKYASQDDIIVGSPTAGRTHPDLQGVPGMFVNTVALRTAPAGDKTFAQFLEEVKTASLQAFEHQSYPLEELIEKLPLTRDTSRSPLFSVMFNMQNMEIPSLRLGDLKISSYSMLHHVAKFDLSLEAVEREEDIGLSFDYATALFKDETIRRWSRHFVNIIKAAAANPNVRLSDVDLLSSAETAALLEERHMTQITEATFAALFEKQAQQTPDHSAVKAGGNLLTYRELDEQANQLAHHLRAQGAGNEDIVAIVMDRSAEVMVSILGVMKAGAAFLPIDPDTPEERIRYSLEDSGAKFAVVNERNMTAIGQYEGIIVSLDDGKWRNESKERPSSISGSRNLAYVIYTSGTTGKPKGVQIEHRNLTNYVSWFSEEAGLTENDKTVLLSSYAFDLGYTSMFPVLLGGGELHIVQKETYTAPDEIAHYIKEHGITYIKLTPSLFHTIVNTASFAKDANFESLRLIVLGGEKIIPTDVIAFRKMYGHTEFINHYGPTEATIGAIAGRVDLYEPDAFAKRPTIGRPIANAGALVLNEALKLVPPGASGQLYITGQGLARGYLNRPQLTAERFVENPYSPGSLMYKTGDVVRRLSDGTLAFIGRADDQVKIRGYRIEPKEIETVMLSLSGIQEAVVLAVSEGGLQELCAYYTSDQDIEKAELRYQLSLTLPSHMIPAFFVQVDAIPLTANGKTDRNALPKPNAAQSGGKALAAPETALEESLCRIWQKTLGIEAIGIDDNFFDLGGHSLKGMMLIANIQAELEKSVPLKALFEQPTVRQLAAYMEASAVSGGHQVLKPADKQDMYPLSSAQKRMYVLNQLDRQTISYNMPSVLLMEGELDISRLRDSLNQLVNRHESLRTSFMEANGEPVQRIIEKAEVDLHVFEAKEDEADQKIKEFIRPFDLNDAPLIRAALLRIEAKKHLLLLDMHHIIADGVSRGIFVKELALLYKGEQLPEPTLHYKDFAVWQNEAEQKERMKEHEAYWMSVLSGELPELDLPLDYARPPVQSFKGDTIRFRTGSETAKAVEKLLAETGTTLHMVLHAVFHVFLSKISGQRDIVIGSVTAGRTNADVQDMPGMFVNTLALRMEAKEQQTFAELLELAKQTNLSALEHQEYPFEDLVNQLDLPRDMSRNPLFNVMVTTENPDKEQLTLQNLSISPYEAHQGTSKFDLTLGGFTDENGIGLQLEYATDLFAKETAEKWSEYVLRLLKAVADNPNQPLSSLLLVTETEKQALLEAWKGKALPVPTDKTVHQLFEETVQRHKDRPAVTYNGQSWTYGELNAKANRLARILMDCGISPDDRVGVLTKPSLEMSAAVLGVLKAGAAFVPIDPDYPDQRIEYILQDSGAKLLLKQEGISVPDSYTGDVILLDGSRTILSLPLDENDEGNPETAVTAENLAYMIYTSGTTGQPKGVMVEHHALVNLCFWHHDAFSMTAEDRSAKYAGFGFDASIWEMFPTWTIGAELHVIDEAIRLDIVRLNDYFETNGVTITFLPTQLAEQFMELENTSLRVLLTGGDKLKRAVKKPYTLVNNYGPTENTVVATSAEIHPEEGSLSIGRAIANTRVYILGEGNQVQPEGVAGELCVAGRGLARGYLNREDETAKRFVADPFVPGERMYRTGDLVKWVNGGIEYIGRIDQQVKVRGYRIELSEIEVQLAQLSEVQDAAVTAVKDKGGNTAIAAYVTPETADIEALKSTLKETLPDYMIPAFWVTLNELPVTANGKVDRKALPEPDIEAGSGEYKAPTTDMEELLAGIWQDVLGMSEVGVTDNFFSLGGDSIKGIQMASRLNQHGWKLEMKDLFQHPTIEELTQYVERAEGKQADQGPVEGEVILTPIQRWFFEKNFTNKHHWNQSVMLHAKKGFDPERVEKTLQALIEHHDALRMVYREENGDIVQVYKPIGESKVSFEIVDLYGSDEEMLRSQIKLLANKLQSSLDLRNGPLLKAEQYRTEAGDHLLIAVHHLVVDGVSWRILLEDFASGYMQAEKEESLVFPQKTNSFKDWAEELAAFSQSAHLLQQAEYWSQIAAEQVSPLPKDCETEQRIVKDTSSVLCELTAEDTKHLLTDVHQPYGTEINDILLSALGLTMKEWTKGAKIGINLEGHGREDIIPNVNISRTVGWFTAQYPVVLDISDADASAVIKTVKENLRRIPDKGVGYGILRYFTETAETKGFTPEISFNYLGQFDSEVKTDFFEPSAFDMGRQVSGESEALYALSFSGMIRNGRFVLSCSYNEKEFERATVEEQMERFKENLLMLIRHCTEKEDKEFTPSDFSAEDLEMDEMGDIFDMLEENLK

SEQ ID NO: 445 - protein, 1275 aa, Bacillus subtilis
MSQFSKDQVQDMYYLSPMQEGMLFHAILNPGQSFYLEQITMKVKGSLNIKCLEESMNVIMDRYDVFRTVFIHEKVKRPVQVVLKKRQFHIEEIDLTHLTGSEQTAKINEYKEQDKIRGFDLTRDIPMRAAIFKKAEESFEWVWSYHHIILDGWCFGIVVQDLFKVYNALREQKPYSLPPVKPYKDYIKWLEKQDKQASLRYWREYLEGFEGQTTFAEQRKKQKDGYEPKELLFSLSEAETKAFTELAKSQHTTLSTALQAVWSVLISRYQQSGDLAFGTVVSGRPAEIKGVEHMVGLFINVVPRRVKLSEGITFNGLLKRLQEQSLQSEPHQYVPLYDIQSQADQPKLIDHIIVFENYPLQDAKNEESSENGFDMVDVHVFEKSNYDLNLMASPGDEMLIKLAYNENVFDEAFILRLKSQLLTAIQQLIQNPDQPVSTINLVDDREREFLLTGLNPPAQAHETKPLTYWFKEAVNANPDAPALTYSGQTLSYRELDEEANRIARRLQKHGAGKGSVVALYTKRSLELVIGILGVLKAGAAYLPVDPKLPEDRISYMLADSAAACLLTHQEMKEQAAELPYTGTTLFIDDQTRFEEQASDPATAIDPNDPAYIMYTSGTTGKPKGNITTHANIQGLVKHVDYMAFSDQDTFLSVSNYAFDAFTFDFYASMLNAARLIIADEHTLLDTERLTDLILQENVNVMFATTALFNLLTDAGEDWMKGLRCILFGGERASVPHVRKALRIMGPGKLINCYGPTEGTVFATAHVVHDLPDSISSLPIGKPISNASVYILNEQSQLQPFGAVGELCISGMGVSKGYVNRADLTKEKFIENPFKPGETLYRTGDLARWLPDGTIEYAGRIDDQVKIRGHRIELEEIEKQLQEYPGVKDAVVVADRHESGDASINAYLVNRTQLSAEDVKAHLKKQLPAYMVPQTFTFLDELPLTTNGKVNKRLLPKPDQDQLAEEWIGPRNEMEETIAQIWSEVLGRKQIGIHDDFFALGGHSLKAMTAASRIKKELGIDLPVKLLFEAPTIAGISAYLKNGGSDGLQDVTIMNQDQEQIIFAFPPVLGYGLMYQNLSSRLPSYKLCAFDFIEEEDRLDRYADLIQKLQPEGPLTLFGYSAGCSLAFEAAKKLEEQGRIVQRIIMVDSYKKQGVSDLDGRTVESDVEALMNVNRDNEALNSEAVKHGLKQKTHAFYSYYVNLISTGQVKADIDLLTSGADFDMPEWLASWEEATTGVYRVKRGFGTHAEMLQGETLDRNAEILLEFLNTQTVTVS

SEQ ID NO: 446 - protein, 242 aa, Bacillus subtilis
MSQLFKSFDASEKTQLICFPFAGGYSASFRPLHAFLQGECEMLAAEPPGHGTNQTSAIEDLEELTDLYKQELNLRPDRPFVLFGHSMGGMITFRLAQKLEREGIFPQAVIISAIQPPHIQRKKVSHLPDDQFLDHIIQLGGMPAELVENKEVMSFFLPSFRSDYRALEQFELYDLAQIQSPVHVFNGLDDKKCIRDAEGWKKWAKDITFHQFDGGHMFLLSQTEEVAERIFAILNQHPIIQP

SEQ ID NO: 447 - protein, 380 aa, Bacillus badius
MSLVEKTSIIKDFTLFEKMSEHEQVVFCNDPATGLRAIIAIHDTTLGPALGGCRMQPYNSVEEALEDALRLSKGMTYKCAASDVDFGGGKAVIIGDPQKDKSPELFRAFGQFVDSLGGRFYTGTDMGTNMEDFIHAMKETNCIVGVPEAYGGGGDSSIPTAMGVLYGIKATNKMLFGKDDLGGVTYAIQGLGKVGYKVAEGLLEEGAHLFVTDINEQTLEAIQEKAKTTSGSVTVVASDEIYSQEADVFVPCAFGGVVNDETMKQFKVKAIAGSANNQLLTEDHGRHLADKGILYAPDYIVNSGGLIQVADELYEVNKERVLAKTKHIYDAILEVYQQAELDQITTMEAANRMCEQRMAARGRRNSFFTSSVKPKWDIRN

SEQ ID NO: 448 - protein, 478 aa, Bacillus subtilis
MNSLMNDDMVKIIRNGLSASQHPKHILVIGAGLSGLVSASLLKNAGHRVTILEASGRAGGRVCTLRSPFSDDLYFNAGPMRIPNNHSLTLEYIKKFKLPTNVFINRTPMDIIYANGIKTRLQVFERAPGILRYPVAPNEQGKTSEELMLSLLQPILNFINQNPARNWRIVEEQYKNHSLSSFLNTYFSYGAIDMIGVLLDMEAYMGMSLVEVLRESIFFSSPAHFYEITGGMDLLPHAFLPQLKTNILYHQKMMKMSQGENRVTIHCQHQQTAEFTSFTADLAIVTIPFSTLRFVKVEPYHSFSYYKRRAIRELNYISATKIGIEFKSRFWEKAGQHGGKSITDLPIRFSYYPSRNIGANGHAVILASYTWADEALIWDSLSEGERIQYTLLNLSEIYGDIVWSEFVSGTSFSWSQYPYSAGGFTAFEPGQELELYPYIPVPEGRVHFAGEHASLTHAWMQGAIESGIRVAYEVNRLP

SEQ ID NO: 449 - protein, 295 aa, Bacillus sp.
METPRKVEHQQTDRGYVPVYATGVVEQPWASYSKTDHEVWDTLYKRQRELLPGRACKEFMAGVERFGLGDGGIPKFTELNTVLGAATGWEVVAVEGLLPDEVFFDHLANRRFPVSWWIRKPDQLDYLSEPDLFHDLFGHVPLLLNPVFADYMQAYGRGGMKAFAIGPDALMNLTRLYWYTVEFGLIDTGEGMRIYGAGIVSSKGESIYSLDSPSPNRIGFDLERVMSTRYRIDTYQQTYFVIDSFEQLFEATHPDFTPIYAKLHESPAHAAGDVLDGDRVFTRGDRVGWATNADT

SEQ ID NO: 450 - protein, 392 aa, Bacillus sp.
MKELLANRVKTLTPSTTLAITAKAKEMKAQGIDVIGLGAGEPDFNTPQNIMDAAIDSMQQGYTKYTPSGGLPALKQAIIEKFKRDNQLEYKPNEIIVGVGAKHVLYTLFQVILNEGDEVIIPIPYWVSYPEQVKLAGGVPVYIEATSEQNYKITAEQLKNAITDKTKAVIINSPSNPTGMVYTREELEDIAKIALENNILIVSDEIYEKLLYNGAEHFSIAQISEEVKAQTIVINGVSKSHSMTGWRIGYAAGNADIINAMTDLASHSTSNPTTASQYAAIEAYNGPQDSVEEMRKAFESRLETIYPKLSAIPGFKVVKPQGAFYLLPDVSEAAQKTGFASVDEFASALLTEANVAVIPGSGFGAPSTIRISYATSLNLIEEAIERIDRFVK

SEQ ID NO: 451 - protein, 352 aa, Enterococcus faecium
MSFLNQTYQNLTPYTPGEQVDEAAYIKLNTNESPYPPAPNVQKAVAEAAQKLNRYSDIAVEAVAKPLAKYLGVKQEQLFLGNGSDEVLSYIFQGFTEKGIAFPDVTYGFYQVYSGLYQVESTVVPLKEDFSLDLAEYDAFKGTVIFANPNAPTGIYLPQEEICAFLERHPDRLVVVDEAYIDFGGKSMVSLINQYKNLFVIGTFSKSRQLAGARLGFGIGNTDLIADLNRLRFSLNPYNVNSLTQAAGGAVLQEQVYVDQKVQETIKVREWSKQELTKLGFEQTDSQGNFLFAKHPKLSGESLFLALREKKILVRWFNQPRTKDYLRITVGTKEQMEQLIAVLTTILNEVKA

SEQ ID NO: 452 - protein, 462 aa, Enterococcus casseliflavus
MERKYVAEPFRIKAVEPLKMLSHAERVKKIKEANYNLFHLRGEDCYIDLLTDSGTNAMSQTQWAGVMQGDEAYAGSSSYYKLIEAGKDIFDYGYIQPVHQGRAAEKVLLPLFLSEGMFAISNMFFDTTRAHVILAGARPIDCVIEEAKNPHIRAKFKGNMDVEKLEKTILEKGSDNVGLVVMTITNNSAGGQPVSMKNLQEVSDICKKYKIPLCIDAARFAENAHFIKRDEEGYQDKAVKEIVREMFQYGDMFTMSAKKDAIVNMGGLLGIKEKESPLVLKVKANCMSYEGFFTYGGLAGRDLEAMAIGLYEGIDENYLKYRIGQMEYLASRLDEAGIAYQSPVGGHGVFIDAAEMYPQIPYYEYPGQTLCIELYKEAGIRTCDIGSYMLGNDPDTNKQLKADFEFSRLAIPRRVYTQSHLDTIADALISVKKRAHTIQQGYKITWEPPILRHFQAHLAPLS

SEQ ID NO: 453 - protein, 251 aa, Enterococcus faecium
MKPLTETLKSRAETEKLFVPYIMAGAQGLDKLEEEIAMLVEQGAAAIELGVPFSDPVADGPTIQAAGLRAFAQQVTLKKLVEKLQEIRSGAPLILMGYSNSFFHYGIKELVEDLEGTDVQGFIIPDLPYEHQELVTPDLGDMALLTLISLTSPTERIEQLAAEAEGFIYAVTVNGITGTDQQFRTDLMEHLAKVKAVSDIPVLAGFGISTSEQVKKFQQVCDGVVIGSKIVRSLEEQGTEKTGELLAEIFR

SEQ ID NO: 454 - protein, 397 aa, Enterococcus faecium
MYQQPNQAGFYGEYGGKFVPETLMYAVQELEETYEASKADPEFQEELDYYLKQYVGRENPLYFAERLTNDLGGAKIYLKREDLNHTGAHKINNALGQVLLAKKMGKRKVVAETGAGQHGVATATAAALFGMECTIFMGEVDVKRQALNVFRMELLGAKVESVTSGSKTLKDAVNEALRYWVATVEDTHYVMGSVLGPHPFPEIVRDYQSVIGIETRRQILEAEGRLPDLVMACVGGGSNAMGMFYPFIEDEEVRLMGVEASGHGLDTEEHAASINKGSIGILHGAKMHLLQDDDGQVLEAFSISAGLDYPGIGPEHSFLHDLGRAEYAAINDEEAVEAFHYLSRLEGIIPALESSHALAQVMKVAPTMDKDQIIVMNLSGRGDKDVQQIKERMEAAK

SEQ ID NO: 455 - protein, 472 aa, Sporosarcina pasteurii
MVRRTAEPYKIKSVETLAMLSYDERKEALIKAGYNTFLIDSADVYIDLLTDSGTTAMSDAQWGALMTGDEAYAGSKSWKKLEETVREVYGYRYVLPTHQGRGAENILSQLKIKDGDFIPGNMYFTTTRAHQEMNGAKFVDVIIDEAHDPNVNHPFKGNIDLTKLQKVIDDVGAENIPYVCLAVTVNLAGGQPVSMENMKDVYSLCKSNGIDVFLDATRCVENAYFIKEREDGFADKKIAAILKEMLSYSDGCTMSGKKDCLVNIGGFLAMNDEELYIRSRELVVVYEGMPSYGGMAGRDMEAMAIGIREAVDDHYIEHRIQQVRHLGDQLIDAGIPIVLPIGGHAVFLDARKFLPHLKQEDFPAQALAAALYLDSGVRSMERGIISAGRNIETGENNTPKLELVRLTIPRRVYTNNHMNVVVDSIIDLFNKRDEICGLQMDYEPPTLRFFNARFSPLSKSGKLISKENKTMN

SEQ ID NO: 456 - protein, 282 aa, Enterococcus faecalis
MKVGYLGPIGSFTYSATLAAFPEATLMPYASIPACLKAIEQQEVAWSIIPIENTIEGTVNASIDYLYHQAQLPVQAELVLPIQQQLMVAKENQAIWQQSQKILSHPQALAQSQMFLEKNFPEAILEATPSTAYAAKYIAEHPELPFAAIAPKLSAEMYDLTIVEKNIQDLSVNQTRFWVLGSENLAISFPLSEKKITLAITMPSNVPGSLHKVLSVFSWRGINLSKIESRPLKTKLGEYFFLMDLVKDQPEKLIEAALTELELIGAEIKILGDYPIYVLSTL

SEQ ID NO: 457 - protein, 246 aa, Parcubacteria bacterium
MTPRSIGIIGYGDFGRFLEALAKRYAPEIVVRVFSRSKEPDNERFFSLEDTAACDIVIIAVSIRAFEETLKKVLPLLSPESILVEVNTVKVMPVRLLRELAKGQRYIATHPMFGPYSFEKQGGSLEGLRLVIADHTLPDEAFSKATDWLSTLGLSLVTMTADEHDRMLAETLFLTHYIAQSVSRAGFVRTDIDTLSFGYLMDAVESVKEDTELFRDVYEFNPYCKEILSRLKEAEGETLAVLARDR

SEQ ID NO: 458 - protein, 278 aa, Cyanobacterium aponinum
MKIGIIGLGLIGGSLGLDLTAKGYEVIGVSRKKETCDRALEKQIVTTAGQNLELLSKTDLIFVCTPIEAILRTIESIIPHLSPETIITDVGSVKGAIASPATKLWSNFVPSHPMAGTANQGVEAAEYNLFNNAPCVITPLPQTSPLAITKVSHIWETVGCRLYQSTPELHDRAVAWISHLPVMISANLIYSCTHTSSPEVIKLAQALASSGFKDTSRVGGGNPELGLMMAQYNRQQLINSLREYQQNLDLLIESIEGENWEALTNILQETHQNRPNFI

SEQ ID NO: 459 - protein, 301 aa, Sphingobium sp.
MLPFSRVTIIGLGLIGSSLARAIRETMPTVRVTGHDADPQVRQIARAIDLCDDVTDTAGASVTDADLVVLCVPVRAMGAAAAEIAEDLPAEAIISDVGSCKADVLAQLTAALPGRAIIPAHPVAGTENSGPEAGFASLFRGRWCIITPPADADPAAVARVSELWHRVGADVETMDPQHHDLVLAVTSHLPHLIAYTIVGTASDLEDVTQSEVIKYSAGGFRDFTRIAASDPTMWRDVFLANKDAVLEMLQRFSEDLSALQRAIRWNDGDALFNLFTRTRAIRRSIIEQGQDDPKPDFGRSH

SEQ ID NO: 460 - protein, 389 aa, Rhizobium meliloti
MFDALARQADDPLLALIGLFRKDERPGKVDLGVGVYRDETGRTPIFRAVKAAEKRLLETQDSKAYIGPEGDLVFLDRLWELVGGDTIERSHVAGVQTPGGSGALRLAADLIARMGGRGIWLGLPSWPNHAPIFKAAGLDIATYDFFDIPSQSVIFDNLVSALEGAASGDAVLLHASCHNPTGGVLSEAQWMEIAALVAERGLLPLVDLAYQGFGRGLDQDVAGLRHLLGVVPEALVAVSCSKSFGLYRERAGAIFARTSSTASADRVRSNLAGLARTSYSMPPDHGAAVVRTILDDPELRRDWTEELETMRLRMTGLRRSLAEGLRTRWQSLGAVADQEGMFSMLPLSEAEVMRLRTEHGIYMPASGRINIAGLKTAEAAEIAGKFTSL

SEQ ID NO: 461 - protein, 397 aa, Escherichia coli
MFQKVDAYAGDPILTLMERFKEDPRSDKVNLSIGLYYNEDGIIPQLQAVAEAEARLNAQPHGASLYLPMEGLNCYRHAIAPLLFGADHPVLKQQRVATIQTLGGSGALKVGADFLKRYFPESGVWVSDPTWENHVAIFAGAGFEVSTYPWYDEATNGVRFNDLLATLKTLPARSIVLLHPCCHNPTGADLTNDQWDAVIEILKARELIPFLDIAYQGFGAGMEEDAYAIRAIASAGLPALVSNSFSKIFSLYGERVGGLSVMCEDAEAAGRVLGQLKATVRRNYSSPPNFGAQVVAAVLNDEALKASWLAEVEEMRTRILAMRQELVKVLSTEMPERNFDYLLNQRGMFSYTGLSAAQVDRLREEFGVYLIASGRMCVAGLNTANVQRVAKAFAAVM

SEQ ID NO: 462 - protein, 260 aa, Paraburkholderia caribensis
MKKAALALLGAICCVGAVQAQSVAPAPASRLDEILARGTMRACTTGDYKPYSFYKQDGQFEGIDIDMAESLAKSLGVKAEFVKTSWSNLMTDFVAKCDVAVGGVSTTLDRQKRAFFTVAYQVDGKSPIVRCDDVDKYQTVAQIDQSTTRVIFNPGGTNERFAKQFFPHANLVVYPDNVTIFKQILAGKADVMVTDASETLLQQKLNPGLCAVHPDKPFQYGEKAWLVPRGDVVFQQYVDQWLHLARASGEYQSISDKWLK

SEQ ID NO: 463 - protein, 2555 aa, Bacillus subtilis
MPQQPEIQDIYPLSFMQEGMLFHSLYDEQSRAYFEQASFTINGQLDLERFQKSMDAVFDRYDIFRTAFIYKNVAKPRQVVLKQRHCHVHVEDISHLNEKDKEHCTEAFKEQDKSKGFDLQTDVLMRISILKWAPDHYVCIWSHHHILMDGWCLGIVIKDFLHIYQALGKGQFPDLPPVQPYGTYIKWLMQQEREEAAEYWKKRLQHFEKASPLPKRTDQMSDGTLQQITFTIPEKETSELQKIAAACGATLNTVFQALWGIMLQKFNSLDDAVFGSVISGRPSELKDVENMVGLFINTIPIRVQSDFLSFSDLVRSMQKDMTEAEAYSYFPLYDIQAQSALKQELIDHIIVFENTPTQQEIEELNQAGSFDFSVKDFEMEEVTNYRCSVKVIPGRTLYVRIHFHTGTYQPNMMSEIKDYLQHMISDVISDPSLPVSKMTLLDEDKTRKIVSQNNRTVSVSPEAPTLHGLFERQAAVTPERPAIRFSGGLLTYAELDLYASRLAAHLAARGVTNESIVGVLSERSPDMLIAVLAVLKAGGAYLPLDPAYPKERLSYMLKDSGATLLLTQPGCSAPNFSGEMLEVDMTSLASEKAENHLFTPADGGSLAYVIYTSGSTGQPKGVAVEHRQAVSFLTGMQHQFPLSEDDIVMVKTSFSFDASVWQLFWWTLSGASAYLLPPGWEKDSALIVKAIHQEKVTTAHFIPAMLNSFLDQAEMLALGDGTNLKRVFAGGEPLAPRTAARFASVLPQVSLIHGYGPTEATVDAAFYVLDPERDRDRLRIPIGKPVPGARLYVLDPHLAVQPSGVAGELYIAGAGVARGYLNRPALTEERFLEDPFYPGERMYKTGDVARWLPDGNVEFLGRTDDQVKIRGYRIEPGEIEAALRSIEGVREAAVTVRTDSGEPELCAYIEGLQRNEVRAQLERLLPGYMVPAYMIEMEQWPVTPSGKLDRNALPAPDGAADAETYTAPRNVTEMKLSQLWEDVLKNGPVGIHDNFFDRGGHSLKATALVSRISKEFDVQVPLKEVFAHPTVEGLATVIREGTDSPYEAIKPAEKQETYPVSSAQKRIYVLQQLEDGGTGYNMPAVLELEGKLNPERMDRAFKELIKRHESLRTSFKQDAGGDPVQRIHDEAPFTLQTTVLGARTEQEAAAAFIKPFDLSQAPLFRAQIVKVSDERHLLLVDMHHIISDGVSVNILIREFGELYNNRNLPALRIQYKDYAVWQEGFKTGDAYKTQEAYWLKQLEGELPVLDLPADHARPPVRSFAGDKVSFTLDQEVASGLHKLARENGSTLYMVLLAAYTAFLSRLSGQEDIIVGSPIAGRPHKDLEPILGMFVNTLALRTRPEGGKPFVQYLQEVRETALEAFEHQDYPFEELVDKLELTRDMSRNPLFDVMFVLQNMDQESLELDELCLKPAANNGHQTSKFDLTLYAQEQPRGLLTFQMEFSTDLYKKKTIEKWLQYFINMLLSIIKDNKAALGTINILNEDETHYLIHELNRTKIDYPRNETISRLFEMQAEQTPNAVAIVSDTQVFTYENLNSWANQIASVLQIKGVGPDSVVALLTGRTPELIAGMLGILKAGGAYLPIASDLPVERIAYMLSDSGAALLLQSEKTEKQLLDIECEQIIIEGIQKQGETKNVDSSAGPHSLAYIIYTSGSTGKPKGVMIEQRSVIRLVKNSNYITFTPEDRLLMTSSIGFDVGSFEIFGPLLNGAALHLSDQQTFLDSHQLKRYIEHQGITTIWLTSSLFNHLTEQNEQTFSQLKHLIIGGEALSPSHVNRIRNVCPEVSIWNGYGPTENTTFSTCLHIQKTYELSIPIGRPVGNSTAYILNQWGVLQPVGAVGELCVGGDGVARGYLGRPDLTKEKFVPHPFAPGDRLYRTGDLARWLPDGTIEYVGRIDDQVKIRGYRVELGEIESALRQIDGVKEAAVLARTAQTGSKELFGYISVKAGTNAEQVRSLLARSLPNYMIPAYIIEMETLPLTSNGKLNRKALPEPNFTSKQTYAPPRNDLEDQLVLIWQEVLGIQRIGIEDSFFELGGDSIKALQVSARLGRYGLSLQVSDLFRHPKIKDLSPFIRKSERIIEQGPVQGDVPWTPVQQWFFSQDIEERHHFNQSVMLFHSGRLSENALRPALKKLAEHHDALRMVYRNDGRRWIQINQGIHESQLYSLRTSDLSQSESGWETQIKQEVADLQQSINLQEGPLLHAALFKTLTGDYLFLATHHLVVDGVSWRILLEDLSAGYQQAASGQTIQLPPKTDSYQEYARRIQEYAQSSKLIREEAYWRSVEEQQAAELPYEIPHHVNIDFSKRDSLSFSLTEADTAVLLQNVNYAYGTDTQDILLTAASLAICEWTGGSKLRIAMEGHGREHILPELDISRTVGWFTSMYPALISFENHRDELGTAVKTVKDTLGRIPNKGVGYGMLKYLTHPENKSITFSKTPEISFNYLGQFNDIERQDTFRPSSLGSGKDITHTWKREQIIEMSAMAADKKLHFNLSYPSARFHKNTMEQLINRIEHFLLDIMKHCAGQQKAEKTLSDFSSQSLTAEDLDSISSLVEEL

SEQ ID NO: 464 - protein, 324 aa, Clostridium hiranonis
MCTAITYKTKAHYFGRNFDYDISYGEKVVVTPRNFQFKFRKEGNLKTHYAFIGVAAVIENYPLYYDATNEKGLSIAGLNFPKNAFYNEFIEGKINISPFELIPWLLGSFVTVEEARESLENLNLVNINFNEQLPLSPLHWMISDKNECIVVESVKDGLKIYDNPIGVMTNSPTFDYQMFNLNNYHNISTKDPKNLFSEKVDMDIYSRGMGGIGMPGDLSSMSRFVKAAFTKLNSIAGHSEDESVSQFFHILGSVEQQNGLCDLGNGKYEKTIYSSCCNIDEGIYYYKTYNNSQINAVDMNKENLDSSNLCVYPLINEQNINLVN

SEQ ID NO: 465 - protein, 324 aa, Clostridium hiranonis; identical to SEQ ID NO: 464

SEQ ID NO: 466 - protein, 265 aa, Clostridium hiranonis
MRLDGKVVLITASTRGIGLACVERFAKEGAKVYMGARNLERAQGVADRLNAEGCKVDIVYNDATEKESYQTMVDEVVAKEGRIDVLVNNFGTSNPKKDLDIKETEYETFIKTVDINLASVFLTSQAVIPHMAKNGGGSIINISSVGGIRPDISQIAYGTSKAAINYLTKIIATHAARDNVRCNAVLPGMTATDAVSDNLSDDFKEFFLKHTPIKRMATPEEIAGTVLYFASDDGAFTTGQVVDVSGGFGMPTPVYGDMIEMKSRR

SEQ ID NO: 467 - protein, 261 aa, Clostridium sardiniense
MNFREKYGQWGIVLGATEGIGKASAFELAKRGMDVILVGRRKEALEELAKAIHEETGKEIRVLPQDLSEYDAAERLIEATKDLDMGVIEYVACLHAMGQYNKVDYAKYEQMYRVNIRTFSKLLHHYIGEFKERDRGAFITIGSLSGWTSLPFCAEYAAEKAYMMTVTEGVAYECANTNVDVMLLSAGSTITPTWLKNKPSDPKAVAAAMYPEDVIKDGFEQLGKKFTYLAGELNREKMKENNAMDRNDLIAKLGKMFDHMA

SEQ ID NO: 468 - protein, 249 aa, Clostridium hylemonae
MKLVQDKITVITGGTRGIGFTAAKIFIENGAKVSIFGETKEEVDTALAELKELYPEEEVLGFAPDLTSRDAVMAAVRAVAEKYGRLDVMINNAGITMNTVFSRVTEEAFKHMMDINVIGVFNGAWAAYQCMKGAQQGVIINTASVTGIYGSLSGIGYPASKAGVIGLTQGLGREIIRKNIRVVGVAPGVVDTDMTKGLPPEILEDYLKSFPMKRMLKAEEIANVYLFLASDLASGITATTVSVDGAYRP

SEQ ID NO: 469 - protein, 249 aa, Clostridium hylemonae; identical to SEQ ID NO: 468

SEQ ID NO: 470 - protein, 520 aa, Clostridium scindens
MHKKSACEREGKELKRDFFNKFNLGTSNFVTPGKQLEYVSECKPDSTAVICLDKEQNCSVITWHQLHVYSSQLAWYLIENEIGPGSIVLTMFPNSIEHIIAVFAIWKAGACYMPMSYKAAESEIREACDTIHPNAAFAECKIPGLKFCLSADEIYEAMEGRSKEMPSDRLANPNMISLSGGTSGKMKFIRQNLPCGLDDETIRSWSLMSGMGFEQRQLLVGPLFHGAPHSAAFNGLFMGNTLVLTRNLCPGNILNMIKKYKIEFIQMVPTLMNRLAKLEGVGKEDFASLKALCHTGGVCSPWLKQIWIDLLGPEKIYEMYSMTECIGLTCIRGDEWVKHPGSIGRPVGDSKVSIRDENGKEVAPFEIGEIYMTAPASYLVTEYINWEPLEVKEGGFRSVGDIGYVDEQGYLYFSDRRSDMLVSGGENVFATEVETALLRYKDILDAVVVGIPDEDLGRRLHAVIETGKEIPAEELKTFLRKYLTPYKIPKTFEFVRSIRRGDNGKADRKRILEDCIARGG

SEQ ID NO: 471 - protein, 639 aa, Clostridium hiranonis
MSYDALFSPFKIRGLELKNRIVLPGMNTKMAKNKHDLSDDMIAYHVARAKAGCALNIFECVALCPAPHAYMYMGLYNDNHVAQLKKLTDAVHEVGGKMAVQLWHGGFSPQMFFDKTNTLETPDTITVERIHEIVKEFGEGARRAVEAGFDAVEFHAAHSYLPHEFLSPGMNKRTDEYGGNFENRCRFCFEVVEAIRANIPEDMPFFMRVDCIDELMDEVMTEEEIVEFINRCADLGVDVADLSRGNAQSFATVYEVPPFNLQHGFNIENIYNIKKQIKIPVMGVGRINTGEMANQVIADGKFDLVGIGRAQLADQDWVAKVREGKEDLIRHCIGCDQGCYDAVINPQMTHITCTRNPHLCLEYKGMPKTDEPKKVMIIGGGMAGILAAEVLKKRGHEPVIFEASDHLAGQFVLAGKAPMKEDWAAAAKWEAEEVARLGIEVRYNTKVTPELIEEFAPDHVVIAIGSDYVAPAIPGIDSDKVYTQYQVLKGEVEPKGHVAVVGCGLVGTEVAQYLAARGAQVTAIERKGVGTGLSMLRRMFMNPEFKYYKINKMSGTNIVGIEPGKLHYIMTNKKTQEVTEGVLECDAAVICTGITARPSEDLQEKCKELGVPFNVIGDAAGARDARIATQEGYEVGMSI

SEQ ID NO: 472 - protein, 169 aa, Clostridium hylemonae
MSIEERLEALEKEIQKMKDIEEIKKLKGQYFRCLDGKFWDELETTLSPNIVTSYSNGKLVFHGPKEVTDYFKKAMPREEISMHMGHTPEITIDSETTATGRWYLEDKLIFTEESKYAGSGVNGGAFYTDKYEKVDGKWYILETGYLRVYEEHFMRDPKIKITMNMHKTK

SEQ ID NO: 473 - protein, 426 aa, Clostridium hiranonis
MAGLKDFPKFGALSGLKILDSGSNIAGPLGGGLLAECGATVIHFEGPKKPDNQRGWYGYPQNHRNQLSMVADIKSEEGRKIFLDLIKWADIWVESSKGGQYDRLGLSDEVIWSVNPKIAIVHVSGYGQVGDPSYVTKASYDAVGQAFSGYMSLNGVNEALKINPYLSDFVCGLTTCWAMLACYVSTQLTGKGESVDVAQYEALARIMDGRMIQYATDGVSVPKTGNKDAQAALFSFYTCKDGRTIFIGMTGAEVCKRGFPVIGLPVPGTGDPDFPEGFTGWMINTPVGQRMEKAMEAFVAERTMPEVEKAMIDAQIPCQRVYDLEDCLNDPHWNARGTIMEWDDPMMGHIKGLGLINKFKNNPSEIWRGAPLFGMDNRDILRDLGYSEEEVNDLYAKGIVNEFDLETTIKRYKLDQVIPHMAKKDK

SEQ ID NO: 474 - protein, 477 aa, Clostridium scindens
MSTVANPNYKKGFVPFAIAALLVSLIGGFTAVLGPAFVADQGIDYNNTTWISLALAMSSAACAPILGKLGDVLGRRTTLLLGIVIFAAGNVLTAVATSLIFMLAARFIVGIGTAAISPIVMAYIVTEYPQEETGKAFGLYMLISSGAVVVGPTCGGLIMNAAGWRVMMWVCVALCVVVFLICTFSIKKTAFEKKSMAGFDKPGAALVVVFFSLFLCIPSFGQNIGWSSTAFIAAAAVALVALFILVMVEKKAKSPIMNGKFMARKEFVLPVLILFLTQGLMMANMTNVIVFVRYTQPDNVIISSFAISIMYIGMSLGSVIIGPVADKKEPKTVLTFSLVLTAIGCALMYLFKADSSVAIFAASLGILGFGLGGNATIFMKVALSGLSSEVAGSGTGTYGLFRDISAPFGVAVFVPMFANGVTANIAKYASGGMEEGAATVKAAISSIQTLTLVELGCIVVGIILVRMLPRIYQKKEA

SEQ ID NO: 475 - protein, 661 aa, Clostridium hiranonis
MDMKNSKLFSPLTIGSLTLNNRVGMAPMSMDYEAADGTVPKRLADIFVRRAEGGTGYVTIDAVTIDSKYKYMGNTTALDSDDLVPQFREFATRVREAGSTLIPQVIHPGPESICGYRHIAPLGPSVNTNANCHVSRAISVDEIHEIIKQFGQAARRVEEAGCGGIGLHCAHAYMLPGSFLSPLRNKRMDEYGGCLDNRARFVIEMIEEVRRNVSPDFPIMLRISGDERMIGGNSLEDMLYLAPKFVEAGVNMFEVSGGTQYEGLEHIIPSQNKSIGVNVHEASEIKKVVDVPVYAVGKINDIRYAAEIVERGLVDGVSIGRPLLADPDLCNKAKENLFDEITPCASCGGSCISRTADRPQCRCHINPRVGFEYDYPEVPAEKSKKVLVVGAGPGGMMAAVTAAERGHDVTLWEADTQIGGQINLAVVAPGKQEMTKWLSHLNYRAKKAGVKMVLGKEATVENIKEFAPEAVIVATGARPLVPPIKGTQDYPVLTAHDFLRGKFVIPKGKVCVLGGGAVACETAETVLENARPNAFTRGFDASIGDVDVTLVEMLPQLLTGVCAPNRTPLIRKLKNKGVHINVNTKILEVTDHDVKVQRADGAEEWLKGFDYILFGLGSRNYDPISEQIKEFVPEVHVVGDAKRARQASFAMWEAFEAAYSL

SEQ ID NO: 476 - protein, 182 aa, Clostridium hylemonae
MSVKIISKDEKDRELIMETVRNARNQDYTPEMLCELQKVIETKYYYWWLMDMKGEEYAPDLFGRNFHYFCNGHLVTDDGAYQALTSKWVNSAMVTMHMGHQPLVWLMDENNARGVFQYEDHHVYKEDDSVVETWMVYCDDFEKDSGGTWHITRMRMYQKQADGRYRDPFPPKDWVPEGWKES

SEQ ID NO: 477 - protein, 330 aa, Pseudomonas fluorescens
MKILVTGASGFIGGRFARFALEQGLDVRVNGRRAESVEHLVRRGAEFIQGDLSDPQLARDLCSDVEAVVHCAGAVGLWGRYQDFHQGNVQVTENVVEACLKQRVRRLVHLSSPSIYFDGRDHLGLTEDQVPKRFKHPYAATKYLAEQKVFGAQEFGLETLALRPRFVTGAGDMSIFPRLLNMQRKGRLAIIGNGLNKVDFTSVQNLNEALLSSLLATGSALGKAYNISNGAPVPLWDVVNYVMRKMDVPQVTRYRSFGLAYTVAALNEGVCKLWPGRPEPTLSRLGMQVMNKNFTLDISRARHYLDYDPKVSLWTALDEFCGWWKAQDIH

SEQ ID NO: 478 - protein, 614 aa, Shewanella oneidensis
MTKVDDALFEHGASAVAVEQNNGRDNPTKPKDANICRHLKLAAHHIPHHLAVAVQQGKGKSFANLTYQELDFISLNKQSDAIAFALNAYGLTRGMKAVLMVTPSLDFFALTFALFKAGIIPVLVDPGMGIKNLKQCFIEAAPDAFIGIPKAHIARRLLGWGKASVKRLINVDANQSGVTDTLSRLLTGAPSLASMLSFTTKSSSAKLPEQVEYPMALLEHDEMAAILFTSGSTGTPKGVVYSHGMFEAQIQALKQDYGIAHGERDLATFPLFSLFGPALGMTSIVPEMDASKPITANPEFLFAAIEKYQCSNIFVNPALLERLGRAGEQTDSKNQHKLSSVKRVISAGAPATIASIARFSKMLSDGVPVLNSYGATESLPISMIASDELFTTTQVTDNGGGICVGRAIDGVKIEIIAITEADIPEWDNRLCLNAGEIGEIVVTGQMVSQSYYHREKATAASKIWDSERQTFRHRMGDLGYLDDSGRLWMCGRKAHRVDATQGGQFAKRYYSIPCERIFNTHPNVKRSALVGVTVKGQHGVGEIKPLICIELDQSLVCNKSAQLYQELMVIAEQYSQTQGIRRFLIHPDFPVDVRHNAKIFREKLAVWAQSQTKG

SEQ ID NO: 479 - protein, 318 aa, Shewanella oneidensis
MLDTLLPFKRHFLSRNGNKLHYINEGQGEPVVMVHGNPSWSFYYRNLVSALKDTHQCIVPDHIGCGLSDKPDDSGYDYTLKNRIDDLEALLDSLNVKENITLVVHDWGGMIGMGYAARYPERIKRLVILNTGAFHLPDTKPLPLALWICRNTLLGTVLVRGFNAFSSIASYVGVKRQPMSKYIREAYVAPFNSWANRISTLRFVQDIPLKPGDRNYQLVSDIAASLPKFAKVPTLICWGLQDFVFDKHFLVKWREHMPHAQVHEFADCGHYILEDASDEVITHIKHFMTETETLATQVNPADSITEFESASQAPQAER

SEQ ID NO: 480 - protein, 349 aa, Shewanella oneidensis
MKYSRVFINSLAYELAPVVVSSSELESRLAPLYQKFRIPMGQLAALTGITERRWWPKGHQLSDGAINAAHKAIAETGIDVAELGAVVYTGVCRDQHEPATACRIAAALGVSKDTAIYDISNACLGVLSGILDIANRIELGQIKAGMVVSCESARDIVDVTIDNMLADPTMQNFAQSLATLTGGSGAVAVILTDGSLPLTNVRKHQLLGASHLSAPQHHQLCQWGLQEVGHNIYREFMRTDAVTLLKEGVELAKHTWEHFLAQRNWLVEQVDKVICHQVGASNRKQVLSALNIPPEKEFPTYQLLGNMGTVSLPVTAAMAHDQGFLRPGDQVSFLGIGSGLNCMMLGIKW

SEQ ID NO: 481 - protein, 2581 aa, Photobacterium profundum
MGVKRRLMMSQTPKTTSESQEDTRLNKRLKDMPIAIVGMASMFANSRYLNKFWDLISEKIDAITEVPETHWRPEDYYDANKSTPDKSYCKRGGFIPEVDFNPMEFGLPPNILELTDTSQLLSLIVAKEVLADAKLPETYDRDKIGITLGVGGGQKISQSLNARLQYPVLKKVFKNSGITDEDSEMLIKKFQDQYIHWEENSFPGSLGNVISGRIANRFDLGGMNCVVDAACAGSLAALRMALSELVEGRSEMMITGGVCTDNSPTMYMSFSKTPAFTTNETIQPFDIDSKGMMIGEGIGMIALKRLEDAERDGDRIYSVIKGVGASSDGKFKSIYAPRPEGQAKALKRAYDDAGFAPHTLGLLEAHGTGTAAGDVAEFSGLNSVFSEGNDEKQHIALGSVKSQIGHTKSTAGTAGLIKASLALHHKVLPPTINVTSPNPKLNIEDSPFYLNTQTRPWMQRVDGTPRRAGVSSFGFGGTNFHIVLEEYTPEHARGDKYRQRQVAQTLLFSAASREALIASLKETSANLANDSVNLETLAESHGLRSIEVSHARLGLAVKTGEELNTQLAQAISNLESQTKAHWQLPSGTSYRESALVSGNDSAKVAALFAGQGSQYLNMGRELACHYPEMRQQLAKADQVFGQNKKTALSQVLFPIPMFNKESTQAQEALLTNTANAQSAIGVMSMGQFELLTQAGFKADMVAGHSFGELSALCASGVISQDDYYQLAFARGNAMAATPAEGDSGTMYAVILDADKLADVEKCISAFEGVSIANYNAPTQLVIAGPTDSAQLAAKALTEQGFKAIPLPVSGAFHTPLVAHAQKPFAAAIDKATFSTPALPLYSNATGELHKNDGKAIKKAFKQHMLQSVRFSTQLEAMYDAGARVFVEFGPKNILQKLVEKTLTNKADELCTISINPNPKGDSDQQLRLAAVQLAVVGISLDNIDPYQAEIAPPAATSPMNIKLNAANYISPATRAKMAKSLTTGEVSTKTEIVEKVVEKIVEKEVIKTEIREVPVAAAPTQAVTVQSTAQAAPQPVVTTAPAQVVTQATSQLPVGEASLHAFFSAQQQAAELHQQFLAIPQQYGDTFTALMTEQAKMATAGIAIPESLQRSMELFHQHQAETLKAHAHYLELQANSNNSALGMLTSQAPAHQVPVYQTPIQQVSVAPAPAAPVVTPVVAAPVATPTPIKAVIQTQQSAPVASAPIAAPVTQTVKPTPVVQAAVAPQAAVQTANPEQVMLEVVAEKTGYPTEMLDLDMDMEADLGIDSIKRVEILGTVQDQMPNLPELSPEDLAECRTLREIVTYMNSKMPAAAASAPVTSASNGLDAAQVQSTMLEVVADKTGYPTEMLDLEMDMEADLGIDSIKRVEILGTVQDQLPTLPELSPEDLAECRTLGEIVSYMNSKLPAASAVAAPVASAPVASASNGLDAAQVQTTMLDVVADKTGYPTEMLDLAMDMEADLGIDSIKRVEILGTVQDQLPGLPELNPEDLAECRTLGEIVDYMNSKLPAVSTQNVAIQTAAPVASASNGLDAAQVQGTMLEVVADKTGYPAEMLDFAMDMEADLGIDSIKRVEILGTVQDQLPGLPELNPEDLAECRTLGEIVDYMNSKLPAASTQNVAVQTVAAPVATAPATNGLDAAHVQNTMMNVVADKTGYPAEMLDLAMDMEADLGIDSIKRVEILGTVQDQLPGLPELNPEDLAECRTLGEIVAYMQSKLSNTSAVAAPSAPAVENLVEAIAETSNVELPPHSEVALKKLPAVDKLVDCFSKEACIVITDDGHNAGVLAEKLSANGLQVAVVRSPLSAASPLNSEIASYTLASIDDASIKTVISDIESKQKEIGGFIHLQPLATDAKTDKATAVTLHATAKESISMAFLFAKLLKTQLNAAKNRSAFFTVSRIDGGFGYLNAEQLINAELNQAALSGLTKTLSHEWSTVFCRALDVAPTLDARHLAEAVTAELFDIDTHTVEVGLADANNGESGRATLIATNAGTALTKNASAKLDKNDNVLVTGGAKGVTFECALTLAKQCKSHFILAGRSQHITANELPEWAQGKQANELKPAAIRHIQTSGEKPTPKKVDALLKPVLSSLEINTALSAFANVGASAEYISLDVSSSDSVAKTLSQFNDITGLIHGAGVLADKHIQDKTLDELNLVYGTKVGGLEAVLNALNSDKLKLVAMFSSAAGFYGNTGQSDYAMSNEILNKAALQLSARNPEAKVMSFNWGPWDGGMVNAALKKMFTDRGVYVIPLQAGAELFSSQLLSETGIQLLVGTSMQGSDNKEAAVKKLDAESMLVAKSPLNSSITVTRDLDPKAMPFINDHCIAGNPVLPTVCAIQWMREAAEQLLGANVTVRDYKLLKGVIFDTNEIQTLTLTLTPDEKATDQIKALISCQDRPQYKAMLVVEPVPATQAKTFVANSNEPITTAKALYSNGTLFHGPRLQGITTVERFDDAGLLAQCQLPTVADTDCGAFVPTQHLGGCQPFAEDYLLQAMLVWARLKYGAASLPSAIGEFVSYEPMQAGDKGWLELDVIKNTTRSLQANISLYHQDGRLSAVMKSAKVTISKSLNEAFLVKSEPEKELLS

SEQ ID NO: 482 - protein, 691 aa, Photobacterium profundum
MPLRIALLAQAADAAGLSADILASLPAIQHIAINDNFNAALQTAIQAVNQGQLVQLTLQCKPNEPQQRLLMLSGLAAAKNKIHPHAYLAGFAEGSVNSLEIALNQSRRQNADLSHQQTSETLAADQQFLAFFNMVDDIARRTLHAAAHAANNASHYWFTEPHKARVASLTFNANSDSESSLVLTQATGLQKAQSLLNASRLFFVLSGLNEIELSVQLEQLKQRLADLPNDLTPNDNAALIALMTKNLAQYQTDVSSSATSSISLPTIVLQGASVTAVLQEISAISNALPKVIAEKSHYKTPAGSCFSPAPNSKGGVTFVYPGVGTVYPGMFRDFHQYFPALFAQLEREGNLKEMLQAEKTYGENPAEMTLGELAIAGVGSSYLLTQLLCEEFAVKPDFALGYSKGEASMWASLGVWKNPHALIELTQTSPIFTTAISGKLTAVREAWQLTDAEEITWNSFVVRCESATIEALLPEFPRAYLAIIQGDTCVLAGCEATCRALLKKLGKRGIAANRVTAMHTTPALSQHSQVTEFYTQPLCDELPMDIKFISAAGLLPQNQNVPVNIDSQSIANSIADTFCTTLDFTALIRTAREQGARLFVEIGADRQTSTLIDKINRTDNVTTESCTVAANAKGGEDIVTLLKCIAQLITHQIPLSLSPLLQGLEEQVNALKLHSVSSANTTPNTTQGEPV

SEQ ID NO: 483 - protein, 2006 aa, Photobacterium profundum
MHCPVNYAPNTAVTFSPASRVRRTSECTEITQCIVSEYHTEHYTRRASVSSQHSTASQSNKIAIVGLANQYPDADTPKDFWQNLLAKKDSRTTLSPDKLGANPDAYQGIQGESDRFYCDKGGYIQNFSFDSNGYRLPAETFEGLDESFLWALDTSRKALADAGIPLDDAVLERTGVIMGALSFPTKRSNDLFLPIYHSAVEKALQTKLGNEHFTLTPSNANITSLNPANGSAAHNASRLVADALGLGSVQLSLDAACASSVYSLKLACDYLNTGKADMMLAGAVSGADPFFINMGFSIFHAYPDHGVSVPFDTNSKGLFAGEGAGVLILKRLEDAERDGDNIYAVVSGIGLSNDGRGQFVLSPNSKGQVQAFERAYEATDLSPESIEVIECHATGTPLGDKVEMTSMERFFADKLNGSQAPLIGSAKSNLGHLLTAAGMPGIMKMIFAMKEGVLPPSINLSTPLSSPEGLFGSHTLPTQVQAWPDKAGNTERCAGVSVFGFGGCNAHLLLEAHSANSARNSPAANSPAKPAVSAPLKVTGLASHFGSLKTINALHNAITTGADAFVALPKKRWKGLDQHPELLSQFGLDAIPHGAYIDQFELDFLRFKVPPNEDDRLISQQLLLMKVADEAIRDAKLEVGQKVAVLVAMETELEMHQFRGRVNLHTQLADSLENMGVQLTDSEYQALEAIAMDSVLDAAKLNQYTSFIGNIMASRIASLWDFNGPAFTISAAEQSVARCIDVAQNLMSQESLDAVVIAAVDLSGSVEQIILKNSVTPVALHPQDSGWNVGEGAGAIVLVDTDNASTKNSYGEITALDFGSVAQSNITSDRLLTTAGITANNVSLLELNQAPESVETVQFPLPSATHIQANQRLGHCYAASGMASILHGLLSLNAIPKQTTIPSLNTSVTAAVTKAAIVANVSENQCSQLLLTQTSTETQSLTARLNSELANDSKRQLIKQVTLGGRDIYQHIVTAELSDIQHIQQKVANTKPLVQKQNIKQPRIQAIAKPVAQPQSIAQPTAIPSVSPILTTPRQTPITGIQSNMTNVLSAKNKHDLTAFQSSAFVENQQLAQQVHQAFLQNREQGLKMADALLKAQLNEVTAQMNAATGQVFDHQLAPSPALTEASTSVPVNVAATPAIVNPIRKPCIWDYEDLVEYAEGDIANVFGPDYAVIDNYSRRVRLPTTDYLLVSRVTKLDATMLEYKPSTMTTEYDIPVDAPYLVDGQIPWAVAVESGQCDLMLISYLGIDFENKGERVYRLLDCTLTFLGDLPRGGDTLRYDISINNFARNGDTLLFFFSYECFVGDKMVLKMDNGCAGFFTDEELSDGKGVIRTEDEIKSRNLAVKQRFNPLLHCQKTQFDYQTLHNLLDANIAGCFGESHISDRHQPSLCFSSDKFMMIEQISHVDPQGGTWGLGLIEGHKQLEADHWYFPCHFKDDSVMAGSLMAEGCGQLLQFFMMYLGMHTQVENGRFQPLENAPQQVRCRGQVLPQSAVLTYRMEVTEIGLSPRPYAKANIDILLDGKVVVDFQNLGVMIKEESECTRYLGSSDFDSASLASSSYVAESAPAQADVITPVEAPISQQASANAPLMAQIPDLNTAPNKGVIPLQHIEAPIVPDYQNRTPDTVPFTPYHMFEFATGDIEKCFGPDFSIYRGMIPPRTPCGDLQLTTRVIEVNGTRGDFKTPSSCIAEYEVPENAWYFDENSHSSLMPYSVLMEISLQPNGFISGYMGTTLGFPGLELFFRNLDGSGKMLRNVDLRGKTIVNDSRLLSTVMMGTNIVQSFSFELSTDGVPFYEGTAVFGYFKGAALKDQLGLDNGQVTYPWHVNNNRTPDVSINLLDKESRYFNAPLSATGEAQPHYQLAGGRLNFIDKVDITSDGGKAGLGYLYAERTIDPSDWFFQFHFHQDPVMPGSLGVEAIIELMQTYALNKDLGAGFRSPKFGQIQSEVKWKYRGQINPLNKQMSLDVHITAIKDEDGKRIIVGDANLSKDGLRIYEVKDIAICIEEA

SEQ ID NO: 484 - protein, 544 aa, Photobacterium profundum
MTTQTMNNEKLSPWPWQVEENATHFDNATMAKILKDLSLGCYVVNHPEKGVGISQQAEITSGDSASASHVHPVSAFAPALGTQSLGDNDFRRVHGVKYAYYAGAMANGISSEELVIALGQAGILCSFGAAGLIPSRVEQAINRIQAALPNGPYAFNLIHSPSEPALERGSVELFLKHKVRTVEASAFLGLTPQIVQYRAAGLSRDAQGEIVIANKVIAKVSRTEVAIKFMEPAPAKMLQGLVDEGRITAEQMELALLVPMADDITAEADSGGHTDNRPLVTLLPTILALKETIQAKHQFKTPLRVGSGGGIGTPDAALAAFNMGAAYIVTGSINQACIEAGASEHTRKLLATTEMADVAMAPAADMFEMGVKLQVVKRGTLFPMRANKLYEIYTRYDSIEAIPADERHKLETQVFHSTLDAIWEGTVAHFNERDPKQIERAQGNPKRKMALIFRWYLGLSSRWSNTGEAGREMDYQIWAGPALGAFNAWAKGSYLDNYQDRRAVDLTKHLMHGAAYLARVNLLAAQGIRLPAELARWKPVEKMI

SEQ ID NO: 485 - protein, 230 aa, Photobacterium profundum
MNPPYISQVIPVVLPDFSGVCFQCEFDPELYTIEAPRQLGIILPETLHSAVKKRQAEYVAGRYLAKRCLSALGGTEADVGISQHRAPLWPKGMIGSISHSSNKAICVLSQCDLPEQGIGIDIEQCLTDSTATSIKKTIINEAEQALLTKHYVDFSTGLTVIFSAKESLFKALFPQVRAYFDFLDAEVIAMERDNLTIMLKRTLTSTLSAGCKFTVQIYKQNMMVRTFTQS

SEQ ID NO: 486 - protein, 395 aa, Bacillus subtilis
MSKIIAINAGSSSLKFQLFEMPSETVLTKGLVERIGIADSVFTISVNGEKNTEVTDIPDHAVAVKMLLNKLTEFGIIKDLNEIDGIGHRVVHGGEKFSDSVLLTDETIKEIEDISELAPLHNPANIVGIKAFKEVLPNVPAVAVFDTAFHQTMPEQSYLYSLPYEYYEKFGIRKYGFHGTSHKYVTERAAELLGRPLKDLRLISCHLGNGASIAAVEGGKSIDTSMGFTPLAGVAMGTRSGNIDPALIPYIMEKTGQTADEVLNTLNKKSGLLGISGFSSDLRDIVEATKEGNERAETALEVFASRIHKYIGSYAARMSGVDAIIFTAGIGENSVEVRERVLRGLEFMGVYWDPALNNVRGEEAFISYPHSPVKVMIIPTDEEVMIARDVVRLAK

SEQ ID NO: 487 - protein, 397 aa, Lactiplantibacillus plantarum
MGKTIAINAGSSTLKFKLFEMPQERVIAQGAVERIGFKTSPVNIRYGVDHHYQEKAVVADHLAAVNIVLDELIKLRIIDSYDEITGVGHRVVAGGEQFHDSVLITDQVLKQITDLAEYAPLHNPANAVGIRAFKRVLPHVPAVAVFDTAFHASMPAVNYLYSLPYDYYQRYGARKFGAHGTSHRYVAVRAAKLLGRPLETLKLITLHLGAGSSITAIDHGQSLDTSMGFTPLAGITMATRSGDVDPSLVAYLMKKLNISDPDEMLTILNTQSGLLGLAGSADMQELEARYDEDSQAQLAIDIFVNRIVKYVGAYLAELQGADALVITAGIGERDARMRQRIADRLTYFGVAIDPTKNQVSGVERDLSTTDAKIRTLLIPTDEELMIARDVERVAQNQ

SEQ ID NO: 488 - protein, 323 aa, Bacillus subtilis
MADLFSTVQEKVAGKDVKIVFPEGLDERILEAVSKLAGNKVLNPIVIGNENEIQAKAKELNLTLGGVKIYDPHTYEGMEDLVQAFVERRKGKATEEQARKALLDENYFGTMLVYKGLADGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVADAVKIAKEKAPELTLDGEFQFDAAFVPSVAEKKAPDSEIKGDANVFVFPSLEAGNIGYKIAQRLGNFEAVGPILQGLNMPVNDLSRGCNAEDVYNLALITAAQAL

SEQ ID NO: 489 - protein, 401 aa, Clostridium acetobutylicum
MKNLVINCGSSSIKYQFIDMKDETVLAKGLVERIGIKGSVITHKVNGEKYVTETPMEDHKKAIKLVLDALLNDEYGVIKNIDEISAVGHRIVHGGEKYANSVLIDEDVMKSIEDCVSLAPLHNPPHIIGINACKELMPNVPMVAVFDTAFHQTIPDYAYMYAIPYEYYDKYKIRKYGFHGTSHKYVSRTAAEFIGKKVEDLKMVVCHMGNGASITAVENGKSVDTSMGFTPLGGLAMGTRSGDMDPAVVTFLMDKLNINASEVNNLLNKKSGIEGLSGISSDMRDIKKGNYVDKDPKAMLAYSVFNYKIKQFIGSYTAVMNGLDCLVFTGGIGENSFENRREICKNMDYLGIKIDDKKNDETMGIPMDISAEGSKVRVLVIPTNEELMIARDTKDIVGKLK

SEQ ID NO: 490 - protein, 333 aa, Clostridium acetobutylicum
MDLIESIWECAKQDKKRIILAEGEEKRNLIAADKIIKEGLAELVLVGDENKIKEKASELNLDISKAEIMDPETSLKTETYARDFYELRKHKGMTIEKSEKMVRDPLYFATMALKDGYVDGMVSGAVHTTGDLLRPGLQIIKTAPGVKIVSGFFVMIIPDCDYGEEGLLLFADCAVNPNPTSDELADIAITTAETARKLCNVEPKVAMLSFSTMGSAKGEMVDKVKNAVEITKKFRPDLAIDGELQLDAAIDSEVAALKAPSSNVAGNANVLVFPDLQTGNIGYKLVQRFAKAKAIGPICQGFAKPINDLSRGCSSEDIVNVVAITVVQAQRGI

SEQ ID NO: 491 - protein, 572 aa, Escherichia coli
MKQTVAAYIAKTLESAGVKRIWGVTGDSLNGLSDSLNRMGTIEWMSTRHEEVAAFAAGAEAQLSGELAVCAGSCGPGNLHLINGLFDCHRNHVPVLAIAAHIPSSEIGSGYFQETHPQELFRECSHYCELVSSPEQIPQVLAIAMRKAVLNRGVSVVVLPGDVALKPAPEGATMHWYHAPQPVVTPEEEELRKLAQLLRYSSNIALMCGSGCAGAHKELVEFAGKIKAPIVHALRGKEHVEYDNPYDVGMTGLIGFSSGFHTMMNADTLVLLGTQFPYRAFYPTDAKIIQIDINPASIGAHSKVDMALVGDIKSTLRALLPLVEEKADRKFLDKALEDYRDARKGLDDLAKPSEKAIHPQYLAQQISHFAADDAIFTCDVGTPTVWAARYLKMNGKRRLLGSFNHGSMANAMPQALGAQATEPERQVVAMCGDGGFSMLMGDFLSVVQMKLPVKIVVFNNSVLGFVAMEMKAGGYLTDGTELHDTNFARIAEACGITGIRVEKASEVDEALQRAFSIDGPVLVDVVVAKEELAIPPQIKLEQAKGFSLYMLRAIISGRGDEVIELAKTNWLR

SEQ ID NO: 492 - protein, 603 aa, Lactiplantibacillus plantarum
MVMKQTKQTNILAGAAVIKVLEAWGVDHLYGIPGGSINSIMDALSAERDRIHYIQVRHEEVGAMAAAADAKLTGKIGVCFGSAGPGGTHLMNGLYDAREDHVPVLALIGQFGTTGMNMDTFQEMNENPIYADVADYNVTAVNAATLPHVIDEAIRRAYAHQGVAVVQIPVDLPWQQIPAEDWYASANSYQTPLLPEPDVQAVTRLTQTLLAAERPLIYYGIGARKAGKELEQLSKTLKIPLMSTYPAKGIVADRYPAYLGSANRVAQKPANEALAQADVVLFVGNNYPFAEVSKAFKNTRYFLQIDIDPAKLGKRHKTDIAVLADAQKTLAAILAQVSERESTPWWQANLANVKNWRAYLASLEDKQEGPLQAYQVLRAVNKIAEPDAIYSIDVGDINLNANRHLKLTPSNRHITSNLFATMGVGIPGAIAAKLNYPERQVFNLAGDGGASMTMQDLATQVQYHLPVINVVFTNCQYGFIKDEQEDTNQNDFIGVEFNDIDFSKIADGVHMQAFRVNKIEQLPDVFEQAKAIAQHEPVLIDAVITGDRPLPAEKLRLDSATSSAADIEAFKQRYEAQDLQPLSTYLKQFGLDDLQHQIGQGGF

SEQ ID NO: 493 - protein, 683 aa, Saccharomyces cerevisiae
MTIKEHKVVYEAHNVKALKAPQHFYNSQPGKGYVTDMQHYQEMYQQSINEPEKFFDKMAKEYLHWDAPYTKVQSGSLNNGDVAWFLNGKLNASYNCVDRHAFANPDKPALIYEADDESDNKIITFGELLRKVSQIAGVLKSWGVKKGDTVAIYLPMIPEAVIAMLAVARIGAIHSVVFAGFSAGSLKDRVVDANSKVVITCDEGKRGGKTINTKKIVDEGLNGVDLVSRILVFQRTGTEGIPMKAGRDYWWHEEAAKQRTYLPPVSCDAEDPLFLLYTSGSTGSPKGVVHTTGGYLLGAALTTRYVFDIHPEDVLFTAGDVGWITGHTYALYGPLTLGTASIIFESTPAYPDYGRYWRIIQRHKATHFYVAPTALRLIKRVGEAEIAKYDTSSLRVLGSVGEPISPDLWEWYHEKVGNKNCVICDTMWQTESGSHLIAPLAGAVPTKPGSATVPFFGINACIIDPVTGVELEGNDVEGVLAVKSPWPSMARSVWNHHDRYMDTYLKPYPGHYFTGDGAGRDHDGYYWIRGRVDDVVNVSGHRLSTSEIEASISNHENVSEAAVVGIPDELTGQTVVAYVSLKDGYLQNNATEGDAEHITPDNLRRELILQVRGEIGPFASPKTIILVRDLPRTRSGKIMRRVLRKVASNEAEQLGDLTTLANPEVVPAIISAVENQFFSQKKK

SEQ ID NO: 494 - protein, 707 aa, Kluyveromyces lactis
MSPAVDTASTAKDPISVMKSNASAAAADQIKTHEYEHLTSVPIVQPLPITDRLSSEAAQKYKPNLPGGFEEYKSLHKESLENPAKFYHERAQLLNWFKPYDQVFIPDTEGKPTFENNAWFTNGQLNACYNLVDRHAFTQPNKVAILYEADEPGQGYSLTYAELLEQVCKVAQILQYSMNVKKGDTVAVYMPMIPQALITLLAITRIGAIHSVVFAGFSSNSLRDRINDAYSKTVITTDESKRGGKTIETKRIVDEALKDTPQVTNVLVFKRTHNENIKYIPGRDLDWDEEVKKYKSYTPCEPVDSEHPLFLLYTSGSTGAPKGVQHSTAGYLLQALLSMKYTFDIQNDDIFFTAGDIGWITGHTYCVYGPLLQGCTTLVFEGTPAYPNFSRYWEIVDKYQVTQFYVAPTALRLLKRAGDSFTEGFSLKSLRSLGSVGEPIAAEVWEWYSEKIGKNELPIVDTYWQTESGSHLVTPLAGGATPMKPGAAAFPFFGIDLAVLDPTTGIEQTGEHAEGVLAIKRPWPSFARTIWKNNDRFLDTYLKPYPGYYFTGDGVARDKDGFFWILGRVDDVVNVSGHRLSTAEIEAAIIEDDMVAECAVVGFNDELTGQAVAAFVVLKNKSSLTAASESELQDIKKHLIITVRKDIGPFAAPKLIVLVDDLPKTRSGKIMRRILRKILAGESDQLGDVSTLSNPGIVKHLIDSVKL

SEQ ID NO: 495 - protein, 662 aa, Schizosaccharomyces pombe [sequence omitted]

SEQ ID NO: 496 - protein, 667 aa, Neurospora crassa
MSGSTVPAGAVVPEAHTIETFQPPREMLQNHPSKPHLANFEEYQKLYKQSITEPNVFWAERARELLSWSKDFQTVHSGSLANGDNAWFVEGELNASYNCVDRHAHKDPNRVAIIYEADEPGQGRNVTYGELLREVSKLAHVLTNLGVRKGDTVAIYLPMIPEAIVAMLACTRIGAIHSVVFAGFSSDSLRDRVVDAQSKVVITTDEGKRGGKLIGTKKIVDEALQQCPDVRNVLVYKRTGADISMTPGRDLWWHEEVEKYPAYYTPVAMASEDPLFLLYTSGSTGKPKGVAHSTGGYLLGAAMTGKYVFDIHDGDRYFCGGDVGWITGHTYVLYAPLLLGVSTVVFEGTPAYPNFSRYWDIIEEHKVTQFYVAPTALRLLKRAGDHHVRNEMKHLRVLGSVGEPIAAEVWKWYYDVVGKGRAQICDTYWQTETGSNVITPLAGVTPTKPGSASFPFFGIEPALVDPVTGEEIHGNDVEGVLAFKQPWPSMARTVWGAHKRYMETYLHVYKGYYFTGDGAARDHEGFYWIRGRVDDVVNVSGHRLSTAEIEAALIEHHSIAEAAVVGVADELTGQAVNAFVAVKEGTQINDALRKEFVLQVRRSIGPFAAPKAIYIVPDLPKTRSGKIMRRILRKIVAGEEDQLGDITTLSDPSVVAKIIDVVHAQRQ

SEQ ID NO: 497 - protein, 669 aa, Penicillium chrysogenum
MSDGPIQPPKPAVVHEAHEVDTFHVPKAFHDKHPSGTHIKDIEEYKKLYEESIKSPDTFWARMARELLTFDKDFETTHHGSFENGDNAWFVEGRLNASFNCVDRHALKNPDKVAIIYEADEPNEGRKITYGELMREVSRVAWTLKERGVKKGDTVGIYLPMIPEAVIAFLACSRIGAVHSVVFAGFSSDSLRDRVLDASSKVIITSDEGKRGGKIIGTKKIVDEAMKQCPDVHTVLVYKRTGAEVPWTAGRDIWWHEEVEKYPNYLAPESVSSEDPLFLLYTSGSTGKPKGVMHTTAGYLLGAAMTGKYVFDIHDDDRYFCGGDVGWITGHTYVVYAPLLLGCATVVFESTPAYPNFSRYWDVIDKHDVTQFYVAPTALRLLKRAGDEHIHHKMHSLRILGSVGEPIAAEVWKWYFECVGKEEAHICDTYWQTETGSHVITPLGGITPTKPGSASLPFFGIEPAIIDPVSGEEIVGNDVEGVLAFKQPWPSMARTVWGAHKRYMDTYLNVYKGYYFTGDGAGRDHDGYYWIRGRVDDVVNVSGHRLSTAEIEAALLEHPSVAEAAVVGIADELTGQAVNAFVSLKEGKPTEQISKDLAMQVRKSIGPFAAPKAVFVVDDLPKTRSGKIMRRILRKILSGEEDSLGDTSTLSDPSVVDKIIETVHSARQK

SEQ ID NO: 498 - protein, 679 aa, Debaryomyces hansenii
MTSSPTHQVVHEANNIKKQETPKEFFERQPRQGHITSLEQYQELYEKSINDPETFFGEFGKELLHWDRDFERVKSGSLLHGDAAWFIGGQLNACYNCVDRHAFATPNKPAIIYEADEEKDSKILTFAELLREVCQVAGVLQSWGIKKGDTVAIYMPMNSQAIIAMLAVARLGAIHSVIFAGFSSGSIKDRVNDASCKALITCDEGRRGGKTINIKKLCDEALLNCPSIEKVLVYERTGNKEVTLKEGRDYWWSEETQKFAGYLPPVPVNSEDPLFLLYTSGSTGTPKGVVHSTAGYLLGAALTTKYVFDIHPEDVLFTAGDVGWITGHTYALYGPLSLGVPTVVFEGTPAFPDYGRLWQIVEKHKATHFYVAPTALRLLRKSGEQEIEKYDLSSLRTLGSVGEPISPDIWEWYNEKVGKGQCHVTDTYWQTESGSHFIAPIAGVVPNKPGSAAVPFFGIQTCLIDPVSGIEIQGNDVEGVLAVKDTWPSMARSVYKNHTKYMDTYLNPYPGYYFTGDGAARDHDGYYWIRGRVDDVVNVSGHRLSTAEIEAALIEHNAISEAAVVGMNDDLTGQTVVAFVALKEHLIANLKADESPEEALKLKKEMILQVRTQIGPFAAPKSVIIVEDLPKTRSGKIMRRILRKIAAGEADQLGDITTLSNPQSVAGIIGSFDSQFGKK

SEQ ID NO: 499 - protein, 704 aa, Candida glabrata
MSPSAIAEKKQVDNIQEIKDKNQEPAHHEYEHLTNVGVVKQKPIDHRLKDNIKTHYSPHLDGLQEYKRQYQESIENPEKFFSEKARSFMNWFRDFDRVFVPDVDNPTKPSFENNAWFLNGQLNTCYNCVDRHALKTPNKTAIIYEADEPGEGYSMSYKELLEKVCQVAQILKYSMNVKKGDTVAVYMPMIPEALITLLAISRIGAIHSVVFAGFSSNSLRDRINDAGSRVVITADESNRGGKIIETKRIVDDALRETPQVEHVLVYRRTNNPQVNFQAPRDLDWETERKKYKTYFPCEPVDSEHPLFLLYTSGSTGTPKGVQHSTAGYLLGALLTMRYTFDVHQEDVFFTAGDIGWITGHTYCVYGPLLYGCTTLVFEGTPAYPNFSRYWEIIDKHQVTQFYVAPTALRLLKRAGDSFIDGFSLKSLRCLGSVGEPIAAEVWEWYSDKIGKNEIPIVDTYWQTESGSHLVTPLAGGVTPMKPGSASLPFFGIETVILDPTTGEEINDSHAEGVLAIKRPWPSFARTIWKNHDRFLDTYLNPYKGYYFTGDGAARDKDGYIWILGRVDDVVNVSGHRLSTAEIEAAIIEDRMVAECAVVGFNDDLTGQAVAAFVVLKDKSTWASASEEELQDIKKHLILTVRKDIGPFAAPKLIVLVDDLPKTRSGKIMRRILRKILAGESDQLGDVSTLSNPGVVKHLIDSVKL

SEQ ID NO: 500 - protein, 684 aa, Kluyveromyces lactis
MSSDKLHKVVHEAHDVEARHAPEHFYNSQPGKSYCTDEEHYREMYTQSIEDPAGFFGPLAKEYLDWDRPFTQVQSGSLEHGDIAWFLNGELNASYNCVDRHAFANPDKPALIYEADDESENKVITFGELLRQVSEVAGVLQSWGVKKGDTVAVYLPMIPAAVVAMLAVARLGAIHSVIFAGFSAGSLKERVVDAGCKVVITCDEGKRGGKTVHTKKIVDEGLAGVDSVSKILVFQRTGTQGIPMKPARDFWWHEECVKQRGYLPPVPVNSEDPLFLLYTSGSTGSPKGVVHSTAGYLLGSALTTRFVFDIHPEDVLFTAGDVGWITGHTYALYGPLTLGTATIIFESTPAYPDYGRYWRIIERHRATHFYVAPTALRLIKRVGEEEIAKYDTSSLRVLGSVGEPISPDLWEWYHEKVGKNNCVICDTMWQTESGSHLIAPLAGAVPTKPGSATVPFFGINACIIDPVSGEELKGNDVEGVLAVKSPWPSMARSVWNNHARYFETYLKPYPGYYFTGDGAGRDHDGYYWIRGRVDDVVNVSGHRLSTAEIEAALAEHEGVSEAAVVGITDELTGQAVIAFVSLKDGYLSENAVEGDSTHISPDNLRRELILQVRGEIGPFAAPKTVVVVNDLPKTRSGKIMRRVLRKVASKEADQLGDLSTLANADVVPSIISAVENQFFSQQKK

SEQ ID NO: 501 - protein, 671 aa, Debaryomyces hansenii
MTPHSTHVTLDHEGIIQPPAEFKERSKSKPNLADFETYSKMYKESIENPSKFFGEQALEHLSWDRPFDEARYPVSSEQDFADGDIASWFVNGQLNASYNAVDRWAIKNPNKPAIIYEADEENEGRIITYGQLLKDVCKLAQCLTKLGIRKGDSVAVYLPMIPEALVTLLAIVRIGAVHSVVFAGFSSSSLKDRILDASSKIVITTDESKRGGKTIETKKIVDDALKNCPDVTNVLLFKRTGNAHIPFTEGRDLWWHEEMAKYGPYFPPVPVNSEDPLFLLYTSGSTGKPKGIQHSTAGYLLGAAMTSKYTFDVHEDDVLFTAGDVGWITGHTYVVYGPLLCGATTVVFEGTPAHPNYSRYWEIVDKYQVTQFYVAPTALRLLKRAGTKYIENYKLDSLRVLGSVGEPIAAEIWHWYNDNIGRRKCHIVDTYWQTESGSHMLAPLAGITPTKPGSASLPCFGIDAKILDPVSGKELKENDVEGVLCVKSCWPSISRGIYNDYARFIETYLKPYPNHYFSGDGAARDVDGFYWILGRVDDVVNVSGHRLSTAEIEAALILHESVAECAVVGYADELTGQAVAAYVSLKSNVSEDLEVIKKELILTVRKEIGPFATPKTILLVDDLPKTRSGKIMRRILRKVLAGEEDQLGDISTLSNPGVVAQIIDVVKATRK

SEQ ID NO: 502 - protein, 675 aa, Zygosaccharomyces bailii
MTVKEHKVVHEAQNVEALHAPEHFYKSQPGPSYIKDMKQYKEMYKQSVEDPENFFGEKARELLDWDRPFTRSKYGSLENGDVTWFLNGELNAAYNCVDRHAFANPDKPALIYEADEEADNRMITFSELLRQVSRVAGVLQSWGVKKGDTVAVYLPMIPEAVVAMLAIARLGAIHSVVFAGFSAGSLKDRVVDAGCKVVITCDEGKRGGKTVHTKKIVDEGLNGISLVSHILVFQRTGSEGIPMTAGRDYWWHEETAKQRSYLPPVPCNSEDPLFLLYTSGSTGSPKGVVHSTAGYLLGAAMTTRYVFDIHPEDVLFTAGDVGWITGHTYALYGPLVLGTASIIFESTPAYPDYGRYWRIIQRHKATHFYVAPTALRLIKRVGEAEIPKYDISSLRVLGSVGEPISPELWEWYYEKVGNKNCVICDTMWQTESGSHLIAPQAGAVPTKPGSATVPFFGVDACIIDPVTGIELQGNDVEGVLAVKSSWPSMARSVWQNHHRYVDTYLKPYPGYYFTGDGAGRDHDGYYWIRGRVDDVVNVSGHRLSTAEIEASLTNHDNVSESAVVGIADELTGQSVIAFVSLKDGSSRESSAVVAMRRELVLQVRGEIGPFAAPKCVILVKDLPKTRSGKIMRRVLRKVASNEADQLGDLSTMANSEVVPSIIAAVDEQFFAEKKK

SEQ ID NO: 503 - protein, 348 aa, Saccharomyces cerevisiae
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 504 - protein, 350 aa, Schizosaccharomyces pombe
MTIPDKQLAAVFHTHGGPENVKFEEVPVAEPGQDEVLVNIKYTGVCHTDLHALQGDWPLPAKMPLIGGHEGAGVVVKVGAGVTRLKIGDRVGVKWMNSSCGNCEYCMKAEETICPHIQLSGYTVDGTFQHYCIANATHATIIPESVPLEVAAPIMCAGITCYRALKESKVGPGEWICIPGAGGGLGHLAVQYAKAMAMRVVAIDTGDDKAELVKSFGAEVFLDFKKEADMIEAVKAATNGGAHGTLVLSTSPKSYEQAAGFARPGSTMVTVSMPAGAKLGADIFWLTVKMLKICGSHVGNRIDSIEALEYVSRGLVKPYYKVQPFSTLPDVYRLMHENKIAGRIVLDLSK

SEQ ID NO: 505 - protein, 350 aa, Emericella nidulans
MSIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPLDAAAPVLCAGITVYKGLKEAGVRPGQTVAIVGAGGGLGSLAQQYAKAMGIRVVAVDGGDEKRAMCESLGTETYVDFTKSKDLVADVKAATPDGLGAHAVILLAVSEKPFQQATEYVRSRGTIVAIGLPPDAYLKAPVINTVVRMITIKGSYVGNRQDGVEALDFFARGLIKAPFKTAPLKDLPKIYELMEQGRIAGRYVLEMPE

SEQ ID NO: 506 - protein, 339 aa, Aspergillus sp.
MSLPQTYKRAVFKELGHPLTVEDAPLKLPGPNELLIKVEACGVCYSDMYSQYNGLGGGFPIVPGHEIIGKVAVVGSEVRDWNVGQRIGAGWHGGHDGTCKACKQGYFQMCDSTAVNGATKEGGYAEYTLIRSESAVHIPANVDAASYAPILCAGLTVFNSIRNVNIRAGETVAVQGLGGLGHLAIQYAKRMGYRVVAISRGPEKEAAARELGADEYIDSNEGDSGEQLAALGGAALAVTTASTGEAITPLLKGLGILGKLLVLSFPSNLTLEPTDLLKYGLSVHFWPSGHPSDAEDAVRFAENTNIASVVEKFPLEQAQQAFESMLSGKVRFRAVITMD

SEQ ID NO: 507 - protein, 350 aa, Aspergillus flavus
MSIPEMQWAQVAEQKGGPLIYKQIPVPKPGPDEILVKVRYSGVCHTDLHALKGDWPLPVKMPLVGGHEGAGVVVARGDLVTEFEIGDHAGLKWLNGSCLACEFCKQADEPLCPNASLSGYTVDGTFQQYAIGKATHASKLPKNVPLDAVAPVLCAGITVYKGLKESGVRPGQTVAIVGAGGGLGSLALQYAKAMGIRVVAIDGGEEKQAMCEQLGAEAYVDFTKTQDLVADVKAATPEGLGAHAVILLAVAEKPFQQAAEYVRSRGTVVAIGLPAGAFLRAPVFNTVVRMINIKGSYVGNRQDGVEAVDFFARGLIKAPFKTAPLQDLPKIFELMEQGKIAGRYVLEIPE

SEQ ID NO: 508 - protein, 353 aa, Neurospora crassa
MPQFEIPEQQWAQVVEKKGGPVVFKQIPVQKPGPDEVLINVKYSGVCHTDLHAMKGDWPLATKMPLVGGHEGAGVVVAKGELVTEVEVGDHAGIKWLNGSCLACSFCMQADEPLCPHALLSGYTVDGSFQQYAIAKAAHVAKIPKGCDLETTAPVLCAGITVYKGLKESGVRPGQCVAIVGAGGGLGSMAIQYANAMGLHAIAIDGGEEKGKNCRELGAQAYVDFTTTKDLVADVKAATPDGLGPHAVILLAVSEKPFHQAVDYVRSRGTIICIGLPAGAKFQAPVFDTVIRMITIKGSYVGNRQDTQEALDFFARGLIKVPIKTVGLSKLQEVYDLMEEGKIVGRYVVDTSK

SEQ ID NO: 509 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 510 - protein, 420 aa, Saccharomyces cerevisiae
MSKIKVVHPIVEMDGDEQTRVIWKLIKEKLILPYLDVDLKYYDLSIQERDRTNDQVTKDSSYATLKYGVAVKCATITPDEARMKEFNLKEMWKSPNGTIRNILGGTVFREPIIIPKIPRLVPHWEKPIIIGRHAFGDQYRATDIKIKKAGKLRLQFSSDDGKENIDLKVYEFPKSGGIAMAMFNTNDSIKGFAKASFELALKRKLPLFFTTKNTILKNYDNQFKQIFDNLFDKEYKEKFQALKITYEHRLIDDMVAQMLKSKGGFIIAMKNYDGDVQSDIVAQGFGSLGLMTSILITPDGKTFESEAAHGTVTRHFRKHQRGEETSTNSIASIFAWTRAIIQRGKLDNTDDVIKFGNLLEKATLDTVQVGGKMTKDLALMLGKTNRSSYVTTEEFIDEVAKRLQNMMLSSNEDKKGMCKL

SEQ ID NO: 511 - protein, 430 aa, Candida tropicalis
MIRASAIQRTAMLLRQLRGFSTSATLADKIKVKNPIVELDGDEMTRIIWQKIKDQLILPYLDVDLKYYDLGIESRDATDDQITIDAANAIKEYGVGVKCATITPDEARVKEFHLKKMWLSPNGTIRNILGGTVFRESIIIPCIPRLIPGWEKPIVIGRHAFGDQYKATDLVINEPGRLELRFTPASGGEAQTQKVYDYTGPGVGLAMYNTDESITGFAHASFKMALAKGLPLYMSTKNTILKKYDGRFKDIFQQIYEQDYAAEFEKQGLWYEHRLIDDMVAQMIKSKGGFVMALKNYDGDVQSDIVAQGFGSLGLMTSALMTPDGKAYEAEAAHGTVTRHYRQHQQGKETSTNSIASIFAWTRGLAQRGKLDETPDVVDFASKLEQATIDTVEVDRIMTKDLALAMGKTDRSAYVTTTEFLDAVADRLKK

SEQ ID NO: 512 - protein, 498 aa, Aspergillus niger
MSSVRFSSALARRSFAVASPPLSAPLSSSARRFLSSSSSTISSSSSSVSTRSPRSLTSASSLLSSRTASARWTGLSSLNLTQSRTMATEIPKIKVKNPVVELDGDEMTRIIWQEIREKLILPYLDVDLKYYDLGLEYRDQTDDQVTVEAAEAIKKYGVGVKCATITPDEARVEEFKLKKMWLSPNGTIRNILGGTVFREPIIIPAIPRLVPGWNKPIIIGRHAFGDQYRATDRVIPGPGKLELVYTPVNGEPETVKVYDFQGGGIAQTQYNTDESIRGFAHASFQMALLKGLPLYMSTKNTILKRYDGRFKDIFQEIYESTYQKDFEAKNLWYEHRLIDDMVAQMIKSEGGFVMALKNYDGDVQSDIVAQGFGSLGLMTSTLVTPTGEAFESEAAHGTVTRHYREHQKGRETSTNPIASIFAWTRGLIQRGKLDETPDVVTFAEELERACIEVVNDEGIMTKDLALACGRKEREAWVTTREYMAAVERRLKANLKSRL

SEQ ID NO: 513 - protein, 427 aa, Saccharomyces cerevisiae
MYSRKSLSLISKCGQLSRLNAQAALQARRHLSIHEYRSAQLLREYGIGTPEGFPAFTPEEAFEAAKKLNTNKLVIKAQALTGGRGKGHFDTGYKSGVHMIESPQQAEDVAKEMLNHNLITKQTGIAGKPVSAVYIVKRVDTKHEAYLSILMDRQTKKPMIIASSQGGMNIEEVAERTPDAIKKFSIETSKGLSPQMAKDVAKSLGFSPDAQDEAAKAVSNLYKIFMERDATQVEINPLSEIEHDPTHKIMCTDAKFGFDDNASFRQEKIYSWRDLSQEDPDEVKAKKYDLNFVKLKGNIGCLVNGAGLAMATMDVIKLNGGDPANFLDCGGGATPETIKQGFELILSNKNVDAIFVNIFGGIVRCDYVALGLVEAARELEVRVPIVARLQGTKVEEGRDIINKSGVKIYSFDELDPAAKKVVELTQN

SEQ ID NO: 514 - protein, 460 aa, Neurospora crassa
SPQPSUCBNEUCRMFKLGRNRALASAFAATSRAPLASRLPSVSQQQRRALSIHEYLSADLLRQYGIGVPKGDVARTGAEAEAIAKQIGGEDMVIKAQVLAGGRGKGTFDNGLKGGVRVIYSPTEAKMFAEQMIGHKLITKQTGAQGRLCSAVYICERKFARREFYLAVLMDRASQGPVIVSSSQGGMDIEGVAKENPEAIHTTYIDINVGVTDEMARDIATKLGFSEQCVEEAKDTIQKLYKIFCEKDATQIEINPLSETSDHKVMAMDAKFGFDDNADFRQPDIFKLRDTTQEDPDEVRAAQAGLNFIKLDGDIGCLVNGAGLAMATMDIIKLNGGQPANFLDVGGGATPAAIREAFELITSDPKVTAIFVNIFGGIVRCDAIAHGLINTVKSLDLKIPIIARLQGTNMEAARQLINDSGMKIFSIDDLQSAAEKSVQLSKVVKMARDIDVGVEFTLGI

SEQ ID NO: 515 - protein, 333 aa, Neurospora crassa [sequence omitted]

SEQ ID NO: 516 - protein, 343 aa, Saccharomyces cerevisiae
MVKVAILGASGGVGQPLSLLLKLSPYVSELALYDIRAAEGIGKDLSHINTNSSCVGYDKDSIENTLSNAQVVLIPAGVPRKPGLTRDDLFKMNAGIVKSLVTAVGKFAPNARILVISNPVNSLVPIAVETLKKMGKFKPGNVMGVTNLDLVRAETFLVDYLMLKNPKIGQEQDKTTMHRKVTVIGGHSGETIIPIITDKSLVFQLDKQYEHFIHRVQFGGDEIVKAKQGAGSATLSMAFAGAKFAEEVLRSFHNEKPETESLSAFVYLPGLKNGKKAQQLVGDNSIEYFSLPIVLRNGSVVSIDTSVLEKLSPREEQLVNTAVKELRKNIEKGKSFILDSSKL

SEQ ID NO: 517 - protein, 341 aa, Schizosaccharomyces pombe
MFAKVAFKNFTPLKSIAPRSFSTTSSRAFKVAVLGAGGGIGQPLSMLLKLNDKVSELALFDIRGAPGVAADIGHINTTSNVVGYAPDDKGLEKALNGADVVIIPAGVPRKPGMTRDDLFATNASIVRDLAFAAGETCPEAKYLVVTNPVNSTVPIFKKALERVGVHQPKHLFGVTTLDSVRASRFTSQVTNGKAELLHIPVVGGHSGATIVPLLSQGGVELTGEKRDALIHRIQFGGDEVVKAKAGAGSATLSMAYAGARMASSVLRALAGESGVEECTFVESPLYKDQGIDFFASRVTLGKDGVDTIHPVGKINDYEESLLKVALGELKKSITKGEQFVA

SEQ ID NO: 518 - protein, 554 aa, Saccharomyces cerevisiae
MVKVSLDNVKLLVDVDKEPFFKPSSTTVGDILTKDALEFIVLLHRTFNNKRKQLLENRQVVQKKLDSGSYHLDFLPETANIRNDPTWQGPILAPGLINRSTEITGPPLRNMLINALNAPVNTYMTDFEDSASPTWNNMVYGQVNLYDAIRNQIDFDTPRKSYKLNGNVANLPTIIVRPRGWHMVEKHLYVDDEPISASIFDFGLYFYHNAKELIKLGKGPYFYLPKMEHHLEAKLWNDVFCVAQDYIGIPRGTIRATVLIETLPAAFQMEEIIYQLRQHSSGLNCGRWDYIFSTIKRLRNDPNHILPNRNQVTMTSPFMDAYVKRLINTCHRRGVHAMGGMAAQIPIKDDPAANEKAMTKVRNDKIRELTNGHDGSWVAHPALAPICNEVFINMGTPNQIYFIPENVVTAANLLETKIPNGEITTEGIVQNLDIGLQYMEAWLRGSGCVPINNLMEDAATAEVSRCQLYQWVKHGVTLKDTGEKVTPELTEKILKEQVERLSKASPLGDKNKFALAAKYFLPEIRGEKFSEFLTTLLYDEIVSTKATPTDLSKL

SEQ ID NO: 519 - protein, 539 aa, Emericella nidulans
MSQVDAQLKDVAILGSVSNEARKILTKEACAFLAILHRTFNPTRKALLQRRVDRQAEIDKGHLPDFLPETKHIRDDPSWKGAPPAPGLVDRRVEITGPTDRKMVVNALNSDVWTYMADFEDSSAPTWDNMINGQINLYDAIRRQVDFKQGQKEYKLRTDRTLPTLIARARGWHLDEKHFTVDGEPISGSLFDFGLYFFHNAKELVARGFGPYFYLPKMESHLEARLWNDVFNLAQDYIGMPRGTIRGTVLIETITAAFEMEEIIYELRDHSSGLNCGRWDYIFSFIKKFRQHPNFVLPDRSDVTMTVPFMDAYVKLLIKTCHKRGVHAMGGMAAQIPIKDNAEANDKAMEGVRADKLREVRAGHDGTWVAHPALASIASEVFNKYMPTPNQMHVRREDVNITANDLLNTNVPGKITEDGIRKNLNIGLSYMEGWLRGVGCIPINYLMEDAATAEVSRSQLWQWARHGVTTSEGKKVDKAYALRLLKEQADALAAKGPKGNKFQLAGRYFAGQVTGEDYADFLTSLLYNEISSPGTASKL

SEQ ID NO: 520 - protein, 542 aa, Neurospora crassa
MASVETLLQGVTISGPIEEHQRKILTPQALSFVALLHRSFNQTRKNLLERRQLRQAEIDRGVLPDFLPETKHIRENPTWKGAPPAPGLVDRRVEITGPTDRKMVVNALNSDVYTYMADFEDSSAPTWANMVNGQVNLYDAIRRQIDFKQGPKEYKLRTDRTLPTLIVRPRGWHLEEKHVTIDGEPVSGSLFDFGLYFFHNAKELVQRGFGPYFYLPKMESHLEARLWNDAFNLAQDYVGIPRGTIRGTVLIETILAAFEMDEIIYELREHSSGLNCGRWDYIFSTIKKFRNHSSFVLPDRSCVTMTVPFMDAYVKLLIQTCHKRGVHAMGGMAAQIPIKDDKAANDKAMEGVRADKLREARAGHDGTWVAHPALASIALEVFNKHMPTPNQLFNRREDVKIGQQDLLNMNVPGSITEEGIRKNLNIGLGYMEAWIRGVGCVPINYLMEDAATAEVSRSQLWQWVKHGVTTAEGKRVDKSYALKLLKEQTDELASKAPQGNKFNLAAQYFATQVTGEDYADFLTSLLYNEITSAGNSLPASKL

SEQ ID NO: 521 - protein, 555 aa, Pichia angusta
MAQINPTTLDNVKILGEVSDKPLLSKATPRDILTKDALKFIVLLHRSFNETRKQLLENRQKVQERLDAGESLHFLEETKYIREDPNWKCLPTHPKLQCRKIEITGPPDAKMIVNAFNTDVFTYMTDFEDSCSPTWNNMIYGQVNLYDAIRDRIDFTNEATGKRYKINREGRRVPVMIVRPRGWHMVDKHILVDGEPISASIMDFGLFFFHNAKFLLSQGLAPFFYLPKMEHYKEAQLWNDIFCVAQDCLEIPRGTIKATVLIETLPISYQLDEVLYALRDHSAGLNCGRWDYMFSTIKRLRNQKQHILPDRHQVTMTVPFMTNYVKQLIKICHKRGVHAMGGMAATIPIKDDPEKNAAAMEAVRQDKLREVLAGHDGTWIAHPGLLPTALSVFQEHMPTPNQIHVQKNVEITEADLVDTNIPDGKITMKGVSANIYIGLNYMESWLRGLGCVPINNLMEDAATAEVSRLQLYSWCKHAVKMDDTGKTITPEFISKLIDEEAERCAANKPNNKFKIAADCLKKEINGHTEVAEFLTTLLYDDIVTIGPEVDISSLK

SEQ ID NO: 522 - protein, 565 aa, Schizosaccharomyces pombe
MPAGTKEQIECPLKGVTLLNSPRYNKDTAFTPEERQKFEISSRLPPIVETLQQQVDRCYDQYKAIGDEPLQKNLYLSQLSVTNQTLFYALISQHLIEMIPIIYTPTEGDAIKQFSDIYRYPEGCYLDIDHNDLSYIKQQLSEFGKSDSVEYIIITDSEGILGIGDQGVGGVLISVAKGHLMTLCAGLDPNRFLPIVLDVGTNNETHRKNHQYMGLRKDRVRGEQYDSFLDNVIKAIREVFPEAFIHFEDFGLANAKRILDHYRPDIACFNDDIQGTGAVALAAIIGALHVTKSPLTEQRIMIFGAGTAGVGIANQIVAGMVTDGLSLDKARGNLFMIDRCGLLLERHAKIATDGQKPFLKKDSDFKEVPSGDINLESAIALVKPTILLGCSGQPGKFTEKAIREMSKHVERPIIFPISNPTTLMEAKPDQIDKWSDGKALIATGSPLPPLNRNGKKYVISQCNNALLYPALGVACVLSRCKLLSDGMLKAASDALATVPRSLFAADEALLPDLNNAREISRHIVFAVLKQAVSEGMSTVDLPKDDAKLKEWIIEREWNPEYKPFV

SEQ ID NO: 523 - protein, 669 aa, Saccharomyces cerevisiae
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 524 - protein, 392 aa, Clostridium thiosulfatireducens
MKEVVIVSAARTAVGSFGGSLSKLSAAEIGAVAAKEAIKRAGIDPAIIDEAIIGNVISAGLGQNVGRQVALKAGLKEESTAISINKVCGSGIKAVTLAAQAIKSGDADVILCGGTESMSNAPYVLPTSRWGQRMGDSTMVDTMIKDGLWDAFYDYHMGVTAENIAEKWGLTREMQDEFALSSQLKAEKAVKEGRFKDEIVPVEIPQRKGDPIVFDTDEFPKFGSTIEKLGKLKPAFKKGGTVTAGNASGINDGAAMFIVMSKEKAEQLGVNYLATIKSYASAGLDPQIMGYGPFEATSKALSKAGLTVEDLDLIEANEAFAAQSLAVAKDLKFDMNKVNVNGGAIAIGHPVGASGARILTTLIYEMIKRDNKKGLATLCIGGGQGIAIVIER

SEQ ID NO: 525 - protein, 282 aa, Clostridium thiosulfatireducens
MKKICVLGAGTMGSGIAQAFAAKGYEVIVRDIKDEFVQKGLGMIEKNIKKLATKGKITEEQAEEILSRVSGTTELSLLDDVDLIIEAAVENMEIKKQIFKELDEICKPEAILATNTSSLSITEIATATKRVDKVIGLHFFNPAPVMKLVEIIKGMGTSQETYDVMHELVINISKEPVQVEEAPGFVVNRILVPMINEAVCIYAEGIASAADIDKAMMLGANHPMGPLALGDLIGLDVCLAIMDVLYKETGDSKYRAHSLLRKFVRAGQLGRKTGKGFFDYSK

SEQ ID NO: 526 - protein, 379 aa, Clostridium thiosulfatireducens
MNFSLTKEQELVKQMVREFAINEVKPIAAEIDVTERFPMENVEQMARYNMLGIPFPTEFGGAGGNNVSYAMTVEELSKVCGTTGVIVSAHTSLCGAPIYQFGTQEQKEKYLTPLAKGEKLGAFGLTEPNAGTDAAGQQTTAVLEGDHYVLNGSKIFITNGGVADIFVVFAMTDKSKGTRGISAFIVEKDFPGFSIGKVEEKLGIRASSTTELVFENCIVPKENLLGKEGKGFAVAMQTLDGGRIGIAAQALGLAQGALDEAVAYMKERKQFGKSIAAFQGLQWMVADMDVQIEAARLLVYKAAYKKDMGMPYSVEAARAKLYASEVAMDVTTKAVQLFGGYGYTKEYPVERMMRDAKITEIYEGTSQVQRMVIAGSILK

SEQ ID NO: 527 - protein, 262 aa, Clostridium thiosulfatireducens
MSGGLYSTEVRDYDTNLDLTKLKPYGDTMNDGKVQVSLTLPVKDDERGIEAAIQLAKSMGLKDPNVAHHGSLDKEFTFYVVYGSLTHTVNYEEIHVQTVEVDTMSMSEVGEYIEEHIGRDVVIIGASTGTDAHTVGIDAIMNMKGFAGHYGLERYKGIEAYNLGSQVENEEFVKKAIELKADVLLVSQTVTQKDVHIQNLTNLVELLEAEGLRDKVVLICGGPRITHELAKELGYDAGFGPGKYADDVASFAVTEIVERKLV

SEQ ID NO: 528 - protein, 518 aa, Clostridium thiosulfatireducens
MESKLNLDLNLVAKARESSKNIAQDTQKFIDRHTTVAVERTVCRLLGIDGVDEFGVPLPNVVVENIKAGNGLSVGVAVLVGNAMVNTGLTPQEIAEKVAKNELDLTKLPMKDMFEIKMAVEKVAKNMVATIKANRGEREAYLEKFGDKTGPYLYVIVATGNIYEDIIQAKAAAKQGADVIAVIRTTGQSLLDYVPYGVTTEGFGGTFATQENFRLMRSALDEVGEELGRYIRLCNYCSGLCMPEIAAMGAMERLDVMLNDALYGILFRDINMQRTIVDQYFSRVINGFAGVIINTGEDNYLTTADAVEEAHTVLASQFINEQFALVAGLPEEQMGLGHAFEINPNVENGFLYELAQAQMAREIFPKAPLKYMPPTKFMTGDIFKGQVQDALFNMVTIMTSQKLHLLGMLTEAIHTPFMSDRALSIDNAQYIFHTMKDLGSEITFKKGGIMETRVDEVLGKAADLLSVIEKEGLFSTLEQGKFAGIKRPLNGGKGLDGVVEKEANYFNPFIDLMLGGNR

SEQ ID NO: 529 - protein, 416 aa, Clostridium thiosulfatireducens
MNTTRRKELFPNVTDEQWFDWKWQTKNRIETLDELKKYIPLTPEEEEGAKKCLETLRMAITPYYLSLIDPNNANDPVRLQAIPTGLEAHKSAADLEDPLHEDTDSPVPGLTHRYPDRVLLLITDQCSMYCRHCTRRRFAGQSDDCMPMERIDKAIDYISKTPVIRDVLLSGGDALLVDDSVLEYIISKLRAIPHVEIIRIGSRTPVVMPQRITDGLVNMLKKYHPIWLNTHFNHPNEITEESKAACERMANAGIPLGNQSVLLRGVNDCVHTMKQLVNDLVKIRVRPYYIYQCDLSLGLEHFRTPVSKGIEIIEGLRGHTSGYCVPTFVVDAPGGGGKTPVMPNYVISQSHDKVILRNFEGVITTYSEPTNYTPGCTCDVCTGKKSVHKVGVAGLLNGEKLALEPTGLERNERHAH

SEQ ID NO: 530 - protein, 345 aa, Clostridium thiosulfatireducens
MKKGCKYGTHRVITPAGVLPQPALKIDNTMEIYDNEILIDVQALNVDSASFTQIEEEAGHDVEKIKAKILEIVGERGKMQNPVTGSGGMLIGKIAKIGAALEGKTDLKVGDKISTLVSLSLTPLKIEEIIDIKPDIDRVEIKGQAILFESGLYAKLPEDMEETLALAALDVAGAPAQVAKLVRPGQSVLLLGAAGKSGMLCCYEAVKRVGPTGNVIGLVRNEEEAARLRRLNLNMKIVIGDATKAIDVMNLALANNNGEEVDVSINIVNVQNTEMSTILPVKDDGIVYFFSMATAFTKAALGAEGVGKDVTMIVGNGYTKGHAEITLQELRENETLRAIFQELYV

SEQ ID NO: 531 - protein, 274 aa, Clostridium thiosulfatireducens
MEKLIIAAAICGAEVTKEQNPNVPYTVEEIGQEAEKCYKAGASIIHLHVRKDDGTPTQDKDRFEACMAEIRRRCPDVIIQPSTGGAVGMSNEERLQPVDLSPEMATLDCGTCNFGGDEIFVNTENTIKEFGEKMIQLNVKPEIEVFDKGMIDMAIRLHKKGFIKAPMHFNFVMGVNGGISAGMRDFVFMKESIPAGSTYTVSGIGRNEFPLAAMSMIEGGHVRVGFEDNVYLSKGVMAESNADLVEKAVRIAKELGREIATPAEAREILGLKAL

SEQ ID NO: 532 - protein, 126 aa, Clostridium thiosulfatireducens
MKSVIRLRMSAHDAHYGGNLVDGARMLQLFGDVATELLIQNDGDEGLFKAYENVEFMAPVFAGDYIEAVGEIVHVGNTSRKMTFEARKVIVPRPEINDSACDVLEEPIVVCKATGICVVPKDKKRK

SEQ ID NO: 533 - protein, 219 aa, Clostridium thiosulfatireducens
MDKNMIREVIAKRVAKELNDGDVVNLGIGLPTMVANYIPEGIDVTLQSENGFIGIGAAPAPGEEQKDLVNAGGQHVTVIPGAAFFDSSVSFGIIRGGHVAATVLGALEVDQEGNLANWMIPGKMVPGMGGAMDLVVGAKKVIVAMEHTAKGNPKILKKCTLPLTAAHQVNLIITEMAVLEVTSEGLVLKELGPEATIEDVKNATLADLIIPENVKKMEL

SEQ ID NO: 534 - protein, 356 aa, Clostridium thiosulfatireducens
MGHKQLIINPGSTSTKIGVYDDENPILVETLRHSAEEIGKYKEIYDQLEFRKEVILQVLKEKGFDIKELSGVVGRGGLLKPIEGGTYSVNDAMIKDLKQGVLGQHASNLGGIIAHEIATEINVPSFIVDPVVVDELEDVARISGMPEIDRKSIFHALNQKAVAKRYAKETNTSYEELNLIVAHMGGGISVGAHKQGRVVDVNNALDGEGPFSPERSGGLPVGDLVKLCFSGKYTMDEIKKKINGKGGIVGYLQTNDAKLVGDRVAEGDKEAKLIFDAMAYQVAKEIGRCATVLQGKVDAILLTGGIAYGKYIVEYIKERVEFISQVVVYPGEDELLALAEGGLRVLTGQEAAKEYK

SEQ ID NO: 535 - protein, 300 aa, Clostridium thiosulfatireducens
MIKTFDEVISKVKSQSMKKVAVAVAQDEPVLEAIRDAKKNGIADAILVGDKEEIVKIAETIGMNIDEYEIIDEKDVNKASIETVKLVSSGRADMMMKGLVDTATFLRAVLNKEVGLRTGKQMSHIAIFEVPGYDRLLFVTDAAFNMYPELKEKIDIIKNAVQVAHALENNMPKVAPICAVEVVNPSMPATLDAANLSKMNERGQIKGCIIDGPLALDNALSKEAAAHKKISGPVAGEADILLMANIEAGNAVYKCLTYTTESKNGGLLMGAAAPVIVTSRADSPETKMNSIALASLVAGR

SEQ ID NO: 536 - protein, 379 aa, Clostridium thiosulfatireducens
MNVFEVIKDLFASSGFAALTWQQAVMIGVSLVFIWLAIGKKFEPLLLLPIAFGMLLTNIPLGNIMAEPVGKEVGGLLYYLSRGVKWEIFPPLIFLGVGAMTDFGPLLANPSSVLMGAGAQFGIFFAFGVAILFGFTPQEAASIGIIGGADGPTAIFLTNKLAGHLLGPIAVAAYSYMALVPLIQPPIMKALTTKEERRIKMGQLRQVKQIEKIVFPIVVTIMVTLLLPSLLPLIGMLMLGNLFKESGVVGRLSDTAQNALVNIVTIFLGLSVGATATAEAFINPKTIGIVIIGVASFAVATAGGVLVGKIMCKLTKGKINPLIGSAGVSAVPMAARVSQVVGQKEDPTNFLLMNAMGANVSGVIGSAVAAGVLLTLFGS

SEQ ID NO: 537 - protein, 359 aa, Clostridioides mangenotii
MNKVFKILTINPGSTSTKIAVFDNEEEVFEKTLRHSSDEIGKYDRISDQFEFRKQVIVDSLAEGGIKLSDLDCVVGRGGLLKPIEGGTYEVNAPMLEDLKVGVSGEHASNLGGIIAKQIGDEVNASSYIVDPVVVDELNDLARISGMPEIERASIFHALNQKAIARRFANENNKKYEDINLVVAHMGGGVSVGAHEKGRVVDVANALDGEGPFSPERSGGLPVGQLAKMCFSGEFTLDDIKKKIKGNGGLVAYLGTNDAREVEDMIEKGDKKAELLYDAMAYQIAKEIGACASVLKGNVDGILLTGGIAYSKSFTQMIIDRVKYITDVTVYPGEDEMIALAQGGLRVLSGEEEAKVYGN

SEQ ID NO: 538 - protein, 264 aa, Clostridioides mangenotii
MSGAYSLENKEYDKNLDLKNIKPYGDTLNDAKVQVSFTLPIKDDEKGIEAAKLIGKNMGLSDINVAHHKALDEEFTFYIVYGSLEKGINYEDIHVEVAQEDTMDKNEIENYIKENIKRDVVVVGASTGTDAHTVGIDAIMNMKGYAGNYGLERYEGVEAHNLGSQVPNEEFIKKAIELKADVLLVSQTVTQKNIHIENLTNLVELLEAEGLRDKVILLCGGPRISYELAKELGYDAGFGAGKFAQDVGSFFVTELVNRRLACAD

SEQ ID NO: 539 - protein, 519 aa, Clostridioides mangenotii
MSKVNLDFEIVEKARKSARNIVSEVQEFIDKNTTVSVERTILRLLGVDGVDEFGVPLPNIVVDSIKNSNDGSLGMGVAYYMGNAMINTGLTPQEIADKVSNGDLDLCKNKEHDVFDVKLKINDIAKKSVEQIKANRNKREEFLNEYGDKTGPYIYVIVATGNIYEDITQAVAAAKQGADIIAVIRTTGQSLLDYVPYGATTEGFGGTYATGENFRLMREALDKVGAELGRYIRLCNYCSGLCMPEIAALGAQNRLDVMLNDALYGILFRDINMKRTMIDQFFSRIINGFAGVIINTGEDNYLTTADAIEEAHTVLVSQLINEQFALVAGLPEEQMGLGHAFEISPDVENSFLYELAQAQMAREIFPNAPLKYMPPTKFMTGDIFKGQVQDALFNMVTIMTNQKLHLLGMLTEAIHTPFISDRAISIDNARYIFSTMKDIGEEIEFKKDGIMCNRVDEVLNNAHDLISEIEKEGLFKTIEKGKFAGIKRPIDGGKGLDGVVMKDSVYFNPFVDLMLGGKC

SEQ ID NO: 540 - protein, 416 aa, Clostridioides mangenotii
MERKIFTNVSDELWNDWNWQVKNRITTVEDLKNYIPLTEQEEEGVKKCLRTLRMSITPYYLSLIDPKNPNDPIRKQAIPTSDELKVSDADLDDPLHEDGDSPVPGLTHRYPDRALLLITDQCSMYCRHCTRRRFAGQNDGAQPIDRIDNAIEYIRNTPAIRDVLLSGGDALLMSDDRLEYIISKLREIPHVEIVRIGSRVPVVMPQRITDDLVNMLKKYHPVWLNTHFNHSNEITPESIEACAKMINAGIPLGNQSVLLRGVNDCMHVMMKLVNDLVKIRVRPYYIYQCDLSNGIEHFRTPVSKGIEIIEGLRGHTSGYCIPTFVVDAPGGGGKTPVMPNYVISQSHDKVILRNFEGVITTYTEPSHYSHTCECEVCRGEREVHKVGIAGLLNNQQSVMEPVGLERKQRELSAHLG

SEQ ID NO: 541 - protein, 344 aa, Clostridioides mangenotii
MKGCKYGTHRVIGENALPQPAKKLNNDMNEIFDNEILIDVQALNIDSASFTQIEEECEHDVEKIKSKIQEIVEEKGKMQNPITGSGGMLIGTIEKIGSDLVDKIDIKVGDKIATLVSLSLTPLKIGKILDIKSEIDRVEIKGKAILFESGIYAKLPEDMEENLALAALDVAGAPAQTQKLVKEGDSVLILGGAGKSGMLCCYEARKKAGKSGRVIALVIDDEQAKFIEENDIADSAIAVDAKNPVEVLNKVLEVNEGKEVDLAINCVNVQNTEMSTILPVRNGGVVYFFSMATVFTKAALGAEGVGKDVDMIIGNGYTKGHADVTLTALRESATLRKIFKNLYI

SEQ ID NO: 542 - protein, 219 aa, Clostridioides mangenotii
MNPKEIIAKRVAKELKDNQLVNLGIGLPTLTANYIEEGINVTFQSENGMVGMNKVADDDQIDPYITNAGGQYVTINENGAFFDTSMSFGLIRGGHVDVTVLGALEVDQHGNIANWIVPGKMVPGMGGAMDLVVGAKKVIVAMLHTAKGNHKILKECNLPLTAKGVVDMIITEYAVMNVTKEGLVLTEICEDITIEELKEMTEADLIISENLVYTNAQLV

SEQ ID NO: 543 - protein, 217 aa, Clostridioides mangenotii
MSKVISLEKLKEVFKDEMTIMIGGFLGCGTGEALIDSLIESNVKNLTIIGNDTSYVDQGIGRLIVNNQVKKVIASHIGTNSETGRLMNEGKLDVELSPQGTLIERIRAGGYGLGGVLTHTGVGTIVEENKQKINISEKEYLLELPLRADIALVYGTLVDEFGNTMYKGTTKNFNPIIAMASDIVVVQAEELVSVGDIDMELIMTPGVVVDYIVKGKN

SEQ ID NO: 544 - protein, 281 aa, Clostridioides mangenotii
MQKVIITAAICGAEVTKDHNPNVPYTVEEIAREAKYAYDAGASIIHLHVREDNGEPTQSIDRFRECIDAIKVACPDAIIQPSTGGAVGMSNEERIQPLNLYPEMATLDCGTCNFGGDEIFVNTENTIKEFGEKMIELNIKPEIEVFDKGMIDMAIRLNKKGFISDNMHFNFVMGVNGGISATYRDLIFMRDSIPESSTFTVSGIGRFQFDMIALGILMGGHVRVGFEDNVYMKKGVPASSNGEFVQRAASIVKELGREVATPKEARQILGLTSKVLEAQEA

SEQ ID NO: 545 - protein, 126 aa, Clostridioides mangenotii
MKSMIRMRMSSQDAHYGGNLVDGAKMLQLFGDIATELLIQNDGDEGLFRSYDSVDFLAPVFAGDYIEAVGEIVKVGNSSRKMVFEARKVIIPRTDISGSAAEVLEEPIVVCKASGTCIVPKDKQRL

SEQ ID NO: 546 - protein, 374 aa, Clostridioides mangenotii
MQNYKLLKQMLREFTLNEVAPIAHEIDEEEKFPYETVEKMAKCGILGIPFPEEYGGEGGDYLGYAMTVEELSKACGTTGVIVSAHTSLAGSPIFEFGSEEQKQKFLVPLAKGEKLGAFGLTEPNAGTDASGQQTTAVLDGDNYILNGTKIFITNAGPAEIYVVMAMTDKTKGTRGISAFIVEKDTEGFTIGKKEQKLGIRGSSTCELIFENCKIPKENLLGKESQGFKIAMKTLDGGRIGIAAQALGIAQGALDTTVEYVKDRKQFGRSISAFQNTQFELADMKTKIEAARHLVYDAAKKKGEGKSYNVEASMAKLYAAQVAMEVTTKAIQLHGGYGYTREYDVERMFRDAKITEIYEGTSEVQKMVISADLLK

SEQ ID NO: 547 - protein, 394 aa, Clostridioides mangenotii
MKEVVILSAVRTPIGSLGGALKNVSAVELGSIAAKEAIKRANIESHMIDEVLIGNVLSAGLGQNVARQVAINSGIPVEVPSLAINKVCGSGLRAVSMAAQFIALGDCDVVLAGGCESMSNAPYLINKGRYGYGLGDNKLVDSLVNDGLTDAFNDYHMGITAENLAEKFDISKEEQDRFALLSQERAKNAQLNNRFKDEIVEVVVPQRKGDPLVVDTDEHIKPNTTIEKLGKLRPAFKKDGTVSAGNASGINDGGAMVVLMSREKCDELGLKPLASIVSYATAGVDPSIMGYGPVPATEKALKKANLKLDDIDLIEANEAFAAQALSVEKELKFNMEKVNVNGGAIALGHPIGASGCRILVSLIHEMQKRETANLGLATLCIGGGQGVSLIIKKC

SEQ ID NO: 548 - protein, 391 aa, Clostridioides mangenotii
MREVVIVSAARTAVGSFGGAFKSVSAVDLGITAAKEAIKRAKITPDMIDESLIGGVLTAGLGQNIARQVALGSGIPVEKPAMTINIVCGSGLRSVSMASQLISLGDAEIMLVGGTENMSMSPYLSPNTRYGARMGDTPFVDSMIKDGLSDIFNNYHMGITAENIAEKWNITRDEQDQLALSSQNKAEKAQAEGKFDEEIVPVVIKGRKGDTVVDKDEYIKLGTTIETLSKLRPAFKKDGTVTAGNASGINDGAAMLIVMSKEKAEELGIEPLATIVSYGTSGVDPEIMGYGPVPATIEALTKANMTIDDIDLVEANEAFAAQSLAVIKDLKIDTTKVNVNGGAIAIGHPIGCSGARILTTLLYEMKRRDAKTGLATLCIGGGMGTTLIVKR

SEQ ID NO: 549 - protein, 281 aa, Clostridioides mangenotii
MKLAVIGSGTMGTGILQTFASSGHDICLKSRSQESLSNCMTLLDKNLSRLVSKDKINESQKSEILDHITLTTNYEDLKDMDIIIEASVEDMDTKKEVFKLLDELCKPDTILATNTSSLSITEIASATKRPDKVIGLHFFNPVPMMKLVEVISGQLTSKVTFDTGIQLSKSINKVPVDVSESPGFVVNRILIPMINEAVGIYADGVASKEEIDEAMKLGANHPMGPLALGDLIGLDVVLAIMNVLYNEFGDTKYRPHPLLAKMVRANQLGRKTKIGFYDYNK

SEQ ID NO: 550 - protein, 372 aa, Lactobacillus brevis
MKKYVVVGSGLFGSVFAYEAAKRGNKVIVLEKRNHVGGNIFTKEIEGIQVHMYGAHIFHTKMKRIWDYVHQFAEFNNYVNSPIANFNGEIYNLPFNMNTFNKLWGVKTPDEAKAKIKEQKEYMKIAGDPHNLEEQAISLIGPDVYEKLVKGYTEKQWGMSATELPAFIIRRLPVRFTYDNNYFSDPYQGIPVGGYTQIIEKLLNSELISVETGVDFLKKRDNYLDSETKVIFTGMIDQYFDYTLGELEYRSLRFESEIVDCDNYQGDAVVNYTDAKTPFTRIIEHKHFEFGKGNKGKTVITHEYPKNWQRGDDPYYPINNQKNKTLYKKYTEMAAREAPNVIFGGRLGQYRYYNMDQTIMAALQVAKNEFGD

SEQ ID NO: 551 - protein, 334 aa, Lactobacillus brevis
MTVLVLGGAGYIGSHAVDRLVEKGYDVAVVDNLVTGHRAAVNAKARFYEGDVRDQAFLDGVFDKEDIEGVIHFAAFSVVPESMKKPLKYFDNNTAGMVSLLEVMNKHNVKKIVFSSTAATYGEPKQIPIKETDPQVPTNPYGESKLMMEKIMRWSDEAYGIKFVALRYFNVAGAKEDGSIGEDHHPETHLVPIILEVAAGERDQLAIFGDDYPTKDGTNVRDYVHVVDLADAHILALEYLKAGHDSDAFNLGSSTGFSNKEMLEAARKVTGKEIPAKMAPRRAGDPSTLIAASDKARKTLNWQPRFDNVEDIIRTAWNWKQTHPAGYNDRNEEK

SEQ ID NO: 552 - protein, 331 aa, Lactobacillus paracasei; identical to SEQ ID NO: 283

SEQ ID NO: 553 - protein, 245 aa, Lactobacillus paracasei
MRSRVIYADTYRKRHQRRLFLLAVLIIALGALFVWWHQRNPRPDPQTYPVLGVRLDQTDGVQDFDSLRSSKVSFVYLKATEGSSYFDDNFNTNFNQAAGSRLSIGIYHVFSFETTPQAQAAQFTRQVGQNIGDLPIGIYLSYYTEKKPSTQWLTTHLQTFVTLVQQHYHRQVLLMGSPSILKAVQKVDPQAPRWVVSDKKPTTSSGFWQYTSGARLPNGPHADYRAAVFMGDRAAFLKLSQQIVN

SEQ ID NO: 554 - protein, 371 aa, Lactobacillus paracasei
MKLLVVGAGLFGATVARERARKGDKVDVIEKRDHLAGNAYTEEIEGIQVHRYGAHIFHTSNKTVWKYVNQFAEFNRFTNEVIANYQGEIYNLPFNMNTFNKMWGVITPAEAASKIAEQRLAMSGKQPQNLEEQAISLVGTDIYNKLIKAYTAKQWGRDPKDLPAFIIRRLPVRLTFDNNYFDDLYQGIPIGGYTQIVEKMLDQPNITVQLNTDFLQNKAEYLKRYDQIVYTGMIDEFFDYQLGTLEYRSLRFETELLNMANFQGNAVVNYTDAETPFTRIIEHKHFEFGKSNPGKTVITREYPVNWSRGDEPYYPVNNSENNHLFKKYREFASINMPQVAFGGRLGLYRYYNMDQVLAAALQFLDGDFFAS

SEQ ID NO: 555 - protein, 211 aa, Lactobacillus paracasei; identical to SEQ ID NO: 287

SEQ ID NO: 556 - protein, 501 aa, Lactobacillus brevis
MDENKSEQQIDTQKANRITGFQLFSMTTSMVMTVYGFAAFAKQGPTAFFYLFLAGILWFLPVTRTSGEMASIDGWSKGGIFTWSRNMLGERAGWSALFYQWIHITVGMNTMMYFIIGCFSVTFGLPIITDNPLVKFILMMIILWGLIFLQQKGTSVTGKIAQWCFTLGVIIPVFFLLFLFILYLVQGNPAMIHVNMHTIFPSSWNGSVLVGFVPFILAFAGAEGSAPHVKDLDKPSIYPKVMMALAVAAICSDIIGSMAIAMTIPNNQIQLSNGIVYAYGALVARYGVGVVFVEKLTGFLLAVGVLGEISSWVVGPNAGMFEAAKAGYLPPRFSKANKYGIETNVMVLQGVIVSIVGALLTFGAGGDKASLSFQTAMSLTVALYTLMYMLMFISYLVLQFKYVDLHRDFVAAKSRWLRITYGILGFILSAFGFVVTFFPPADLSVASKHTYLMLLVSAFVVMLVLPFILYRFHDKWALQLGVNVDEVAAPTGHEALEKETK

SEQ ID NO: 557 - protein, 480 aa, Lactobacillus brevis
MMNKNDQETQQMINNVDLEKTFLGSVEAGQSLPTNTLPDDPMAPDVAAQLVEHYRLNEAKANQNLATFCTTQMEPQADELMKNALNTNAIDKSEYPKTAAMENYCVSMIAHLWGIPDNEKIYDDFIGTSTVGSSEGCMLGGLALLHSWKHRAKAAGFDIEDLHSHKPNLVIMSGYQVVWEKFCTYWNVEMRQVPINGDQVSLDMDHVMDYVDENTIGIIGIEGITYTGSVDDIQTLDNLVTEYNKTATMPVRIHVDAAFGGLFAPFVDGFNPWDFRLKNVVSINVSGHKYGMVYPGLGWIVWRHNTADILPAEMRFQVPYLGKTVDSIAINFSHSGAHISAQYYNFIRFGLSGYKTIMQNVRKVSLKLTAALKTYGIFDILVDGSQLPINCWKLADDAPVGWTLYDLESELAKYGWQVPAYPLPKNRDDVTISRIVVRPSMTMTIADDFLDDLKLAIDGLNHTFGVTTTVDQDNKTTVRS

SEQ ID NO: 558 - protein, 516 aa, Clostridioides mangenotii
MLSKEKLDLLQEKRYAIELGGGQKRIDKQHSSGKLTARERLNRLFDENTFVELEAFVKHRCSNFGMEKQEIPGEGVVCGYGKVDGRLVCAFAQDFTVLGGSLGEMHAKKIGKVMDLSLKLGVPVVGLNDSGGARIQEGVDALAGYGEIFYKNTLASGVVPQISAIMGPCAGGAVYSPALTDFVYVVDQTSQMFITGPQVIKTVTGEEVTAEELGGAYTHNTTSGVAHFIASNDEDCIDQIKRLLSFLPSNNSEKAPILECQDNANRINDKLDSIVPDDSNKPYDMKEIIFEIVDSGDFYEVQPLFAQNIVTGLARINGESIGIIANQPNFMAGSLDINASDKSSRFIRMCDSFNIPILSLVDVPGFLPGTAQEYGGIIRHGAKMLYAYSEATVPKITIITRKAYGGSYLAMCSKDLGADMVLAWPTAEVAVMGPSGAANIVFKNDIKNAEDKNAMRAEKAKEYTTEFATPYKAAERGYIDDVIRPSLTRLRLADALDILSSKREERPPKKHGNIPL

SEQ ID NO: 559 - protein, 470 aa, Meyerozyma caribbica
MSICEKYFPKEPSAPVLSTSSTGEVSKAEIKTLDKTFDARAAYFVADYEKSEGNYIADVDGNLYLDVYAQIASIPLGYNNPELIKTAKSDKMIRAIVDRPAMGNFPGADLKEITLKLLEFAPKGQDKLWSGLSGADAVELAFKAVFFWYQSKKRGFGKAFTAEENESVMNNQAPGSPELAILSFERAFHGRLFASGSTTRSKPIHKMDLPSFNWPKAQYPSYKYPLEEHTEENKREDERCLKIVEDLFSSWKCPIAGLLIEPIQSEGGDNHGSAEFFQGLRDITIKHGALMIVDEVQTGVGATGKFWCHEHFNLSPPPDLVTFSKKFQSAGYFFHDPKLVPDFAYRQFNTWCGDPARMILAGAIGDEIVKNNLAAKAQEVGDYLFKKLESLQSKYPKYLQDLRGKNRATFIAWTLPSGDDRNKFLSDMRAAGVNIGGCAEASVRLRPTLVFEQKHADILVAAIEKVLGSC

SEQ ID NO: 560 - protein, 491 aa, Meyerozyma caribbica
MVPGIKNTNLIRSSPYIAGKWLESASKATFKVTDPATDKEIAELPDQTPEEIDHAINSAYEAFKTYKHTNVYDRAKWLRNLYNLMMENQDDLARIITWENGKCLTDALGEVKYAASYFEWFSEEAKRMYGHTIQPSVPSNKVITLKQPVGVVGLLCPFNFPLAMGTRKLAPALAAGCTAVLKPDGQTPLSSLAIAYLAEQAGFPAGTINVVLTSTKNTPMVGLKFCESPLIKKVSFTGSTRVGKLLMQQSSSTLKKLSMELGGNAPIVVFDDADLDLAVLQAVASKFRSLGQTCVCANRIYVQSGIYEKFAEKFAEKVKLFKIGNGFEEGVTHACLVNESLIEKVESHAKDAVAKGATTLVKGGRLPELGKHFYAPTVLRDVAIGLAVLKEETFGPLAALVKFDTKEEVLEQCNDTEFGLASYVFSENLNTIWYMSENIEAGMVSVNTGLFTDAAMPFGGVKESGFGREGSLYGIDDYTVIKSITLGNVYR

SEQ ID NO: 561 - protein, 473 aa, Hanseniaspora uvarum
MSYCSKAYKEPTAPTVVTTAIPGPESIKQISELDKNFDARPVYFMCDYEKSEGNYLADVDGNVFLDVYAQIASIALGYNNPDLIKAAQSPEMIRSLVERPALGNFPGADFNGILEKVLKLAPKGQSKVWSALSGADANELAFKAAFVYYRAKERGGFEVKHSDEELSSVMVNQAPGAPHLAVLSFKKAFHGRLFASGSVTRSKPVHKLDFPAFDWPQAEYPYYKYPLAENEEYNKKEDERCLAIVEKLIKEWPTSKGAKVAALIIEPIQSEGGDNHASAYFLQALRDLTLKHNVVYIIDEVQTGLGATGSLWCHEQANITPPVDLVTFSKKFQSAGYFFNDEKFIPALPYSIFNTWCGNPSSMIIAGAIGEVIEREKLLEQVVRVGDYLMNKLQKVAEKYPQHLGRLRGKATFIAFDLENAETRNKLLTLLKLNGCNVGGCADASVRLRPTLTFEEKHADIFIEALEKSLASL

SEQ ID NO: 562 - protein, 416 aa, Hanseniaspora occidentalis
MFNIKPALLKQATKIKVKTPVVELDGDEMTRIIWDKIKKTLIHPYLDVDLKYYDLGIKKRDETNDQITKDSALAIKKYGVGIKCATITPDEQRVKEYNLKQMWKSPNGTIRNILGGTVFREPIIISNIPRLVSKWNKPIVIGRHAHADIYKCQDMIVPATGGSLDMVFTNAKTGEKQVIPVYDFKSGGVALSQYNTDESITGFAHSCFKTAIDKKMDLYFSSKNTILKKYDGRFKDIFEELYQTTYKTKFEELGIQYTHRLIDDMVAQMLKSEGGFVMALKNYDGDVISDILGQGFGSLGLMTSVLISPDGKSFESEAAHGTVTRHYYKHLNGEKTSTNSIASIFAWTRGLIKRGELDNTPDVVKFAKELERITIETVESGIMTKDLAIAKGTPNEFVDTDGFLDAVAKNLEKSIK

SEQ ID NO: 563 - protein, 425 aa, Hanseniaspora occidentalis
MFSITRRYLSTQTKIKVKTPVVELDGDEMTRIIWDKIKSKLILPYLDVDLKYYDLSVTSRDKTDDQITVDAANAIKKYGVGIKCATITPDESRVEEYNLKKMWRSPNGTIRNILGGTVFREPIVIPRIPRLVPSWESPIIIGRHAHADIYKCQDMVVPKPGKLELVYTPTDPKDGERVLLDVYDFKDPKGGVALGMYNTVESITGFGDSCFQLAISKKMDLYLSTKNTILKKYDGKFKDIFQELYETKYKDEFKKLGINYEHRLIDDMVAQMIKSKGGFIMALKNYDGDVQSDILAQGFGSLGLMSSMLVTPDGKTFESEAAHGTVTRHYRRYQKGEETSTNSIASIFAWSKGLGKRGELDNTADVVKFANLLEKATLDTVQVQGIMTKDLALACGNKERSAYVTTDEFLDSVEKNLKDEMTKLD

SEQ ID NO: 564 - protein, 563 aa, Hanseniaspora occidentalis
MSEITLGKYLFERLRQVNCNTIFGLPGDFNLSLLDKIYEVEGMRWAGNANELNAAYAADGYARVKGMGCIITTFGVGELSALNGIAGSYAEHVGVLHVVGCPSVSSQAKGLLLHHTLGNGDFTVFHRMSANISETTAMVTDLATAPAEIDRCIRTTYMTQRTVYLGLPANMVDLYVPAKLLETPIDLTLKPNDAEAEKEVVDTILELIAAAKNPVILADACANRHDVKPELKELIDATQFPSFVTPLGKGTIDEQHPRFGGVYVGTLSSPAVKDAVENADLILSVGALLSDFNTGSFSYSYKTKNIVEFHSDYIKIRNASFPGVQMKFALQKLLSQIKPVVANYTPVAVPAGRAPNAEVPASTLLKQEWVWNELGKFLQEGDVVLTETGTSAFGINQTHFPTNSSCISQVLWGSIGFTVGACLGAACAAEELDVNRRVILFVGDGSLQLTVQEISTMIKWGLKPYLFVLNNDGYTIEKLIHGPTAQYNQIQPWKHQQILSTFGATDSESIEVRTTGEWQKLTTDEHFVKNERIRLIEVFLPEMDAPSSLIEQAKLTEATNAKQ

SEQ ID NO: 565 - protein, 563 aa, Hanseniaspora occidentalis
MSEITLGKYLFERLRQVNCNTIFGLPGDFNLSLLDKIYEVEGMRWAGNANELNAAYAADGYARVKGMGCIITTFGVGELSALNGIAGSYAEHVGVLHIVGCPSVSSQAKGLLLHHTLGNGDFTVFHRMSANISETTAMITDLATAPAEIDRCIRTTYLSQRTVYLGLPANMVDLYVPAKLLETPIDLSLKPNDEEAEKEVVETILELIGGAKNPVILADACANRHDVKPELKELIDATQFPSFVTPLGKGTIDEQHPRFGGVYVGTLSSPAVKDAVENADLILSVGALLSDFNTGSFSYSYKTKNIVEFHSDYIKIRNASFPGVQMKFALQKLLSQIKPVVANYVPVAVPAGRAPNAEVPASTLLKQEWVWNELGKFLQEGDVVLTETGTSAFGINQTHFPTNSSCISQVLWGSIGFTVGACLGAACAAEELDVNRRVILFVGDGSLQLTVQEISTMIKWGLKPYLFVLNNDGYTIEKLIHGPTAQYNQIQPWKHQQILSTFGATDSESIEVRTTGEWQKLTTDEHFVKNERIRLIEVFLPEMDAPSSLIEQAKLTEATNAKQ

SEQ ID NO: 566 - protein, 572 aa, Hanseniaspora occidentalis
MAKNLTLNVQGDIECPLEGFQLLNSPVFNKGSAFTQEERDHFKLNGLLPPHIHTLEEQIDRSYKQLHDLKDPLRKNDFMTSLRTQNKTLYYALIKKHISELVPIIYTPTEGDAIANYSARFRRPEGVFLDITSPDSILERMSQFGTDADIDYIVVTDSEGILGIGDQGVGGVRISVSKLALMNLCAGIHPGRGLAVVLDVGTNNETLATDELYMGNRFARVRGKQYDDFVAKFMNVVKEHYPSSVLHFEDFGVSTARPILEKYRSEVACFNDDIQGTGAVVMSSLLAALKHTERDLKTAKILVYGAGSAGLGIADQIVNHMVSHGLTKEQARANIYAMDRHGLILSSMGDVSYESQMVYSKPDAEWEGINTKSLIDVVDHVKPTCMIGCSTQTGAFTEAVIKQMYKHNDKPIIFPLSNPTRLAEAVPEDLLKWTDFNALIATGSPFKPVEGYNIAQNNNCFSFPGIGLGAALSKASVISDTMISAAVDELANLAPIKNGDPKAGLLPDLTTITELSSKIATAVALQAVKEGVAKRQDVPADYDTCLTWVEKQMWQPVYRPMVKVDGELKHQI

SEQ ID NO: 567 - protein, 337 aa, Hanseniaspora occidentalis
MLQTTFSRRLFSQSMANQYKVAVLGASGGIGQPLSLQMKLNHKVSELRLYDLRLAKGVAADLSHIPTDSKVIGYSNDEPEGLAKALDNADVVLIPAGVPRKPGMTRDDLFSINAGIVRDLAEAVAKNCPNASICVISNPVNSTVPIVAKVLQKHGVYNPKKLYGVTTLDIIRASRFISEVEGTNPTQEKVNVVGGHSGITIIPLISQTNHKLMPKEVKDKLIHRIQFGGDEVVKAKDGAGSATLSMSYAGAVFADKVLDGLLGEKDVIVNSFVESPLYKEEGIDFFSSPITLGPEGVQKVHPIGEISSEEEALLAECKETLKKNIAKGYKFVEESKL

SEQ ID NO: 568 - protein, 175 aa, Hanseniaspora occidentalis
MFMLRNPLLASLRSSYKPNTITNRLFSINKNLLQTPAKGQEILLKQRANRPISPHLTIYQPQITWYLSSVHRVSGVLLGAIFFGVSIAYGINKIYDFGLNDDSLVEFYKTNVPTWLDYTGKASVAYLFTFHFANGIRHLVWDKGSGFTIKGIYKGGYSVLAVCAVAGSYLFSKAF

SEQ ID NO: 569 - protein, 189 aa, Hanseniaspora occidentalis
MFKVVGLQTSSMLFARSTAAQQVSKRTGSLMARALRASSRRMVSTEATSIREADQILVKQRAVRPISPHLTIYQPQITWYLSSVHRVSGVLLGAVFFGATIAFGVSSLLGLGLTSEKLSQYYHAHVPKWADYTVKGGFAYLFAFHFGNGIRHLIWDAGKGFSIKGIYAGGYAVLALTAIAGTGFFFKGL

SEQ ID NO: 570 - protein, 684 aa, Hanseniaspora occidentalis
MTMDHTVVHEAHNVAMRNTPQHFYDSQPARGSYIKNKEQYDEMYKQSINDPEQFFGNLAKEYLHWDKEFTKTLTGSLEKGDIAWFLNGELNACYNCVDRHAFETPDKVALIYEADDESENTKITFNELLEKVCKVAGVLKSWGVKKGDTVGIYLPMTPEAIIAMLAVARLGAIHSVIFAGFSSGSLKDRIVDASCKVVITCDEGKRGGKTINIKKIVDEGLNGVQIVSKILVYKRTGNPKVSMQPGRDFYWDEECAKQRSYLPHVPVNAEDPLFLLYTSGSTGSPKGVVHTAGGYLLGAALTTRFVFDLHPEDVFFTAGDVGWITGHTYALYGPLSLGTSSIIFESTPAYPDYGRYWRIIERYRATHFYVAPTAMRLIKKVGEQEIDKYDISSLRVLGSVGEPISPDLWEWYNEKIGKNNCVICDTMWQTESGSHLIAPLAGAFPTKPGSATLPFFGINASIIDPVTGQELLGNDVEGVLAIKSPWPSMARSVWNDHQRYMETYLKPYPGFYFTGDNAGRDHDGYFWIRGRADDVVNVSGHRLSTNEIEVALSEHESVSECAAIGIADDLTGQAVIAFLSLKNDDDEHTSQTATSSSSPEDLLLLRKELVMKVRGSIGPFASPKSVIIVDDLPKTRSGKIMRRVLRKIASNELDQIGDLSTLANPESVPKLISAVDAQFWSVKK

SEQ ID NO: 571 - protein, 674 aa, Hanseniaspora occidentalis
MSTNHVEVHEANGVSFRQAPEHFFKSQPSKSYIVDEAQYKAWYDQSINDPESFYGALAKEYLHWDKPFTKVRSGDLSNGDISWFLQGELNACYNCVDRHAFANPDKIALISEPDEESEAYSITFQQLLEKVCKVAGVLQSWGVKKGDTVAVYLPMTPEAVIAMLAIARIGAVHSVVFAGFSAGSLKDRVVDAGSKVVITCDEAKRGGKTINTKKIVDEGLNGVQSVSKILVFKRTGNPDVKMTPGRDYYWDEVCATQRSYVPCVPTNAEDPLFLLYTSGSTGQPKGVVHTVGGYLLNAALSTRFVFDLHPEDVFFTAGDVGWITGHTYALYGPLSLGTASIIFESTPAYPDYGRYWRIVNRWKATHFYVAPTAMRLIKKVGEAEIAKYDISSLRVLGSVGEPIQPDLWEWYNEKVGNNNCCIVDTYWQTESGAHLITPLAGAFPTKPGSASLPFFGIAPAIIDPATGKELEGNDVAGVLAIKSTWPSVARTVYNDHSRYMETYLKPFAGYYFTGDNAARDNDGYYWIRGRADDVVNVSGHRLSTNEIETVLDEHSGVTECACIGINDDLTGQAVVAFISLKDGACDITNESEFTAFKKSLVMEVRGVIGPFASPKAIIAVSDLPKTRSGKIMRRVLRKIASNEMEQLGDLSTMANPECVPKIIAAVDSQFFVKK

SEQ ID NO: 572 - protein, 353 aa, Hanseniaspora occidentalis
MSHPVIPKTQKAVVFYKNGGKLTHQDIPVPTPKANELLINVKYSGVCHTDLHAWKGDWPLGVKLDPFLVGGHEGAGVVVAMGSEVKGWKIGDYAGIKWLNGSCMNCEECELGYESNCALADLSGYTHNGSFQEYATADAVQAAKIPPGTDLAEVAPILCAGITVYKAIKSAELQPGQWVAVSGAAGGLGSLAVQYAKAMGLRVLGIDGGEGKEELFKKCGGEVFVDFTKEKDIPAVILKATNGGAHGVINVSVSEKAIEQSTQYVRTNGTVVLVGLPADAYCKSSVFDQVVKSYKIVGSYVGNRADSREAIDFFVRDLVRSPIKVVGLSELPRIYEEMEAGKILGRYVVDTSK

SEQ ID NO: 573 - protein, 351 aa, Hanseniaspora occidentalis
MSAIPQNQKAVVFYKNGGELTYEDIPVPTPKANELLINVKYSGVCHTDLHAWKGDWPLGVKLDPFLVGGHEGAGVVVAMGENVKGWNIGDYAGIKWLNGSCMNCEECELGNESNCPVADLSGYTHNGSFQQYATADAVQAAKIPQGADLAEISPILCAGITVYKAIKSAEMQPGQWIAISGAAGGLGSLAVQYAKAMGLRVVGIDGGEGKEELFKKCGGEVFVDFTTEKDIPAAIVKATNGGAHGVINVSVSEKAIEQSTQYVRTNGTVVLVGLPANAYCKSSVFDQVVKSYKVVGSYVGNRADSREAIDFFVRGLVRSPIKVVGLSELPRIYEEMEAGKILGRYVVDTTC

SEQ ID NO: 574 - protein, 372 aa, Hanseniaspora occidentalis
MLRSFTRSSTVSPLVLRRLQSTFTIPTIQKGVTFYENNGPLKYEDIAVPKPKSNELLINVKYSGVCHTDLHAWKGDWPLAVKFDPYLVGGHEGAGVVVGMGSEVKNWKIGDYAGIKWLQSSCMSCEACENSNESNCDHAVLSGYTHNGSFQQYATADAVQAARIPHGTDLAEVSPILCAGVTVYKALKSANLKAGQWVAISGAAGGLGSLAVQYAKAMGYRVVGIDGGEGKEELFKKCGGEVFIDFTKEKDIVEAIKEATHGGAHGVVNVSVSEAAISMSTKYVRNNGTVVLVGLPAGAVCKSDVFSHVVKSISIVGSYVGNRADTREAIDFFARGLVKSPIKIIGLSELPRAFSEMEQGKVLGRYVVDTAK

SEQ ID NO: 575 - protein, 621 aa, Hanseniaspora occidentalis
MLRHSLTRSANKSLTLQSSRLFSRSSVAKMASTTSTSTSPAEKYNIIDHEYDCLVVGGGGAGLRAAFGLSEAGFKTACISKVFVTRSHTVAAQGGINAALGNAHKDDWKHHMYDTVKGSDWLGDQDAIHYMTREAPHSIIELEHYGITVKGGQAYRTCAVADRTGHAMLHTLYGQAVKHNTDFFIEYFALDLLTHNGEVVGVIAYNQEDGTIHRFRSHKTVIATGGYGRAYFSCTSAHTCTGDGNAMVSRAGFPLQDLEFVQFHPSGIYGSGCLITEGARGEGGYLVNSEGERFMERYAPSAKDLACRDVVARAITQEIREGRGVGKNKDHMNLQLSHLPAGVLKERLPGISETASIFAGVDVTKEPIPIIPTVHYNMGGIPTKWTGECLTIDEEGKDKVIPGLLACGEAACVSVHGANRLGANSLLDLVVFGRAVAHHITDTLQPGLPHKPLPSDLGYKSLLNLEELRTSSGNKKTAEIRLDMQKAMQDHVAVFRTEEVLNEGVDKLKQVSETFKDVGIQDRSLIWNSDLVETMELQNLLTLSNQTCVSANSRKESRGSHVILDSKTNEQLPRDDEKWLKHSLSFQQDIYDPVTMKYRDVTMTTLDENECPSVPPAVRAY

SEQ ID NO: 576 - protein, 266 aa, Hanseniaspora occidentalis
MSSVITKRITQITQLNSILVSKRFQSVAAPANLKTFKIYRWNPDTPEVKPKMQEYKVDMNNCGGMVLDALIKIKDEQDGTLTFRRSCREGICGSCAMNIDGRNTLACLCKIDSEKASSIKIYPLPHTHVVKDLVPDLTQFYKQYKSIQPYLQRKEFPKDGTEILQTVEDRKKLDGLYECILCACCSTSCPSYWWNAEEYLGPAVLMQSYRWMIDSRDEAKEKRKEMLQNSMSVYRCHTILNCTKTCPKGLNPGKAIAEIKKFLASA

SEQ ID NO: 577 - protein, 323 aa, Hanseniaspora occidentalis
MLRNTGSKLLSKRLYSRPATIYDETIGNLALGNDTKVIIQGFTGRQATFHSQISLDYGTNIVGGTNPKKAGQTHLGKPVFATVKDAMKETGANVTGIFVPPPIAASAIKEAIEAEIPLAVTITEGIPQRDMLYIAEMLQSQNKTRLVGPNCPGIFNPNSKVRVGIQPTSIFTPGKIGIVSKSGTLTYEAVHQTTLAGLGQTLVIGMGGDSFPGTDFIDALKYFKNDPTTEGLILLGEIGGVAEIEAAQFIKEMGMDLPIASFIAGEATAGIKGKRFGHAGAIASGADDTAAAKKKALRAAGVAVVDSPGMLGEALLGEFAKRK

SEQ ID NO: 578 - protein, 436 aa, Hanseniaspora occidentalis
MLRNQIFQNSSKIIKRSLSIHEYRSAELLRQYGIGTPKGVAATTPQEAIVAADKLFSSGDVTKGLVLKAQALTGGRGKGHFDNGLQSGVHFIKSAKEAGDLSAQMLGAKLITKQTGAEGKHVSAVYLANQCDVVHESYLSILTDRSTKRNLIVCSPKGGMNIEEVAKNEPEMIFKYYFKPDEVLNDEKSVEIAKNLGFTDSVVAEAGKTIQNLYKIFQEKDATLIEINPLAQVKPTNLSSSSTSESNSQALTGKQTEVMCMDAKFGFDDNAEYRQKEVFEWRDLTQEDPDEIVAKQNDLNFIKLNGDIGCLVNGAGLAMATMDVIKLYGGKPANFLDCGGGATPETIEIAFKLILSNPDVKAIFVNIFGGIVRCDFVAKGLVAASKSLNVKVPIVVRLQGTNLAEGKQIIQDSGLKIYSFSDLDPAAKKVVEFINN

SEQ ID NO: 579 - protein, 173 aa, Hanseniaspora occidentalis
MFKSVCTRTSRVSLLLSKTPSQLSLLKPVSTTMSGVFTSIRNNSSSGISANEAADAELLKRIKIKPLKRFNEDRNKKIARLIYQSRKRGILETDILLSGFASKYLKSFTDAQLQEYDNLLNELDWDIYYWATKNYKITPLPERWENSEILTLLQEYSENKERKMMRVPELHEY

SEQ ID NO: 580 - protein, 564 aa, Meyerozyma caribbica
MSEITLGRYVFERIKQVGVNTIFGLPGDFNLSLLDKIYEVEGLRWAASLNELNAAYAADGYSRIKGLGVIITTFGVGELSALNGIAGAYAEHVGVLHIVGVPSLASQAKQLLLHHTLGNGDFDVFHRMSANISETTAMITDLAAAPAEIDRCIRTAYIAQRPVYLGLPANLVDLNVPAKLLETKIDLALKANDAEAENEVVETILALVADAKNPVILSDACASRHNVKAEVKQLIDATQFPAFVTPLGKGSIDEKHPRFGGVYVGTLSSPEVKQSVESADLILSVGALLSDFNTGSFSYSYQTKNIVEFHSDYIKIKNASFPGVQMKFVLEKLIAKVGAKIANYSPVPVPAGLPKNAPVADSTPLAQEWLWNELGEFLEEGDIVVTETGTSAFGINQTRFPTDAYGISQVLWGSIGYSVGAMVGATFAAEELDKAKRVILFVGDGSLQLTVQEIACLIRWGLKPYIFVLNNNGYTIEKLIHGPTAQYNMIQNWKHLDILPTFGATDYEAIPVKTVGEWKKLTADPAFKKNSTIRLIEVFLPEMDAPSSLVAQANLTAAINAKQD

SEQ ID NO: 581 - protein, 564 aa, Meyerozyma caribbica
MSEITLGRYVFERIKQVGVNTIFGLPGDFNLSLLDKIYEVEGLRWAASLNELNAAYAADGYSRIKGLGVIITTFGVGELSALNGIAGAYAEHVGVLHIVGVPSLASQAKQLLLHHTLGNGDFDVFHRMSANISETTAMITDLAAAPAEIDRCIRTAYIAQRPVYLGLPANLVDLTVPAKLLDTKIDLALKANDAEAEDEVVETILSLIADAKNPVILSDACASRHNVKNEVKQLIDATQFPAFVTPLGKGSIDEKHPRFGGVYVGTLSSPEVKQSVESADLVLSVGALLSDFNTGSFSYSYQTKNIVEFHSDYIKIKNASFPGVQMKFVLEKLIAKVGAKIANYSPVPVPAGLPKNAPVADSTPLAQEWLWNELGEFLEEGDIVVTETGTSAFGINQTRFPTDAYGISQVLWGSIGYSVGAMVGATFAAEELDKAKRVILFVGDGSLQLTVQEIACLIRWGLKPYIFVLNNNGYTIEKLIHGPTAQYNMIQNWKHLDILPTFGATDYEAIPVKTVGEWKKLTTDPAFKKNSTIRLIEVFLPEMDAPSSLVAQANLTAAINAKQD

SEQ ID NO: 582 - protein, 411 aa, Meyerozyma caribbica
MLTRALRASRVSQKRFLSLHEYRSAALLKSYGVGVPSGDAALTPQQAYDVAKSIGSNELVIKAQALTGGRGKGHFDNGFQGGVQMISTPEQAKELSEKMLGHKLITKQTGEAGKEVTAVYIVERKDAKTEAYLAILMDRATQLPMIVASSQGGMDIEGVAAKDPDAIKTFPINLDEGVTDSKATEIASVLGFSQEAVPEAALTIQKLYKVFMERDCTQVEINPLSEITDGSVMAMDAKLGFDDNASFRQKEVFSWRDPTQEDPEEVEAAEYGLNFIKLDGNIANIVNGAGLAMATMDIIKLNGGEPANFLDCGGTATPETIEKAFELILSDKKVNGIFVNIFGGIVRCDYVAKGLIAATKNFQLDIPVVVRLQGTNMKEAKELINNSGLKLYPFEDLDPAAEKIVSLAPAS

SEQ ID NO: 583 - protein, 321 aa, Meyerozyma caribbica
MKSIRTLSTSAPLRNYASTIKNLKVNLDTKVIYQGFTGRQGTFHAEQAIAYGTKIVGGTNPKKAGSTHLDRPVFANVSDAIKETGANATAIFVPPSIAAAAIEEAIEAEIELAVAITEGIPQHDMVRIAQMLKTQSKTRLVGPNCPGLIAPDQCKIGIMPSHIHQRGKVGVISRSGTLTYEAVAQTTGVGLGQSLVIGMGGDPFPGTNFIDALTLFLEDKETEGIILIGEIGGTAEEEASEFLKQHNLTRPDGPKPVVSFIAGVSAPPGRRMGHAGAIISGGKGDAKSKIAALESAGVVVERSPARLGNSLLEEFKNKGLL

SEQ ID NO: 584 - protein, 175 aa, Meyerozyma caribbica; identical to SEQ ID NO: 568

SEQ ID NO: 585 - protein, 437 aa, Meyerozyma caribbica
MLRSIGHTKPLSGGSRMTQATTVTYGIRYLATASKIKVKNPIVELDGDEMTRIIWQRIKDKLVHPYLDVDLKYYDLGIEARDKTDDQITIDAAHAIQKYGVGVKCATITPDEARVQEFGLKKMWLSPNGTIRNILGGTVFRESIVIPRVPRLVPGWKQPIVIGRHAHGDQYKATDLVVSGPGKLELKFTPKDGGESETRVVYDYQGPGVGLAMYNTDESIRGFAHSSFKMALSKKLPLYMLTKNTILKKYDGRFKDIFSEVYQEYQAEFEAQGLWYEHRLIDDMVAQMMKSQGGFVMALKNYDGDVQSDIVAQGFGSLGLMTSVLMTPDGKAFESEAAHGTVTRHFRQHQQGKETSTNSIASIFAWTRGLAQRGRLDNTPEVVEFAERVEKATVDTVDKQGIMTKDLAIACGNHDRSAYVTTTEFLDAVADSVANSK

SEQ ID NO: 586 - protein, 418 aa, Meyerozyma caribbica
MFNIKPALLKQATKIKVKTPVVELDGDEMTRIIWDKIKKTLIHPYLDVDLKYYDLGIKKRDETNDQITKDSALAIKKYGVGIKCATITPDEQRVKEYNLKQMWKSPNGTIRNILGGTVFREPIIISNIPRLVSKWNKPIVIGRHAHADIYKCQDMIVPATGGSLDMVFTNAKTGEKQVIPVYDFKSGGVALSQYNTDESITGFAHSCFKTAIDKKMDLYFSSKNTILKKYDGRFKDIFEELYQTTYKTKFEELGIQYTHRLIDDMVAQMLKSEGGFVMALKNYDGDVISDILGQGFGSLGLMTSVLISPDGKSFESEAAHGTVTRHYYKHLNGEKTSTNSIASIFAWTRGLIKRGELDNTPDVVKFAKELERITIETVESGIMTKDLAIAKGTPNEFVDTDGFLDAVAKNLEKKHKIS

SEQ ID NO: 587 - protein, 514 aa, Meyerozyma caribbica
MFKSTAKQAFKSAPTLARMYSDLPLSVKVTFPTGKSYEQPTGLFINNEFVQPKRKKTFEVISPATEEEICHVYEAREEDIDIAVEAAEAAFNTDWSTGPPLERTKYLTRLADLIEEHADTLAHIDTFDNGKSLANSRGDVALAANYIRSCAGWADKIQGSAPDTGSSHLNIVKREPIGVCGQIIPWNFPLLMLAWKLGPALATGNTIVLKTAETTPLSGLYVANLIKEAGFPKGVVNIVSGFGKIAGDAIATHNKIKKIAFTGSTATGRHIMRAAANSNLKKVTLELGGKSPNIVFDDANIDTTVQNLVTGIFYNTGEVCCAGSRVYVQEGIYDELLTAFKKAAEDVKIGDPFAEDTFMGAQNSSNQLDKILKYIEIGKNEGAKVIAGGARHGDKGFFVKPTIFGDVKEDMQIVKDEIFGPVVTITKFSTVDEVVKLANDSEYGLAAGIHSTSIDTIMSVANRIHAGTVWVNTYNDFDHMVPFGGYGQSGIGRELGEAALDNYTQVKSIRVGLH

SEQ ID NO: 588 - protein, 361 aa, Meyerozyma caribbica
MAVPKTQKGVTFYENNGELKYETIDVPTPKADEILINIKYSGVCHTDLHAWKGDWPLPVKFDPYCVGGHEGAGVVVAIGDNVKGWNLGDYAGIKWLNGSCMNCEECELSNESNCPEADLSGYTHNGSFQEYATGLAVQAAHIPKPEEGSEWYGKDDEYLAEVAPILCAGITVYKALKSADCKPGQWVAISGAAGGLGSLAVQYAKAMGLRVIGIDGGEGKEDLFKKCGGEIFVDFTKEKDVPAAINKATNGGAHGVISVSAAEAAISQSTQYVRTNGTIVLVGLPANAYCKSNVFEQVVRSYKIVGSYVGNRADTREALDFFERGLVRSPIKIVGLSELPRVFEEMAAGKILGRYVVDTTH

SEQ ID NO: 589 - protein, 362 aa, Meyerozyma caribbica
MCVCVETQKAIVFYKNGGDLTYEDIKTPKPKPDEILINIKYSGVCHTDLHAWKGDWPLDVKLDPYLVGGHEGAGVVVAIGDNVKGWNLGDYAGIKWLNGSCMNCEECELSHESNCPEADLSGYTHDGSFQQYATGLAVQAAHIPKPEEGSKWYGKDDEYLAEIAPILCAGITVYKALKSSEAKPGQYVAISGAAGGLGSLAVQYAKAMGLVVVGIDGGEGKEELFKKVGGDVFIDFTKEKNVPKKILEVTKGGAHAVINVAVSEAAISQSTQYVRSNGTVVLVGLPANAYCKSNVFEQVVRSYKIVGSYVGNRADTREALDFFERGLVRSPIKIIGLSELPKVYEEMESGKILGRYVVDTSY

SEQ ID NO: 590 - protein, 388 aa, Meyerozyma caribbica
MLKTSIRNIARQQFRTAPALRAAPVFRANAGVRIARTLASYTIPEKQKAVIFETNGGELKYTDIPVPKPKPNELLINVKYSGVCHTDLHAWKGDWPLDTKLPLVGGHEGAGVVVGMGENVVGWKVGDLAGIKWLNGSCQACEYCDGGHESNCALADLSGYTHDGSFQEYATADYIQAARIPDGTDLAQVAPILCAGITVYKALKTANLTQGQWVAISGAGGGLGTLAVQYAKAMGYLVVGIDGGADKAKTATSLGADAFVDFTKDKDVVAKIQEITNGGPHGVINVSVSPQAMQQSVDYVRPTGTVVLVGLPADAAVKASVFDSVVKTISIRGSYVGNRADTREAIDFFTRGLVHSPIKLAGLSELPRIYEEMEKGAIVGRYVVDTSK

SEQ ID NO: 591 - protein, 551 aa, Meyerozyma caribbica
MSNPFPRTEDKLKGVQILASIPDRSKHIFNPEAVAFVATLHRAFNGERKRLLANRKQQQQLRDQGVLPDFLPETKHIREDPTWTGPPLAPGLRDRRVEITGPTDRKMVINALNSGVATYMADFEDSLTPAWDNLVDGQTNLYDAVRRNLKFESGGKKYELKIEKGKHIPTLIVRPRGWHLEEKHFLVDGEPVSGGIFDFGFYFFNSAKEALAQGFGPYFYLPKMEHHLEAKLWNDIFNYSQDYIGINRGTIRGSVLIETLPAAFQMDEIIYQLRQHIGGLNCGRWDYIFSYIKSLRNHPEFILPDRSQVTMSAPFMSSYVKLLVNTCHKRQVHALGGMAAQIPIKNDEQRNKAALENVAKDKLREVMAGCDSCWVAHPALVPVVLKVFNEHMKGPNQINVPPRTPYKPVTARDLLSPYVPGAKITEQGIRANCIIGLSYIEAWLRNVGCVPINYLMEDAATAEVSRTQIWQWVTHGAKTDKGVLITKEYVSKLLQEEYSKLEKAAPSGNKFKRALEYFKPEASAEKYSDFVTTLIYDDVTTIGRPTAAEKL

SEQ ID NO: 592 - protein, 417 aa, Meyerozyma caribbica
MADFEDSSAPTWSNMVDGQVNLYDGVRRTITFQAPGGKSYKLRSDKEKLPTLIVRPRGWHLDETHFLVDGKPISGGLFDFGLYFFNNAKESVARGAGPYFYLPKMESHLEARLWNDVFKLSQDWIGMPRGTIRGTVLIETILAAFEMDEIIYELREHSSGLNCGRWDYIFSFIKKFKNHPEFVLPDRGDVTMTVPYMSAYVKLLIQTCHKRGVHAMGGMAAQIPIKNDAAANKVAMEGVYKDKLREVTAGHDGTWVAHPQLATIAVEVSTDDERTSTSLLETLINPYIEGGKITEEGIRKNLFIGLGYMEAWLRGLGCVPINYLMEDAATAEVSRSQLHQWVKHSVTTAEGKKVTKDYAVKLLNEETDKLIKDAKPGNKFAEAAAYFKPEIVGDKYSDFLTTLLYDQITSVNGSSKL

SEQ ID NO: 593 - protein, 674 aa, Meyerozyma caribbica; identical to SEQ ID NO: 571

SEQ ID NO: 594 - protein, 670 aa, Meyerozyma caribbica
MPESTNHLDHEKMLDPPKAFFERSTSKPNLASFDEYKKLYKQSIDDPATFFGTAAKELLDWDRPFDYTRFPLDPKDDFKNGDIPSWFINGQLNASYNAVDRWAMKNPEKPAIIYEADEVSDGRTISYGELLKQVSKLAATLTNLGVKKGDSVAVYLPMIPEAIVTLLAIVRIGALHSVVFAGFSSTSLRDRIIDADSRIVITADESKRGGKTIETKKIVDDALKECPNVRNVLVFKRTGNSHVPFLAGRDLWWHDELQKYGPYFPPVPVNSEDPLFLLYTSGSTGKPKGVQHNTAGYILGALMTAKYTFDLHEEDIIFTAGDVGWITGHTYVVYGPLLCGATTVVFEGTPAYPNYSRYWDIVDKYKVNQFYVAPTALRLLKRAGTKYVENHDLSSLRVLGSVGEPIAAEVWHWYNDNIGRGNAHIVDTYWQTESGSHLLTPLAGVTPTKPGSASLPFFGIDARILDPVSGKDLGDNNVEGVLCVKSAWPSITRGIYHDYARYIDTYLKPYPNHYFLGDGAARDKDGFFWILGRVDDVVNVSGHRLSTAEIEAALIEHELVGESAVVGYADELTGQAVAAYVSLKSNVEVDDLEAIKKELILTVRKEIGPFAAPKLILLVDDLPKTRSGKIMRRILRKVLAGEENQLGDISTLSNPQVVSQVIEVVKASRK

SEQ ID NO: 595 - protein, 668 aa, Meyerozyma caribbica
MTQQHSVVHEANTSLLRAIPEEFFAKQPRKGHVESLEQYHELYKKSIEDPQGFFGPLAKELLSWDREFTHVKSGSLHHGDAAWFLNGQLNASYNCVDRHALATPDKIAIMYEADEEKDSYTLTYAELLREISKVAGVLTSWGIKKGDTVAIYLPMNPQAIIAMLAVARIGAIHSVIFAGFSLGSIKDRVNDAACKALLTCDEGRRGGRPVNIKKLCDDALEQCPTVEKVLVFKRTGADVAMKKGRDFYWDEETANFPGYTPPVPVNSEDPLFLLYTSGSTGTPKGVLHTTGGYLLGAALTTKYVFDIHPEDILFTAGDVGWITGHTYALYGPLALGVSTIVFEGTPAYPDYGRLWNIVDKYKATHFYVAPTALRLLRKAGEEELAKYDLSTLRTLGSVGEPISPDIWEWYHEKVGRGKCHITDTYWQTESGSHFIAPFAGITRNKPGSASLPFFGVQTCLIDPVSGQEITGNDVEGVLAIKDTWPSMARSVWKNHTKYMDTYLRPYPGYYFTGDGAARDHDGYYWIRGRVDDVVNVSGHRLSTAEIEAALIEHHGVSEAAVVGINDDLTGQAVVAYVALKDEAGASNGDELRKALVLQVRKEIGPFAAPKSVIIVADLPKTRSGKIMRRILRKISSNEADQLGDITTLANPQSVEGIIKEFSLQFGKK

SEQ ID NO: 596 - protein, 332 aa, Meyerozyma caribbica
MFTKIAARSFSSTSASAYKVAVLGANGGIGQPLSLLLKLNHKVTDLSLYDLKGAPGVAADVSHIPTNSTVRGYDPENLKEALTGADVIVIPAGVPRKPGMTRDDLFNTNASIVRDLAKAAADHAPDAAVCIISNPVNSTVPIVAEVFKSKGTYNPKKLFGVTTLDVLRASRFVAEVANTNPVHEKVTVVGGHSGVTIVPLLSQTNHKSLDAETRDALIHRIQFGGDEVVQAKNGAGSATLSMAQAGARFAGAVLDGLAGETDVVEPSFVDSPLFKDEGVDFFASKVTLGTEGVKKVHSLGELSGHEEELIKTAKETLIKNIQKGVEFVKQNP

SEQ ID NO: 597 - protein, 336 aa, Meyerozyma caribbica
MVKVTVCGAAGGIGQPLSLLLKLNPKIDELALFDVVNVPGVGTDLSHICSNSTTTSHLPSAKEDKTALADSLKNSDLVIIPAGVPRKPGMTRDDLFNINASIVQGLAQGIAESCPDAFVLIISNPVNSTVPIVAETLKKNNVFNPKKLFGVTTLDIVRANTFISQLYPKETKPTDFNINVIGGHSGETIVPLYSLGNSKQYLDKLSEEQQKELIHRVQFGGDEVVQAKNGAGSATLSMAYAGYKLAESILKAFDTPNIVECTFLNLDSSIKGASEAKKLVGNLDFFSLPVKLGKSGIEEVQYEILDKISANEKKLLEVAVDQLSKNIEKGVSFVKK

SEQ ID NO: 598 - protein, 625 aa, Meyerozyma caribbica
MLRNLRFLSNLAKKAAANAEHQSVHTHTIKTPVGIRAAIESLKPKTTRLSIEGAIECDLEGFQILNSPIFNKGSAFTRQEREAFKLTGLLPSQVNTLEDQVGRAYAQFSYLKTPLAKNDFLVSMRMQNKVLYYELVRKHIREMLPIIYTPTEGDAIAAYSHRFRKPEGCFLDITDPDSIPERLASYGEDKDIDYIVVSDGEGILGIGDQGVGGVRIAIAKLGLMTLCGGIHPGRTLPVVLDTGTDNEKLLADDLYMGNKFPRVRGEQYWDFIDKFITAVKERFPSAVLHYEDFGVSTGRKMLHKYREAIPSFNDDIQGTGAVVMASMTAALKFTNRDLLDSKVLIYGAGSAGLGIADQIVNHMRSHGASTEEACKAIHCMDRRGLILKSYEDSTEGQKRYADDDADWEGIDTKNLVEVIKKIKPTALVGCSTQPGAFTEEVVRAMYEHNKQPIIFPLSNPTRLHEAVPEDLMKWTDNNALIATGSPFQPVNGYVISENNNCFTFPGIGLGAVLSRCSTISDAMISAAVDQLASLSPKMDDPKNGLLPRLEEIDEVSAKVATAFILQSLKEGSARVESEKRPDGGMVQVPRDFNECLKWVQSQMWRPIYRPLVKVEHVPEIHTFQH

SEQ ID NO: 599 - protein, 343 aa, Meyerozyma caribbica
MSDNKIIFKHEEDSNTIVCPLSKFELINSSIFNKGSAFTNEEKDLFNLKGLLPSKTNTLEEQIERSYKQYSDLTHPLRKNDFMTSLRQQNKTLYYALVAKNLTEMIPIVYTPTEGDAIINYSNRFRRPEGCFLDITCPEEIKNRLECFGLKEDLDYIVVSDGEAILGIGCQGVGGASRISLAKLGLMTLCAGIHPARGLAVALDVGTNNKDLATDPLYMGNKFSRISGDNYFAFLDKFMMVLKEHYPNVIVHFEDFGVPNAQILLDKYRDVIPCFNDDIQGTGAVVTASLMAALKYTNRKLPESKILVYGAGTAGCGIAQQIVNHLKSFGLNRGRSLLQDLLY

SEQ ID NO: 600 - protein, 257 aa, Meyerozyma caribbica
MIKSVLRQRIPFRTLATLAQQPALKKFQIYRWNPDTPEVEPQMKTYEVDLNQCGPMVLDAILKIKNEQDATLTFRRSCREGICGSCAMNIGGVNTLACLCKIDKDTSKDTKIYPLPHMFVVRDLVPDLTHFYKQYKSIQPYLQRETLPSDGRENLQSIEDRAKLDGLYECILCACCSTSCPSYWWNQQEYLGPAVLMQAYRWLIDSRDEATKARKEMLQNSMSLYRCHTIMNCARTCPKGLNPGRAIAEIKKQLAFD

SEQ ID NO: 601 - protein, 641 aa, Meyerozyma caribbica
MLSVARIGRSRARWAISRSFASSAVRSQTIGDIKGKDVNASKYMSQKYHVIDHEYDCVVVGAGGAGLRAAFGLAEAGFKTACISKLFPTRSHTVAAQGGINAALGNMHKDDWHWHMYDTVKGSDWLGDQDAIHYMTKEAPQSIYELENYGVPFSRNEEGRIYQRAFGGQSKEYGKGGQAYRTCAVADRTGHALLHSLYGQSLRHDTHFFIEFFAMDLLMQDGACVGVIAYNEEDGTLHRFRAHRTVIATGGYGRAYFSCTSAHTCTGDGYAMVARAGLPLEDLEFVQFHPSGIYGSGCLITEGARGEGGFLVNSEGERFMERYAPSAKDLASRDVVSRAITMEINEGRGVGPLKDHMYLQLSHIPAAVLKERLPGISETAHIFAGVDVTKEPIPILPTVHYNMGGIPTKWNGEVLKKNDKGEDEVVPGLLACGEAACASVHGANRLGANSLLDLVVFGRAVSHTIRDNLTPNTPHKPMPQDLGVESIENLDKLRNANGTHSTADLRLEMQKTMQKGCAVFRTQETLDEGVEHILRVDKKFHDVKTTDRSMIWNSDLVETLELQNLLTCATQTAVSAAARKESRGAHARDDYPERDDENWRKHTLSYQTGYGEDVKLDYRDVIRTTLDENDCKPVPPAKRVY

SEQ ID NO: 602 - protein, 674 aa, Hanseniaspora uvarum; identical to SEQ ID NO: 571

SEQ ID NO: 603 - protein, 219 aa, Hanseniaspora uvarum
MSTELIIEKTDFYQSIDNLTLDLYTTKPLPDVLKSLKAPLEKDLVKYDESTQSLVLKFDIDGYSIDYSLKLAHPISKIANLSIGFKKFEVSLIKADNSINWKHVEYKENQASSDGHLFNTSNIIDSSTNKLKQPYTSKVDWSTFNADETPELQEDKVAEEEDENAFFQKIFKDATDDQKKAMIKSMQESSGTVLSTDWDKVKENPVEPNLPDGAEFTSR

SEQ ID NO: 604 - protein, 363 aa, Hanseniaspora uvarum
MSPKIPETQKAIVFYKNGGDLTYEDIKTPKPKPDEILINIKYSGVCHTDLHAWKGDWPLDVKLDPYLVGGHEGAGVVVAIGDNVKGWNLGDYAGIKWLNGSCMNCEECELSHESNCPEADLSGYTHDGSFQQYATGLAVQAAHIPKPEEGSKWYGKDDEYLAEIAPILCAGITVYKALKSSEAKPGQYVAISGAAGGLGSLAVQYAKAMGLVVVGIDGGEGKEELFKKVGGDVFIDFTKEKDVPKKILEVTKGGAHAVINVAVSEAAISQSTQYVRSNGTVVLVGLPANAYCKSNVFDQVVKSYKVVGSYVGNRADTREALDFFERGLVRSPIKIIGLSELPKVYEEMESGKILGRYVVDTSY

SEQ ID NO: 605 - protein, 399 aa, Hanseniaspora uvarum
MYRSLFRPLSATLIRSAPTLKKNLNLRVLSKRANATVNVPKTQKAVVFYKHNDGLKYQDIKTPEPKSNELLVKILYSGVCHTDLHVYKGDWTEINYKFDPYLVGGHEGAGIVVGMGSQVKGWKLGDLAGIKWLQSSCQACEYCETGHESNCDHAELSGATHNGSFQQYATTDAVQAARLTNPKDLDVWGEEKFAEYMAKVSPILCGGLTVYKALKSSNLKANQWCLVTGCGGGLGSLATQYANAMGFRVIGIDSGEEKEKFFKRLGGEVFIDFKKTNDIVSDIQQATKGGPHAVINLATSSDSISLSTKYCRTNGTIVLVGLPAGAVVKSDVFDHVVKSLNIVGSYVGNRADTREALEFFNRGLIKSEIKVVGLSELEHVFEDMENGRVVGRVVVDTSK

SEQ ID NO: 606 - protein, 1091 aa, Hanseniaspora uvarum
MALHLSASNGSNGSSEKSPTQDTNNEITPPKLPPRTNAIDNESIQDLLKNQQANFRKLYEKFMNEAKSGDAVYIFPKKWFATYFNTDTITKDDDSTSNEECLKAFFEAPYLPEDVNQITYLEYLKSDLLIPMGYDLMAEIFNFYGFNGTWIEGFIIKNEDGISIDENLLTMQVCILVESRWKTAQTTPVIFTSSRYSNLGQLFQTAANKLQDQLSLDTFDKRCWYSSADISTEDDYVKDFLILPNDFLKLSNIQYVDNTMADLLFPEETFLKLNTLIIEIKFGDVWPSLFHLYNSTKKITVSEQETNAIKQGIVGLNNLGNTCFMNSALQCLVHVPELVEYFENGCHLEELNVDNPLGYNGKIATVFGDLIKELYEKNVEKKSIAPRNFKMNLGMCNPMFAGYSQQDSQEFLSFLLDGLHEDLNRIKDKPYVENSSSGLDFDYSNKEKIVALAKESWEKYKLRNDSVILDLFVGLFESTLICPDCKHVSITFDPFNDLSLPIPVETFWKKSIYILPLDDDPHTLELEMKEDLKYVDLKKEVAKYMQRDPNHLIGFEFYSSSIYKCFENENSGSVFLPIGDLISTYDITFFVEVGPYDLEKDVIIPIYNSSESSEGPKRFNQMVSENLCGYPTLIKFEKSKMGDFKYIIETICKAVKNSTTIEPISISEEHEEILKTKFDTIVNKMKETKNINDKIYEDILSYKDAWVSSKMMSNWFNIGFLANRSPVVAPNDMDSGESQVDKIKIPNGRLNITNAIDLVDIAGDLFSELFNADITESKEMSLEDEPSAEINAENDSDDISLRSAEVSVDLQTGQSNLEEAVWNPKESLLDALTQNAAFTKLQRHMSNKALDEKNQLAQEGESKKQTITLDDCLKRFTETETLSQENTWYCASCKDHKQADKKIQLWDLPDILCVHLKRFKNQSLLSDKIDELVEFPINDFDLTPHIACPTNNEKYVYDLIAVDNHYGGIGGGHYTAYAKNASDGKWYYYNDSRVTEADVEDSINEAAYLLFYKKRGSDSDSKHSKLKELVDKRRAENDKFEKFLDERQKKVAILLEKHGVSIVDESDEETDTDSSEANLNKEPENDVSEKY

SEQ ID NO: 607 - protein, 175 aa, Hanseniaspora uvarum; identical to SEQ ID NO: 568

SEQ ID NO: 608 - protein, 266 aa, Hanseniaspora uvarum; identical to SEQ ID NO: 576

SEQ ID NO: 609 - protein, 283 aa, Hanseniaspora uvarum
MSLQFKSLQQLNSESINYQYNEQLSLNFYFKLCDQLLNKTFAIFDYQKWKLKLKFDDSLKDNVITDNAMEWCYILQMRYLDLVNNKLTSHSEFLVNENSVQLMMIRKQLIHRLKDEVPLIIENVEWLKEQLKRKYEDLERNKHHELLNDLEAKKIQDLKKLVKEETDFRKEAVLKYNLHHTSDEFNSNIQLSRQHQIEKDQFIQSIKRKTQIQQHDSQQKKIKYGVEDLVSSLSTRSSSGYSLPVLTPHASSDNLSLLDYNTKNNSNTIRNDENCIKYTLPKL

SEQ ID NO: 610 - protein, 564 aa, Hanseniaspora uvarum; identical to SEQ ID NO: 580

SEQ ID NO: 611 - protein, 564 aa, Hanseniaspora uvarum; identical to SEQ ID NO: 581

SEQ ID NO: 612 - protein, 337 aa, Hanseniaspora uvarum; identical to SEQ ID NO: 567

SEQ ID NO: 613 - protein, 1867 aa, Hanseniaspora occidentalis
MSYQNGEEYPEMYGQDGQQYDPNSQQYQQEFDEFGNPIGYYDEHGQFYYYQQDPSGNNNYYEPPMNPNSTENFSDFSYGQNGNMPPPNGDFYQQEQPSDSFATGPNGWDASMALAAALPNDPYPAWTADPQSPISIEEIEDIFIDLTNRFGFQRDSMRNQFDNFMTLLDSRASRMSPDQALLSLHADYIGGDSANFKKWYFAAQLDLDDEVGFRNMNLGKMSRKARKLKKKQRKQMEKDMKEQGEAYNHEEALNQLEGDNSLDAADFRWKAKMNILSPADKVRHIALYLLCWGEANQVRFTPECLCFIFKCCLDYLDSPLCQQSTKPMPEGDFLNRIITPIYKFIRSQVYEVIDGKFIKREVDHNKVIGYDDVNQLFWYPEGLAKIVLDDGTRITDLPSEERYLRLGDVTWEFVFFKTYKETRTWLHLLTNFNRIWIIHACVYWMYIAYVSPTFYTKNYQQLVNNKPLASSSWAAAALGGTLGCVIQILATICEWQFVPRKWAGAQHLSRRLWFLFGVLAINLAPVVFVFAYAGRTVESKLAHAISIIFFFVSLVTVIFFAVMPLGGLFTSYMKKSSRKYVASQTFTASFASLKGIDMWMSYLVWVAVFGAKFSESYFFLILSLKDPIRILSTTTMRCTGDYWWKAKLCVLQPKIVLGLMIATDFILFFLDTFMWYVLANTIFSIGKSFYMGISILTPWRNIFSRLPKRIYSKILATNDMEIKYKPKVLISQIWNAIVISMYREHLLAIDHVQKLLYHQVPSEIEGRRTLRAPTFFVSQDDNNFDTEFFPQGSEAERRITFFAQSLATPIPEPLPVDNMPTFTVLTPHYSEKILLSLREIIREDDQFSRVTLLEYLKQLHPVEWDCFVKDTKILAEETAAFDENEENSSAAGPDGSVVSGANGDALKSQIDDLPFYCIGFKSAAPEYTLRTRIWASLRSQTLYRTISGFMNYARAIKLLYRVENPEIVQMFGGNAEGLERELEKMARRKFKFVVSMQRLAKFKPQEMENAEFLLRAYPDLQIAYLDEEPPLNEGDEPRIYSSLIDGHCELLPNGRRRPKFRVQLSGNPILGDGKSDNQNHAVIFTRGEYLQLIDANQDNYLEECLKIRSVLAEFEELNAEQVNPYAPELRYEDQTTNHPVAIVGAREYIFSENSGVLGDVAAGKEQTFGTLFARTLSQIGGKLHYGHPDFINSIYMNTRGGISKAQKGLHLNEDIYAGMNALLRGGRIKHCEYYQCGKGRDLGFGTILNFTTKIGAGMGEQMLSREYYYLGTQLPLDRFLSFYYAHPGFHLNNLFIQLSLQMFALTLVNLNSLAHESILCEYNKNKPITDILYPLGCYNLAPAIDWVRRYTLSIFIVFFIAFIPIVIQELIERGVWKASQRFIKHLCSLSPMFEVFSGQIFSNALLSDMTYGGARYISTGRGFATSRIPFSILYSRFAGSAIYMGSRTLLMILFGSVSHWQPALLWFWASLSSLMFSPFIFNPHQFSKQDYFIDYRDFIRWLSRGNGKFHRNSWIGYVRMSRARVTGFKKKLLGDESEKSVGDVPRAHKSNVLMAEFIPCAIYAAGCFVAFTFINAQTGVRDAVTVNSAVRVIICTVGPIVINMGVLFFTLGLSCCAGPLLHMCCKKTGPVMAGFAHGIAVIIALIFFIVMWVLEGFSFARMLIGQITCIFCQRLIFIAMSSWLLTREFKNDHANSAFWTGRWYGSGMGGSAWTQPAREFTAKVIEMSEFSADFILGHLLLFCQLPFVLMPFIDKFHSMMLFWLKPSRQIRAPIYSLKQSRLRKRMVRKYSVLYAFVLILFVIVIAAPAVASSHVSDTIGSSLTGTFKNLVQPRHQDNNDTGKRLSTWKGHYLSHTPSLKTWSTKKP

SEQ ID NO: 614 - protein, 623 aa, Hanseniaspora occidentalis
MILIFLLKAYPHMTISYLEEDFVENQDTHEIKRYYYSCAVDGFSKVDKKTNKRIPNFKIKLSGNPILGDGKSDNQNHSIIFYRGEYIQVVDANQDNYIEECLKIRSVLNEFEEVDIDSIHPYKVDNDYMKDESILNSENNTPVAIIGAREYIFSENIGILGDIAAGKEQTFGTLFARTLAEIGGKLHYGHPDFLNAIFMTTRGGISKAQKGLHLNEDIYAGITATCRGGRIKHSDYFQCGKGRDLGFGSILNFTTKIGAGMGEQLLSREYYYLGTQMPIDRFLSFFYAHPGFHLNNLFISLSVQLFFLLLLNVGSLNHELISCFYNKDLPITDIQSPLGCYNLQPVLNWVTIFVFSIFIVFFIAFCPLLIQEVLERGVWKAFARFVHHLLSFSPLFEVFVCQIYSNSLISDITFGSAKYLATGRGFAITRISFAELYFKFTTSSIYTGSKIFLMLTFAVSTMWQPALLWFTITLMSLTVAPFFFNPHQFMINEFFYDYIVVLKYFINGNSHFDKYSWANCTKLQRVRYTGLDKKRLGDIQTLNGVAMFVLIFTAISVFLAIPVVLRHINLVETMVEPAIDKLPYVGKLIQPRHQNNNDTGPRAPSSVVKSTPDYEGYATVDFW

SEQ ID NO: 615 - protein, 1888 aa, Hanseniaspora occidentalis
MSYPNDGQDHQYYQQGEQDQQGQQQMDGNMNADQYYYDQQQQQQQQQQNQYYDPNGQVDQYGNPIMYDQYGNPITNNGAYDPTQQQGQYYYDQPRVNMNNGANGAYYSQPQPGYAMSSSGASTPYNGSEMQNMSSTGMYDPIAMALPNDPYPAWTADPQSPVTIEQIEDVFIDLANRFGFQRDSIRNQFDNFMTLLDSRASRMSPDQALLSLHADYIGGDTANFKKWYFAAQLDMDDQVGFRNMNLGKLSRKARKLKKKQRKEMEQQENPEAILNQLEGDNSLEAADFRWKAKMNLLTPLERVRHIALYLLCWGEANQVRFTPECLCFIFKCCLDYLESPLCQQNNTPMPEGDYLNRIITPIYKFIRSQVYEVVDGRYMKREKDHNQVIGYDDVNQLFWYPEGLTRIILNDGTRITDLPSEERYLRLGEVPWDFVFFKTYKETRTWFHLITNFNRIWIIHACVYWMYIAHNAPTLYTHNYQQLTNNQPTVAYKWATCALAGTLACIIQLIATICEYFFVPRKWAGAQHLSRRLWFLILVTAVNLGPIIFVFAYQPINVYSRLATVIAAIFFFVAVATILFFSIMPLGGLFTSYMNKSSRKYVASQTFTASFAPLKGLDMWMSYLVWFTVFGAKFSESYFFLILSLKDPIRILSTTTMRCTGEYWWGVGNYNILCKNQAKIVLGLMIATDFILFFLDTFMWYVIVNTVFSIGKSFYMGISILTPWRNIFSRLPKRIYSKILATNDMEIKYKPKVLISQIWNAIVISMYREHLLAIDHVQKLLYHQVPSEIEGKRTLRAPTFFVSQDDNNFETEFFPKDSEAERRITFFAQSLATPIPEPLPVDNMPTFTVLTPHYSEKILLSLREIIREDDQFSRVTLLEYLKQLHPIEWECFVKDTKILAEETAAYEGTANENDEQNDEEKEDALKTQIDDLPFYCIGFKSAAPEYTLRTRIWASLRSQTLYRTISGFMNYARAIKLLYRVENPEIVQMFGGNAEGLERELEKMARRKFKFVVSMQRLAKFKPYEMENAEFLLRAYPDLQVVYLDEEPPLNEGEEPRIYSSLIDGHCEILPNGRRRPKFRVQLSGNPILGDGKSDNQNHAMIFTRGEYLQLIDANQDNYLEECLKIRSVLAEFEELNVEQVNPYTPDLKYEEQSFNHPVAIVGAREYIFSENSGVLGDVAAGKEQTFGTLFARTLSQIGGKLHYGHPDFINTIYMNTRGGVSKAQKGLHLNEDIYAGMNAMLRGGRIKHCEYYQCGKGRDLGFGTILNFSTKIGAGMGEQMLSREYYYLGTQLPIDRFLSFYYAHPGFHLNNLFIQLSLQMFALTLVNLNSLAHESIICLYNRNKPITDVLHPIGCYNLAPSIDWIRRYTLSIFIVFFIAFIPIVVQELIERGVWRAIQRFVKHLCSLSPMFEVFSGQIYSNALLSDMTYGGARYISTGRGFATSRIPFSILYSRFAGSAIYMGSRSLLMILFGSVAHWQPALLWFWASLSSLMFSPFIFNPHQFSKEDFFIDYRDYIRWLSRGNSKYHRNSWIGYIRMSRSRITGFKRKLVGDESEKAVGDSPRAHRTNVFLAELIPCGLYAAGCFVAFTFINAETGVKNATPVNSVLRVVICTLGPIAVNLGVLFFTLGLSCCSGPLLNMCCKKTGPVLAGFAHGVAVIVALIFFIVMWVLEGFSFARCLMGQITVIFCQRFVFLLLSTLLLTREFKNDNANTAFWTGKWYGSGFGYMAWTQPFRELTAKVIEMSEFAADFILGHILLFCQLPFVLMPFMDKFHSMMLFWLKPSRQIRPPIYSLKQTRLRRRMVRKYSILYSMVLILFVIVIAAPAVGSRASATKNLGSSLTGMFKNLVQPRHQNHNDTGTGLSTYKGHFFTHTEKIPRYSYTKSL

SEQ ID NO: 616 - protein, 582 aa, Hanseniaspora occidentalis
MDYKGYYASKIPNSTAPPKTINRDMSFSSLAGAAHQTGGRYPVGTSRVGSQMLHQHNSIRSGMNTLANNNNNTNNNNNVQDSARSELNDGWGSSMSLSETSQNPVSDQDFSPFGGYPASSFPLLMDEKEEDDYLHNPDPEEEARLDRQRFYLDFKHMDKKSFGGFAGVVCLLVGTMCIFILLPVLTFTNVIDHVSADNVYTILSLYEYPQLSSIRTSLVDPDTPSNALSTVAKDGSYWKLVFSDEFNAVGRTFHSGDDQFWESPNIHYQATEDLEWYSPDAASTDNGTLNLRMDAYMNHDLFYRSGMVQSWNKLCFTQGKIEISAKLPNYGEVTGLWPGLWTMGNLGRPGYMGSTEGLWPYSYEACDAGITPNQSSPDGISYLPGQKLSACTCNGEDHPNQGVGRGAPEIDIIEGEVSTDLYNGVGLASQSLQVAPFDIWYMPDYDFVEIYNFSVTTMNTYCGGPFQQAVSAVTTLNTAWYEFGANAGYYQTYAIEYMNDDENGYIRWFVGEQPTWTMYSTALHPNGNIDWRYISKEPMSIIMNLGISNSWAYINWQSIFFPVTMSIDYVQSKHYCLDRRRV

SEQ ID NO: 617 - protein, 726 aa, Hanseniaspora occidentalis
MVHNNESNKRLLAGSMPASPDDSSDSQPISENNNHHHYQDRSMFESSDDDDQEEEEEEEHGEGGFTHMNPYTSNGSNNRSNLSDHKMDYKGYYASKIPNSTAPPKTINRDMSFSSLAGAAHQTGGRYPVGTSRVGSQMLHQHNSIRSGMNTLANNNNNTNNNNNVQDSARSELNDGWGSSMSLSETSQNPVSDQDFSPFGGYPASSFPLLMDEKEEDDYLHNPDPEEEARLDRQRFYLDFKHMDKKSFGGFAGVVCLLVGTMCIFILLPVLTFTNVIDHVSADNVYTILSLYEYPQLSSIRTSLVDPDTPSNALSTVAKDGSYWKLVFSDEFNAVGRTFHSGDDQFWESPNIHYQATEDLEWYSPDAASTDNGTLNLRMDAYMNHDLFYRSGMVQSWNKLCFTQGKIEISAKLPNYGEVTGLWPGLWTMGNLGRPGYMGSTEGLWPYSYEACDAGITPNQSSPDGISYLPGQKLSACTCNGEDHPNQGVGRGAPEIDIIEGEVSTDLYNGVGLASQSLQVAPFDIWYMPDYDFVEIYNFSVTTMNTYCGGPFQQAVSAVTTLNTAWYEFGANAGYYQTYAIEYMNDDENGYIRWFVGEQPTWTMYSTALHPNGNIDWRYISKEPMSIIMNLGISNSWAYINWQSIFFPVTMSIDYVRIYQPNDSVSITCDPEDFPTYDYIQNHLAVYENPNITAWTDAGFDWPTNMLTGDCSSDKCKKNSDGSITC

SEQ ID NO: 618 - protein, 622 aa, Hanseniaspora occidentalis
MSHQDDNIFADEHENSGHNEFINDQNDSNVSLNDRHNNNPQSRNGIGSSQNNSSSSVNSSDEFLKPQSMDILAQKGSTLKMRDLSVATGLNEVLNNNSAVGDEDFSPFGGYPASSFPLLMDEEEDDDYLHNPDPEEEARLDKQRFKLDFQNMDKKSFGGWSALIVLFLGIIAVFIVLPVLTYSNVIDYTKSTDVIELLSPYRYPQLSAIRTSLVDPDTPSDALTTKSTKGDTWELVFSDEFNANGRTFYSGDDQFWEAPDIHYAATQDLEWYDPDASVVVNGSLTFTMDAYENHNLFYRSGMVQSWNKLCFSQGRIEISANLPNYGEVIGLWPGLWTMGNLGRPGYLASTEGTWPYSYEACDAGITPNQSSIDGISYLPGQKLNSCTCKGESHPNAGTGRGAPEIDILEAETDTYLGSGVGLASQSFQVAPFDIWYMPDYKFVEVYNFSTTTMNTYCGGPFQQAISAVTTLNNNWYQFGPGSGQYQTFGYEFMSDDNEGYITWIVGDKPTWTMNSYALHPNGNINWRYVPKEPMSIIMNLGISNSWAYINWQSIFFPVTMSIDHVRIYQPSNAQSITCDPEDYPTYDYIEAHKIAYYNNNMTSWEDCGYSWPKNSLMNGCSV

SEQ ID NO: 619 - protein, 938 aa, Hanseniaspora occidentalis
MKNPFIDQRFDNEFDNSENNFASKERSVYQTPTKSNKYPSFGQHATPNLNSPSKAALKYSPRRKANNNHIIPIQGNETIDLSPGKHISRSEAVKLESPTRDAPVLYNLDDDSDDEYESHFHNSYDSPSKIPPPVNEVDLSDVGSYSAAGSYKERMSSYSSYTSSNFSGDTFKQTRFNTNHHDLQYIRRANSTVRPKVSKNKAGKILTLDNPIPSGILDVLPNKSSPEFTEMRYTACTSDPDSFVADGYSLRFSDMNRECEIAVCITMYNEDKYSLARTLHSILKNVTELCTREKSRTWGRKSWKKVQIIIVSDGRSKINRGSLDYLISLGVYQEDMAKSTVNGIPVQAHLFELTTQISIDDNLNYVSDVVPCQILFCLKEENKKKINSHRWLFNAFCPILDPNTITLVDVGTKLGSNSLYHMWKQFDMDSNVAGVAGQIIAMKGKYGRKLINPLVASQNFEYKMSNILDKPLESTFGYISVLPGALSSYRYRALKNNEDGTGPLHSYFLGETQDNGATDVFTANMYLAEDRILCWELIAKKDCKWVLKYVKEATGETDVPEEIPEFISQRRRWLNGAMFADLYSKLHFYQIFRTRHSKARKTGLLVLFFYQFVQFWFSWFSIANFYLTFYFLAGSMVQLIHNGIYLFIFFKYLLISTICGLFIISMGNRPQGAIHLFIISMVILSVCTLFALITGLYFAFNTLKDNEESHGMFVKIVVSLFSTYGLYAYSSIIYLDPWHLFHSFIQYLVMVPTFICTLQIFALCNTHDVSWGTKGSTKEEKPKSEAVITAGPDGKTVITGTEWPQDIDRKYIEVRNRLKETETFDIKVDQNQKNTDYYRDVRTRIVTFWMLSNLILCMIITQIYGPEDMYKNKYLVFILISVASLALFRAFFSTLFLVMKYIRSIISFINKYQRNGGVNIELPKWMGKFKKSSKTTEA

SEQ ID NO: 620 - protein, 588 aa, Hanseniaspora occidentalis
MTTQEFLNSKIGSPNSTIEQAQTASDWFDKTLDPSWVNKNALKQPKPDYMPFGFPLIHNICFVTCYSEDENGLRTTFDSLAVTDYPNTHKLIMCVCDGIIKGSGNDKTTPDIVLGMMENFVIVPDLVKPYSYIAVAARSKRHNMAKIYSGYYKFDKQTMPIEYHQKVPMVCIVKCGTESEKTDPKPGNRGKRDSQVILMSFLQKLFFEERMSVFEYQLLKNIWCLTGLMCTYYETVLMVDADTKVYPDSLKHMIAEMCKDPEIMGLCGETKIANKTASWVSAIQVFEYFVSHHQTKGFESVFGSVTCLPGCFSMYRIKSPKGSDGYWVPILANPDIVEQYSDNVTNTLHKKNLLLLGEDRYLSSLMLKTFPKRKQVFVPKAACKTLVPDKFSVLLSQRRRWINSTVHNLMELVFINDLCGVFCFSMQFVILIELLGAIILPLAISFTIYIIFYSIFSYPTPVLTLILLAIILGLPAVLIVVTASRPSYLIWMVIYILALPIWNFVLPSYAFWKFDDFSWGETRCVEEQESEENSDNPDGAVVGNNTSKILNVGGKTELNKNSDNFDYSKIEMKTWRDFARKDLNNDSN

SEQ ID NO: 621 - protein, 949 aa, Hanseniaspora occidentalis
MKNPFLDTRTALRSPERQNYAQDNSSEVSSWGPTNGYPDFTPPASPSKAALKYSPRRKHILPINTHIPRHEATRMESPKRNGRVVINIDDDSDEELPYHGHDQEHSDFYDIQQSPSKKRPYPPRSENNVTFEDNFNEKDEYNEVDVVDLASEVSTTYDRQVSTSDLSSVAKSFDEASTIYSGDTFQQTKFHQHHPELKYIRRGNSTVRPKPSKKKANKILTLDNPIPRGILDVLPNRSSPEFTEMRYTACTTDPNDFVSEGYNLRFADMNRECQIAVCVTMYNEDKYCLARTMHSIMRNVSYLCKREKSKVWGPNGWKKIQVVIVSDGRSKINRGSLDYLISLGVYQEDMAKNTVNGQPVKAHIFELTTQISIDDTLNYVSKDIVPVQIVFCLKEENQKKINSHRWLLNGFCPILDPTVVTLVDVGTRLNDSALYHMWKAFDRDSNVAGVAGQIKAMKGKYGSKLINPLVASQNFEYKMSNILDKPLESCFGYISVLPGALSAYRYRALQNHEDGTGPLHSYFLGEKQDGAESDVFTANMYLAEDRILCWELVAKRNSRWILKYVKEATGETDVPEEAPEFISQRRRWLNGAMFAALYSQLHFYQIWNTRHSRTRKFFFHIEFLYQFIQFLFSWFSIGNFFLTFYFLAGSMTILIKHGTALFIFFKYLLISTLCTLFIISMGNRPQGANHLFMISMVILSICSTFAIVTGLYYSISTLKKNDETRLSFLRIVVSMLSTYGLYVFTSFMYLDPWHIFHSSVQYFLMIPTYICTLQIFAFCNTHDVSWGTKGSTKEEKPKSEAVVKAGPDGKTVITGTEWPQDIDKKYIEIRNRLKEDEIVEKKVDAVEKNNDYYRDIRTRIVTLWMLSNLILCMVITQIYGPKDMYKNKYLVFVLISVAALALFRAFFSILFLFMQYFRSIVSFKHKFERNGSGLRGSFNITKWFKKSEK

SEQ ID NO: 622 - protein, 713 aa, Hanseniaspora occidentalis
MCGIFGYCNYMVERSRKDILETLTEGLSKLEYRGYDSTGVAVDGDTDGTSLIIKNPGKVSQLKEKINNTLNFDEYNPEYINHVGIAHTRWATHGEPSVSNAHPQRSDINGEFVVVHNGIITNYRELKTLLLNKGFKFESDTDTECIAKLFKLFYDTNLENGIEIDFNALTKEVLSELDGAYGLLCRSSHYPGEVICTRKGSPLLIGVKSEKNLKVDFVDVEFVDDSSDDQITLNDTKLNNPHKQKADEEKVFFAPITNNNPNLRYSQSRAFLSEDGIPIPIEFFISSDASSVVKHTKKVLFLEDNDVAHIYDGELHIHRFKPREDGDKITRPIQTLELELAQIMKGDYNHFMQKEIFEQPESTLNTMRGRLDFQNKSVKLGGLTNWLPTIKRARRLLMIACGTSYHSCLAVRQMFEELSEIPVSIELASDFLDRKAPVFRDDVCIFVSQSGETADSMQALKFCLERGALTIGIVNTVGSSISRSTHCGVHINAGPEIGVASTKAYTSQYIALAMLALSLSDDSLSSLGKRQEIISNLQKIPEQIKQILQLEPQIKSICKKLQGEQSLLLLGRGYQYACALEGALKIKEISYMHSEGILAGELKHGVLALVDENLPIIALGTRDSLFPKVVSSIEQVIARKGKPIVICNKDDEYWLSKKADNPSIELIEVPGTSDCLQGLLNIIPLQLMSYWLAVNQGFDVDFPRNLAKSVTVE

SEQ ID NO: 623 - protein, 274 aa, Hanseniaspora occidentalis
MSAAPTSRESSVYLAKLAEQAERYEEMVENMKNVASSGEELSVEERNLLSVAYKNVIGARRASWRIVSSIEQKEEQKQQHLQQQQHLQQNTTTTTTTTTRGKHIVDSTQVTLIRDYRSKIENELAKICYDILAVLDNHLIPSASSGESKVFYYKMKGDYHRYLAEFSNGDVREKTTEDSLQSYTKASEIATVELPPTHPIRLGLALNFSVFYYEIQNAPDKACHLAKQAFDDAIAELDTLSEESYKDSTLIMQLLRDNLTLWTSDIIDDGADEE

SEQ ID NO: 624 - protein, 268 aa, Hanseniaspora occidentalis
MSEFNRENYVFLAKLAEQAERYEEMVENMKKVASASTEGKELTVEERNLLSVAYKNVIGARRASWRIVSSIEQKEEQKLEQFLQQQKDLDGSNNAASTEEDKQQIALISKYRNGIEVELAKICDDILNVLDSHLIPSASSGESKVFYYKMKGDYHRYLAEFSSGDVKNKTTDDSLKAYERASEIATAQLPPTHPIRLGLALNFSVFYYEIQNSPDKACHLAKQAFDDAIAELDTLSEESYKDSTLIMQLLKDNLTLWTSDLADDVDDE

SEQ ID NO: 625 - protein, 321 aa, Hanseniaspora occidentalis
MVATNSIKLLAPDVHRGLAELVAQRLGLKLTECKLKRDPTGEVSFSIGESVRDQDIYIITQIGSGIVNDRVLELLIMINASKTASARRITAVIPNFPYARQDRKDKSRAPITAKLMADMLTTAGCDHVITMDLHASQIQGFFDIPVDNLYAEPSVVRYIKENVSFDESIIISPDAGGAKRAAGLADRLDLNFALIHKERAKANEVSRMVLVGDVTDKVCIIVDDMADTCGTLAKAADVLLENGAKKVMAIVTHGVLSGNAINNINNSRLDRVVCTNTVPFEEKMSSCPKLDVIDVSGVLAESIRRLHNGESISYLFKNYPL

SEQ ID NO: 626 - protein, 319 aa, Hanseniaspora occidentalis
MSSNSIKVLVGNSHPELAEKICKKLGLPLAKINVYQYSNKETSVTIGESIRDEDVYIIQTGTGQEEINDFLMELLIMIHACRTASARRITAVIPSFPYARQDKKDKSRAPITAKLVANLITTAGADHVITMDLHASQIQGFFRIPVDNLYAEPCVLNYIRTKTDFDNAILVSPDAGGAKRVASLADKLDLNFALIHKERQKANEISRMVLVGDVAGKSCLLIDDMADTCGTLCKAAEVLLADGGAKEVIAIVTHGIFSGNAFERLANSKLSRVVCTNTVPVNSDLAILDQIDISPTLAEAIRRLHNGESVSYLFTNAPI

SEQ ID NO: 627 - protein, 323 aa, Hanseniaspora occidentalis
MVATNSIKLLAPDIHRNLAELVSKRLSMPLTPCKLKRDSNNEITFSIGESVRDQDIFIITQIGSGNVNNKVLELLIMINACKTASARRITAIIPNFPYARQDRKDKSRAPITAKLVADMLTTSGCDHVITMDLHASQIQGFFDIPVDNLYAEPSVIRYIQNNYMKNQQDIIMISPDAGGAKRAASLADRLDLNFALIHKERAKANEVSRMVLVGDVTNKICIIVDDMADTCGTLAKAAEVLLEHGASKVLAIVTHGLLSGNAINNINNSKLDKVVCTNTVPFEEKMEICSKLDTIDVSGVLAEAIRRLHNGESISYLFKNYPL

SEQ ID NO: 628 - protein, 195 aa, Hanseniaspora occidentalis
MDLHASQIQGFFSIPVDNLYAEPSTLKYIKDNYDVNQKDLILVSPDAGGAKRVASLADKLDLQFALLHKERAVANEVSRMVLVGDVQGKNCILIDDMADTCGTLCKAAEILKENGAKQTIAMVTHAILSNNALERVKNSELKKLVFTNTNPISEKDKEDYKVCIDVIDISGTLAEAIRRLHNGESISYLFTHVPL

SEQ ID NO: 629 - protein, 720 aa, Hanseniaspora occidentalis
MCGIFGYCNYMVEKTRGEVIDVLVEGLTRLEYRGYDSTGLAIDGDNADETLILKQAGKVSALKEEIKRVNPDRSTPLVNHVGIAHTRWATHGTPTQANCHPQRSDVNGEFVIVHNGIITNFRELKTLLLNKGFTFESDTDTECIAKLFKHLYDTNLKMGFELDFNELTKQVLSELEGSYGLLCRSSHYPGEVIATRNGSPLLIGVKSKKSLKVDFVDVEFPGNAEKPESILKPTNSNSPHGSASSSSTNLQKEEEKFLFSPLANNETALRYSQSRAFLSEDGVPMPVEFFVSSDASSVIKHTKKVLFLEDNDIAHIYDGELHIHRLKKQQDGEKTTRPIQTLELELAQIMKGPYSHFMQKEIFEQPESTFNTMRGRVDFENNSIKLGGLTNWLTTIRRARRLIMIACGTSYHSCLATRAMFEELSEIPVSIELASDFLDRKTPIFRDDVCIFVSQSGETADTMLALKYCLDRGALTIGIVNSVGSSISRSTHCGVHINAGPEIGVASTKAYTSQYIALVMLALSLSDDRVSVVDRRREIIQGLKEIPHQIKKVLQMETQIKALCENELKDQKSLLLLGRGYQYASALEGALKIKEISYMHSEGVLAGELKHGVLALVDEDLPIIAFGTRDSLFPKVVSSIEQVTARKGKPIIICNENDEVWTSKQKSIEGLVLLEVPQTVDCLQGLVNIVPLQLISYWLAVNKGFDVDFPRNLAKSVTVE

SEQ ID NO: 630 - protein, 323 aa, Hanseniaspora uvarum; identical to SEQ ID NO: 627

SEQ ID NO: 631 - protein, 1867 aa, Hanseniaspora uvarum
MSYQNGEEYPEMYGQDGQQYDPNSQQYQQEFDEFGNPIGYYDEHGQFYYYQQDPSGNNNYYEPPMNPNSTENFSDFSYGQNGNMPPPNGDFYQQEQPSDSFATGPNGWDASMALAAALPNDPYPAWTADPQSPISIEEIEDIFIDLTNRFGFQRDSMRNQFDNFMTLLDSRASRMSPDQALLSLHADYIGGDSANFKKWYFAAQLDLDDEVGFRNMNLGKMSRKARKLKKKQRKQMEKDMKEQGEAYNHEEALNQLEGDNSLDAADFRWKAKMNILSPADKVRHIALYLLCWGEANQVRFTPECLCFIFKCCLDYLDSPLCQQSTKPMPEGDFLNRIITPIYKFIRSQVYEVIDGKFIKREVDHNKVIGYDDVNQLFWYPEGLAKIVLDDGTRITDLPSEERYLRLGDVTWEFVFFKTYKETRTWLHLITNFNRIWIIHACVYWMYIAYVSPTFYTKNYQQLVNNKPLASSSWAAAALGGTLGCVIQILATICEWQFVPRKWAGAQHLSRRLWFLFGVLAINLAPVVFVFAYAGRTVESKLAHAISIIFFFVSVVTVIFFAVMPLGGLFTSYMKKSSRKYVASQTFTASFASLKGIDMWMSYLVWVAVFGAKFSESYFFLILSLKDPIRILSTTTMRCTGDYWWKAKLCVLQPKIVLGLMIATDFILFFLDTFMWYVLANTIFSIGKSFYMGISILTPWRNIFSRLPKRIYSKILATNDMEIKYKPKVLISQIWNAIVISMYREHLLAIDHVQKLLYHQVPSEIEGRRTLRAPTFFVSQDDNNFDTEFFPQGSEAERRITFFAQSLATPIPEPLPVDNMPTFTVLTPHYSEKILLSLREIIREDDQFSRVTLLEYLKQLHPVEWDCFVKDTKILAEETAAFDENEENSSAAGPDGSVVSGANGDALKSQIDDLPFYCIGFKSAAPEYTLRTRIWASLRSQTLYRTISGFMNYARAIKLLYRVENPEIVQMFGGNAEGLERELEKMARRKFKFVVSMQRLAKFKPQEMENAEFLLRAYPDLQIAYLDEEPPLNEGDEPRIYSSLIDGHCELLPNGRRRPKFRVQLSGNPILGDGKSDNQNHAIIFTRGEYLQLIDANQDNYLEECLKIRSVLAEFEELNAEQVNPYAPELRYEDQTTNHPVAIVGAREYIFSENSGVLGDVAAGKEQTFGTLFARTLSQIGGKLHYGHPDFINSIYMNTRGGISKAQKGLHLNEDIYAGMNALLRGGRIKHCEYYQCGKGRDLGFGTILNFTTKIGAGMGEQMLSREYYYLGTQLPLDRFLSFYYAHPGFHLNNLFIQLSLQMFALTLVNLNSLAHESILCEYNKNKPITDILYPLGCYNLAPAIDWVRRYTLSIFIVFFIAFIPIVIQELIERGVWKASQRFIKHLCSLSPMFEVFSGQIFSNALLSDMTYGGARYISTGRGFATSRIPFSILYSRFAGSAIYMGSRTLLMILFGSVSHWQPALLWFWASLSSLMFSPFIFNPHQFSKQDYFIDYRDFIRWLSRGNGKFHRNSWIGYVRMSRARVTGFKKKLLGDESEKSVGDVPRAHKSNVLMAEFIPCAIYAAGCFVAFTFINAQTGVRDAVTVNSAVRVIICTVGPIVINMGVLFFTLGLSCCAGPLLHMCCKKTGPVMAGFAHGIAVIIALIFFIVMWVLEGFSFARMLIGQITCIFCQRLIFIAMSSWLLTREFKNDHANSAFWTGRWYGSGMGGSAWTQPAREFTAKVIEMSEFSADFILGHLLLFCQLPFVLMPFIDKFHSMMLFWLKPSRQIRAPIYSLKQSRLRKRMVRKYSVLYAFVLILFVIVIAAPAVASSHVSDTIGSSLTGTFKNLVQPRHQDNNDTGKRLSTWKGHYLSHTPSLKTWSTKKP

SEQ ID NO: 632 - protein, 268 aa, Hanseniaspora uvarum; identical to SEQ ID NO: 624

SEQ ID NO: 633 - protein, 493 aa, Clostridium thiosulfatireducens
MNIKLQEKYQLYIDGQWREASDGGVLKTYNPATGEFLAEIADATEKDVDDAVKAAERAFITWGKTTVAERADVLNKIADTIDDNAEYLATIETMDNGKPIRETTGADIPLAADHFRYFAGVIRSDEGSSTMLDENTLNIILREPIGIVGQIVPWNFPFLMAAWKLAPVLAAGDVSVFKPSSTTSLSVLELMRLIENIVPKGVINIVTGRGSKSGEYLQHHKGLNKLAFTGSTEVGRKIGLSAAENIIPATLELGGKSANIFFKDADLDIALEGLQLGILFNQGQVCSAGSRIFVQEDFYDEFIEKAVKAFEKVKVGNPLDNNTQMGAQVSEAQLNKILSYVEIGKKEGAKVATGGERYTGGDAAKGYFMKPTLLVDVTNDMRVAREEIFGPVGVVIKFKTIDEVIAMANDSEYGLGGGVFTRDINKAIQVARGIRTGRVWVNTYNSFPAGAPFGGYKNSGIGRETHKSVLDAYTQMKNIMVNLSEKPSGMYVK

SEQ ID NO: 634 - protein, 473 aa, Bacillus velezensis
MAYQDFREFLAALEKEGQLLTVNEEVKPEPDLGAAARAASNLGDKTPALLFNNIYGHHHAQVALNVIGSWPNHAMMLGMPKDTPVKEQFFEFAKRYDAFPMPVKREETAPFHENEITEDINLFDILPLFRINQGDGGYYLDKACVISRDLEDPDNFGKQNVGIYRMQVKGKDRLGIQPVPQHDIAIHLRQAEERGVNLPVTIALGCEPVITTAASTPLLYDQSEYEMAGAIQGEPYRIVKSKLSDLDIPWGAEVVLEGEILAGEREYEGPFGEFTGHYSGGRSMPVIKIKRVYHRNNPIFEHLYLGMPWTECDYMIGINTCVPLYQQLKEAYPNEIVAVNAMYTHGLIAIISTKTRYGGFAKAVGMRALTTPHGLGYCKMVIVVDEDVDPFNLPQVMWALSTKMHPKHDAVIIPDLSVLPLDPGSDPAGMTHKMILDATTPVAPETRGHYSQPLDSPLTTKEWEQKLMDLMNQ

SEQ ID NO: 635 - protein, 445 aa, Bacillus velezensis
MDQHIKADIKRVFALQKKNQKTLRASTAGQRREKLQRFLDAVTAHEEEIIEAIRRDVRKPYHEVKRAETQGTIKAIKDNMNNLDTWMAPKRVGSSVSPDADGVLMYEPKGLTLILGPWNYPFMLTMAPLAAAIAAGNSAIVKLSDFTMETSHIAATVIREAFHEEEVAIFEGEVDVATELLDQPFDHIFFTGSTNVGKIVMTAAAKHLSSVTLELGGKSPTIIDSGYDLMDAAKKIAVGKFVNAGQTCIAPDYLLMKEDVQDTFTDLLQTIVNAGFMEDDHTVDRNKFTQIVNDRNFNRVKALYDDAIEKGAKTAFGGVFDAHDRTISPTVLTNVTPDMKIMQEEIFAPILPIMNYEDISEAVDYITERDKPLALYVFSHNQELIDYVLQHTTSGNASVNDVIVHFTDVNLPFGGVNTSGIGSYHGVYGFKEFSHEKGVFIQASK

SEQ ID NO: 636 - protein, 403 aa, Exiguobacterium acetylicum
MAKIMAVNAGSSSLKFQLLEMPNETMIAVGLVERVGKDDAIFTIKYGEGQKYTDVLPLATHKEAVELSLEKLMEFGIISSYDEIKGVGHRVLHGKEKYADSVLITDEVMHDIESYTELGPLHIPPNLIGIRAFQALLPEVPQVAVFDTAFHQTMPEENFLYSLPYDYYTEYGIRKYGFHGTSHKYVTERASELLGRPLKDLRLISCHLGSGASIAAVSGGESIDTTMGFTPLEGITMGTRSGSLDPALIPFLMEKTGKTAEDVLNVMNKESGIYGLSGLSSDLRDVQTAAKEGNHRSEMALRIFANRIHGYIGQYAAEMNGVDAIIFTAGVGENSDSIRERVLRGLEFMGVYWDPSLNTGARGEELFINYPHSPVKVIIIPTNEELMIARDTVRVGGLVAQNA

SEQ ID NO: 637 - protein, 328 aa, Exiguobacterium acetylicum
MQLFDMLEQKIKAQQPKIVFPEGIDARVLGAAVRLKKDGLVTPVVIGPRVQIEETATANGIDVTGLDTIDPASYAGIDELVASFVERRKGKATEEQARAVILKDVNTFGTMLVHTGQAEGLVSGAMHATGDTVRPALQIIKMQEGYKKTSGVFIMVRDEEQYVFADCAINIAPDANDLAENAIASAKTAKTFGIDPKVALLSFSTKGSAKSPETERVVEATRIAKERAPELAIDGELQFDAAFVPSVAKSKAPESDVAGQANVFIFPSLEAGNIGYKIAQRLGGFEAIGPILQGLNKPVNDLSRGCNEEDVYKLAIITAAQAVEERQA

SEQ ID NO: 638 - protein, 325 aa, Lactobacillus paracasei
MDLFESLKDKINGKNLRIVFPEGEDPRVLGAAVRLAADGLIQAIVLGNPDKIQTLAAAKSWDLSKLTVRDPANDDIHAKMVAAFVERRKGKATPEQAEKIVQDANYFGTMLVYMKEADGMVSGAVHSTADTVRPALQIIKTRPGVHLVSGAFIMQRGRDERYLFADNAINIDPDADQLAEIAVESAKTAALFDIEPPRVALLSFSTKGSAKGLQVDKVVEATKKAHELAPDLALDGELQFDAAFVPSVAKQKAPDSKVAGEANVFIFPELQSGNIGYKIAQRFGGFEAIGPILQGLNQPVSDLSRGANEEDVYKLAIITAAQTLL

SEQ ID NO: 639 - protein, 338 aa, Weissella cibaria
MAQKPGTEALANADTVLFVGSNFPFAEVANSFKNTKHFMQIDIDTAKLGKRHKADVALLADAKVALGALLDVLPERVETGWYKANAQNVVNWRAYLNKLETKTEGDLQLYQVYNQINRVKTDDAIFSLDVGDVNQTSNRHLHLTDTNRHFTSNLFATMGVGIPGAIAARLNNADKQVWSLSGDGGAAMVMQDLVTQVQYKLPVINVVFSNNQFGFIKDEQEDTNKGYIGVEFNDIDFSKVAEAVGMQGFRVTKISELADVFDQAVALGKTEPVLIDARISGDRPIPTEALQLDPTTNTPEEIAAFKARFEAEDLQPLRDFLVANDVVVGDANVENGGF

SEQ ID NO: 640 - protein, 260 aa, Weissella cibaria
MSEQAEMIPAGIAMVKVLEAWGVDHLYGIPGGSFNSTMDALLAEKDNIQYIQVRHEEVGAMAAAADAKLTGKIGVAFGSAGPGGTHLLNGLYDAREDHVPVLALIGQFGTSGMNMDTFQEMNENPIYADVSVYNVTAVTAQSLPHLIDEAIRRAYAQHGVAVVQIPVDLPWQDIPAESWYASANSYQQPLLPQPDPDKVKQIATLLEQAERPVIYFGIGTRGAGQTLQDISNKFKIPLISTYPAKAIVPDDFPLYLGSTL

SEQ ID NO: 641 - protein, 398 aa, Clostridium thiosulfatireducens
MKVLVINCGSSSLKYQLINMETEESLAQGLVERIGIEGSILTQKVPGRDKYIIEQPMADHKDAIKLVLDALVDGNHGVISSMDEISAVGHRVVHGGEKYSESVVIDDTVMESLEECVKLAPLHNPANIIGINACKSLMPNTPMVAVFDTAFHQTMPKTAYMYPLPYELYTKYGIRKYGFHGTSHKYVSAECAKLMGKDIKDVKIITCHLGNGASLAAIKDGHCVDTSMGFTPLEGIAMGTRCGNIDPAIVTFLMNEGKMTAKEVDNLMNKQSGVLGLSGVSSDFRDIEDAAKEGNERAILALNVYNYRVREMIGAYAAAMGGVDAVVFTAGLGENAIETRAEICKGLEFLGIEIDDAKNNVRGKSTEVSKDGAKVKVFVIPTNEELVIARDTKELTSK

SEQ ID NO: 642 - protein, 333 aa, Clostridium thiosulfatireducens
MSFTQKVWKLAQQEMKTIVLPEGEEERNLKASEIIHKNKIAKVILVGSQDKIKENAKNFGVNIEGIEIVDPEVSPKTAEYAKAFYELRKNKGVTEEKALQTVKDPVYYGTMMVKLEDAHGLVSGAVHSTGDLLRPGLQIIKTAPGIKVVSSFFVMELENSSYGDNGTLLFGDCAVNPNPTSEELASIAISTAENAKTLCGIDPKVAMLSFSTMGSAKHENVNKVVEATRMAKEARPDLAIDGELQLDAAIVDKVASLKAPNSTVAGNSNVLIFPDLQAGNIGYKLVQRFAGAEAIGPVCQGFAKPINDLSRGCSVDDIVNVVAITAVQAQNSK

SEQ ID NO: 643 - protein, 323 aa, Bacillus velezensis
MADLFTKVQEKVAGKDVKIVFPEGLDERILVAVNNLAGNKVLKPIVVGNKEDIQAKAKELNLTLDGVDIFDPHTYEGMEELVQAFVERRKGKATEEQARKALLDENYFGTMLVYKGLADGLVSGAAHSTADTVRPALQIIKTKEGVKKTSGVFIMARGDEQYVFADCAINIAPDSQDLAEIAIESANTAQMFDIDPRVAMLSFSTKGSAKSDETDKVAEAVKIAKEKAPELTLDGEFQFDAAFVPSVAEKKAPDSDIKGDANVFVFPSLEAGNIGYKIAQRLGGFEAVGPILQGLNMPVNDLSRGCNAEDVYNLALITAAQAL

SEQ ID NO: 644 - protein, 395 aa, Bacillus velezensis
MSKIIAINAGSSSLKFQLFEMPSEKVLTKGLVERIGIADSVFTISVNGEKNTEVTDIPDHAVAVKMLLHKLTEFGIIKDLNEIDGIGHRVVHGGEKFSDSVLLTDETIREIEEISELAPLHNPANIVGIKAFKEVLPNVPAVAVFDTAFHQTMPEQSYLYSLPYEYYEKYGIRKYGFHGTSHKYVTQRAAELLGRPLEDLRLISCHLGNGASIAAVEGGKSIDTSMGFTPLAGVAMGTRSGNIDPALIPYIMEKTDQTADEVLNTLNKKSGLLGVSGFSSDLRDIVEASKEGNERAETALEVFASRIHKYIGSYAARMSGVDAIIFTAGIGENSVEVRERVLRGLEFMGVYWDPALNNVRGEEAFISYPHSPVKVMIIPTDEEVMIARDVVRLAQ

SEQ ID NO: 645 - protein, 398 aa, Enterococcus gilvus
MSKTIAINAGSSSLKWQLYQMPEESVIAKGIVERIGLNDSIFTIKYGEGEKFEQVLDIKDHEVAVQMLLDQLLELKIIASFDEITGVGHRVVAGGEYFKDSVLIDDDVLAKIEELSEFAPLHNPANAMGIKAFRHILPNVTSVAVFDTSFHATMPAVNYLYSIPKEYYDKYAARKYGFHGTSHRYVSERAAELLGKPIEETKIITAHIGNGGSVTAVEGGKSVDTSMGFTPLAGLTMGTRAGDIDASLLPYLMEKAGIKDINEMIDVLNKKSGVLGLTGISSDMRDIENGAEEGNADAILALEIYCDRIRKYIAQYISVMNGVDAIVFTAGVGENADPVRSMVLENMTWFGIEIDEEINKSIHGKEAELSTENSRVKVFVIPTDEEVMIARDVERLSK

SEQ ID NO: 646 - protein, 326 aa, Enterococcus gilvus
MELFDSLKFKIIRRNIKVAFPEATDARILGAASRLKAEELIEPVLIGNLAEIEKAAGARGIALSNFTIIDPDHFDRWDEMVESFVERRKGKVSKEDAEKILKDENYFGTMLTYMGITDGMVSGAIHSTGDTVRPALQIIKTKPGVSRTSGAFLMVRGRDQEKYLFSDCAINVNPTAQELAEIAVESAKTAELFDIEPKVAMMSFSTKGSAKSPEVEKVAEATTIAQELAPEFLIDGELQFDAAYIPGVAQLKAPESQVAGQATVFVFPELQSGNIGYKIAQRFGGFEAIGPVLQGLNKPVSDLSRGCNEEDVYKLSIITAAQSLMN

SEQ ID NO: 647 - protein, 327 aa, Lactobacillus harbinensis
MDLFASLQQKIQGKDIRIVFPEGTEPRIIGAAARLNAERSVTPILLGEPAAIRAAAEKAGFTLGNIQILDPNDYADFDSLVTSFVDRRKGKNTKEQAETMLRDPNYFGTMLVYTGLADGMVSGAVHSTGETVRPALQIIKTKPGVSRTSGAFIMQRGRDAERYIFADCAINIDPNAQELAEIAVASAQTAKLFDIEPHVAMLSFSTKGSAKAPQVDKVAEATQIAHELTPDLDLDGELQFDAAFVPSVGEQKAPGSTVAGKATVFIFPDLQSGNIGYKIAQRFGHFEAIGPILQGLNKPVSDLSRGSNEEDVYKLAIITAAQTLDQD

SEQ ID NO: 648 - protein, 326 aa, Lactococcus lactis
MELFESLKQKISGKGLKIVFPEGTDARILGAANRLNADGLITPVFIGNVKEVTETLISRGINPEGFEIYDPENCGRFETMTETFVERRKGKVTEEQAKELLKDPNYFGTMLVYMKIADGMVSGAIHSTADTVRPALQIIKTKPGVKSVSGAFIMVRGRDDNEKYIFGDCAINIKPDAPTLADIAVASAETAALFDIDPKVAMLSFSTKGSGKSEDVDKVVEATKLVKEDYPEIEIDGELQFDAAFVPAVARQKAPDSTVAGRANVFIFPDIQSGNIGYKIAQRLGNFEAIGPILQGLNAPVSDLSRGSNEEDVYKLAIITAAQALK

SEQ ID NO: 649 - protein, 399 aa, Pediococcus pentosaceus
MEKTIAINAGSSTLKFKLFEMPEERVISSGTVDRIGISGSNFTIKTTDGKKVEIDQPIKNHEEAVNLLLKELLKLDIIKDYSEITGVGHRVVAGGEIFQDSALIDDKVLKQIEDLKEYAPLHNPANATGIRAFKKVLPDITSVAVFDTSFHETLPEKNYLYSIPYEYYEKYGARKYGAHGTSHQYVAGRAAKMMGKPLEELKIITLHLGAGSSITAIKDGKSFDTSMGFTPLAGITMATRSGDIDASLVVYLMQKLNITNPEDILTILNKKSGLLGLSGMSPDLRDIIDAAEKGEHRAQMAIDIFVNNIVKYIGSYATEMGGLDGIVFTAGIGENSVPMREKITSKLGIFNVKLDQALNEKRGERFISAEDSAVQVMVIPTDEELAIARDVEKFKKMGD

SEQ ID NO: 650 - protein, 396 aa, Lactobacillus brevis
MGKSLAVNAGSSTLKFKLFQMPEEEVIAEGAIDRISLGNSLVEIKYGDGQKYETHQDINDHNEAIQLMLDQLTELKIITNFDEITGVGHRVVAGGQEFKDSAIIDDDVLQKIEDLAEYAPLHNPAAAMGIKAFKKILPNVVSVAVFDTSFHTSMPQENYMYAIPYEYYEKYGARKYGAHGTSHRYVAHRAAEMLGKPLEDLKLITMHLGAGGSITAIKDGKSYDTSMGFTPLAGIEMATRSGDIDASLVAYLMEKLNIEKPNDMINILNKKSGLVGVSGVSADMRDLEKVQAKNPRAKLARDMFINRIVRYVGAYLAELGGADAIVFTAGVGENDITIRQEVADKLAYFGIGVDSEKNNIRGVERDLSKAGSKIKTLLIPTDEELMIVRDIERLRK

SEQ ID NO: 651 - protein, 332 aa, Exiguobacterium acetylicum
MATLVVGGAGYIGSHAVYQLIDAGKDVVVIDHLQSGHREAVHPQARLYEGDIRDRAFLDRVFTEETIEQVVHFAAFSLVGESMTEPLRYFDNNVYGTQVLLEAMTAHDIKQIVFSSTAATYGEQEQMPILETAETRPTNAYGETKLMMEKMMRWSEQAYGLRYVALRYFNVAGARATGEIGEDHTPETHLIPLVLEVANRQRAEISIYGDDYPTPDGTCIRDYIHVEDLIDAHIRALDYLANGNDSTVFNLGSSQGFSVREIIEAARRVTGHPIPERIIERRAGDPSILIAGSAKAKEVLGWTPQRTDIETIIRDAWNWHAHNPEGYRTSVR

SEQ ID NO: 652 - protein, 339 aa, Lactobacillus brevis
MKNNQLPRLTIVVPCYNEEPVLPNSAPILQTLLQHLIDNQQITTDSKLLFVDDGSQDQTWALITQLHHQDPLFTGLQFSRNYGQEAALMAGMQVANQYSDLIITIDADLQDDPTIIPAMIAQAQDGYDIVYGVRNDRSTDTWFKRTTAQSFYWLMGKLGVNLIPNHSDFRLLTHRVVTELMRCQESRPFIRGLIPQLGFPATKLFYKRQPRQAGVSKYPLRKMLRFALDGILSFSIAPIRAVLYVGLTICGGSLFVLLWILISHLYGTVVTGWSSIMASLWLLGGFQLVAISMIGEYIGRTFTEVKHRPRFIIQTDTYSPAFTSSHSDKISPSEDHHIY

SEQ ID NO: 653 - protein, 330 aa, Weissella cibaria
MAILVLGGAGYIGSHMVDTLLSDGRDVVVVDNLLTGHRAAVPAGVPFYEVDIRDKAALREVFEKENIEQVVHFAASSIVPESMADPLKYFDNNTAGMIALLEVMLEFDVKQIVFSSTAATYGIPEENPIKETTPQNPINPYGESKLQMEHIMKWADDAYGLKWVALRYFNVAGAKADGSIGEDHPVETHLVPIILQTALGQREKIMMFGDDYNTPDGFNVRDYVHVMDLANAHVLALDYLAKGNESNQFNLGSANGFSVKQMVEAAREATGKEIPAEVGPRRAGDPDSLVASSAKAREVLGWAPKYDDVKEIIKTAWTWHQQHPHGYEDR

SEQ ID NO: 654 - protein, 392 aa, Weissella cibaria
MTLNDKNYDYLIVGAGPFGSIFAYEAAKRGKRSLIIEKRAHIAGNMYTHTEHGITVHDFGAHIFHTDNKEVWDYIRQFAEFNGYQNQVVANYKGTLYNLPFNMNTFYEMWGTKTPAEAKAKIEEQKAAALTDLGDREPRNLEEQAISLIGTDIYEKLIKGYTEKQWGRKATELPAFIIKRLPVRFIYDNNYFNHRYQGIPIGGYTQIFEKMLDNDLIDVRLNSDFFEHKDEYIAEFPRILYTGMIDQFFDYKFGELEYRSLRFEQEVIESDNYQGNSVINYTDAETPYTRVMEWKHFDGLSDDGVTIITKEYPQTWDRTKEAYYPVNDEKNTNLYKEYAKEARQHKDQFIFGGRLGQYRYFDMDQVFNAALNEVRKEFKISSSFNFAHDEEH

SEQ ID NO: 655 - protein, 361 aa, Bacillus velezensis
MTKLDETLTMLKALTDAKGIPGNEREVRQVMKSYIEPFADDVTTDRLGSLIAKKTGKENGPKIMISGHLDEVGFMVTQITDKGFLRFQTVGGWWSQVMLAQRVTVVTKKGDITGIIGSKPPHILPPDARKKAADIKEMFIDIGASSREEAMEWGVLPGDQIVPYFEFTVMNNEKHLLAKAWDNRIGCAIAIDVLKNLKNSDHPNEVYGVGTVQEEVGLRGAKTAAHTIQPDIAFGVDVGIAGDTPGISEKEAQSKIGEGPQIILYDASMVSHKGLRDLVVNTAEEAGIPYQFDSIAGGGTDSGSIHLTANGVPALSITIATRYIHTHAAILHRDDYENTVKLITEVIKKLDRETVDRITYQ

SEQ ID NO: 656 - protein, 330 aa, Bacillus velezensis
MAILVLGGAGYIGSHAVDQLLNKGFKTIAVDHLQTGHRKAVHEKAVFYHGDIRDKPFLRSVFAKENVTGVLHFAAQSLVGESMKDPLSYFNNNVYGTQITLEVMQEFGVKHIVFSSSAAVYGEPEKVPITEDMPEKPESAYGESKLMAEKMLKWCETACGIKYVSLRYFNVAGAKTDGSIGEDHHPETHLIPILLQTALGQREEVLIFGTDYDTKDGTCIRDYVHVSDLIDAHILALEYLQNGGDSGIFNLGSSSGFSVSEMAEAARQVTERDIKVKAAARRPGDPSTLIASSDKARNILGWNPKQTDISEIIASAWNWHRQHPNGYKDK

SEQ ID NO: 657 - protein, 289 aa, Enterococcus gilvus
MKGIILAGGSGTRLYPLTKATSKQLMPVYDKPMIYYPMSTLMLAGINEILIISTPQDTPRFENLFGDGHELGIHIEYAVQDSPDGLAQAFIIGEEFIGDDSVCLVLGDNIYYGDGLSRMLQRAAKKTEGATVFGYHVNDPERFGVVEFDDDMQAVSIEEKPEKPKSHYAVTGLYFYDNEVVEIAKNIQPSERGELEITDVNKEYLKRNKLSVEVMSRGFAWLDTGTHESLLEASTFISTIEKRQNLKVACLEEISYRMGYITKEQLVELAQPLKKNQYGQYLLRLAEED

SEQ ID NO: 658 - protein, 193 aa, Enterococcus gilvus
MGKIKVTETNLTDVKIIEPAVFGDHRGFFTESYSVEDFKAAGIDFDFIQDNHSLSTQPGVLRGLHFQKGASAQTKLIRVVTGAVLDVIVDIRKGSPTYGKWEGYILSEHNHRQLLVPRGFAHGFVTLTPNVNFMYKCDNYYDAEADGGISFADPDLAIEWPIAIEKAITSEKDAKQPTLKEFEAENPFVYGEI

SEQ ID NO: 659 - protein, 281 aa, Enterococcus gilvus
MILITGGHGQLGTELRHLLDEKKIEYVSTDADQLDITDKEGTYKFITEMKPELIYHCAAYTAVDKAEDEGKELDELINVDGTRNVAEAAKAAGATLIYISTDYVFDGTKKDGMYQVGDATNPLSEYGRTKLLGEQAVQEIMKDYYIIRTSWVFGIYGHNFIYTMQNLAKTHDRLTVVNDQFGRPTWTRTLAEFMTFVIETNAPFGVYHLSNENSCSWYEFAKEILKDTKVEVAPVTSEEYPQKATRPQYSIMDLSKAKALGFEIPTWQEALASFLELEAKQ

SEQ ID NO: 660 - protein, 329 aa, Enterococcus gilvus
MAILVLGGAGYIGSHTVDKLVSQNYEVVVVDNLLTGHRKAVHPKATFYEGDCRDKTFMRDVFTKESIEGVVHFAASSLVGESVEKPLKYFNNNVVGMESLLEVMEEFEVKNIVFSSTAATYGEPGVSPITEEVATNPTNPYGESKLMMEKMMKWCDNAYGMRYVALRYFNVAGAKADASIGEDHDPETHLVPIILQVALGQRDHLTIFGEDYDTPDGTCIRDYVQVEDLAAAHILALEYLNAGNPSNFFNLGSNNGYSVKEMLDAAREVTGKEIAAEVGPRRAGDPSRLVASSEKVKETLGWNPEYTDIKAIIETAWNWHVSHPHGYED

SEQ ID NO: 661 - protein, 370 aa, Enterococcus gilvus
MNKYIVVGSGLYGSVFANEASKKGHKVKVIEKRNHIAGNIYTENIEGIQTHMYGAHIFHTSDKEVWEYVNQFAHFNRYTNSPIASYHGEIYNLPFNMNTFNKLWGVTTPEEAQEKIEKQRSILKGKKPTNLEEQAISLVGIDIYRKLIKEYTEKQWGRPCKELPSFIIKRLPVRMTYDNNYFNDSFQGIPIGGYTQIVEKMLDHPNIEVFLNTDFFDIKEDLELEADKIIYTGMVDQFFNYRFGKLDYRSLKFTHNILNQENHQGSAVVNYTDKAHKYTRIIEHKHFEFGNQPKTIITKEYPLDWNNGEEPYYPINDEKNNSIYEQYKKLVREKDQYIFGGRLGTYKYFDMHMIIRAALDDAKKELEGSK

SEQ ID NO: 662 - protein, 331 aa, Lactobacillus harbinensis
MTVLVLGGAGYIGSHTVDRLVDKGYDVAVVDNLITGHEKAINAKARFYQGDVRDKLFMREVFDKENIDTVIHFAAFSIVPESMSDPLKYFDNNTYGMTALLEVMRDAGVKRIVFSSTAATYGEPKQVPIKETDPQIPTNPYGESKLAMEKIIHWADVAYGIKFVALRYFNVAGAKDDGSIGEDHHPETHLIPIILQVAKGQRDKLTIFGGDYPTKDGTNVRDYVHVMDLADAHILAMEYLKQGNDSTAFNLGSSHGFSNKEIVDAARKATGKPIPAEVGPRRPGDPATLVASSEKAKKILGWEPQYDDMEKIIATAWHWDQTHPNGYNDRR

SEQ ID NO: 663 - protein, 371 aa, Lactobacillus harbinensis
MKLLVVGSGLFGAVVARERALAGDQVTVIEKRDHIAGNIYTEDVAGIQVHRYGAHIFHTNSERVWQYVQQFATFNRFTNQVIANYHDRLFNLPFNMNTFHQMWGVTTPAEAQAKIAEQQQAGATRRPHNLEEQAIALVGTDIYETLIKEYTAKQWGRAPIDLPAFIIRRLPVRFTYDNNYFSDVHQGIPVGGYTQLVAKMLKLPTISVQLNTDFLTKKAAYLVDYDRIVYSGMIDAFFDYQFGALGYRSLRFATELLDTPNFQGNAVINYTDAETPYTRIIEHKHFEFGTGNRQQTVITREYPAIWTPGAEPYYPINDPENDALFQQYRQYAATAAPKVIFGGRLGAYRYYNMDQVIAAALQVARNEQLFK

SEQ ID NO: 664 - protein, 380 aa, Lactococcus lactis
MKFNKKNYDYLIVGAGPYGSIFAHEAAKHGKKSLIIERRSHIGGNMYTHKEHGINVHDYGAHIFHTDNKMVWDYVNQFTEFNNYINQVVANYKGELYNLPFNMNTFYQMWGVKTPEEAAAKIEEQKAKAGVSGIPKNLEEQAISLIGTDIYHKLIKGYTEKQWGRKATELPSFIIRRLPVRYTFDNNYFNHRYQGVPVDGYTAIFDKMLDSDLIDVQTGVDFFSDKEVFLEEFPKIVYTGMIDQFFDYSFGELEYRSVRFETETVKSDNIQGNAVINYTDAETPYTRVMEWRHFDKKADEGYTILTKEYPQNWDRTKEAYYPVNDEKNSKLFRKYKEETKKYPNVIFGGRLGNYQYYDMDQVFGVALKAVEKEFKDLDKN

SEQ ID NO: 665 - protein, 289 aa, Lactococcus lactis
MKGIILAGGSGTRLYPLTRAASKQLMPIYDKPMIYYPLSTLMLAGIKDILIISTPTDTPRFKELLQDGSEFGINLQYAVQPSPDGLAQAFIIGEEFIGDDSVALILGDNIYHGPGMSKMLQNAAAKEKGATVFGYHVPDPERFGVVEFDENMNAISIEEKPEEPKSNYAVTGLYFYDNDVIEIAKNIEPSSRGELEITDVNKAYLERGDLSVELMGRGFAWLDTGTHESLLEAAQYIETVQRMQNMQVANLEEIAYRMGYITADDVLKLAQPLKKNEYGQYLLRLIGKD

SEQ ID NO: 666 - protein, 376 aa, Lactococcus lactis
MKFNNKNYDYLIVGAGPYGSVFAYEAAKRGKRSLIIERRATIGGNMATHKEHGINIHDFGAHIFHTDNKEVWEYINQFTEFNGYINQVVADYKGERYNLPFNMNTFYQMWGVKTPEEAQAKIDEQRDIGNVSGAPKNLEEQAISLIGKDIYLKLIKGYTEKQWGRNAVDLPSFIIRRLPVRFTYDNNYFNHRYQGVPVDGYTSIFEKMYETDLIDLQLETDFFEHKDEYLNEFSKIIYTGMIDQFFDYKFGELEYRSVRFESETFKSNNQQGSAVINYTDSETPFTRIMEWKHFDKKGDDGYTILTKEYPQDWDRTREAYYPVNDKKNTDLFKKYKKEAIKFGNVIFGGRLGNYQYYDMDQVIGSALKAVKKEFRE

SEQ ID NO: 667 - protein, 373 aa, Pediococcus pentosaceus
MQEYLVVGSGLFGSVFAHEAAKRGHKVKVIEKRDHVAGNIYTKEVEGIQVHQYGAHIFHTSMKNVWDYVNQFAEFNNYINTVVANYNGEIYSMPFNMYTFNKLWGVITPDEAKAKIEEQKKSVKLDGKPANLEEQAISLVGPDVYQKLVKGYTEKQWGQAATDLPSFIIRRLPVRFTYDNNYFNDPYQGIPVGGYTQIIEKMLDHELIEVETGVDFFDHKEEYINSGAKIIFTGMIDQFFDYELGELEYRSLRFETEVKDVDDYQGNAVINYTDAETPYTRVIEHKHFEFGKGNKNKTVVTHEYPKTWKRGDEPYYPINNKRNKELYTKYVELAQAKAPSVLFGGRLGQYRYYNMDQTIMAALQTVEHEFEEK

SEQ ID NO: 668 - protein, 330 aa, Pediococcus pentosaceus
MSILVVGGAGYIGSHMVKRLVEQNRDVVVVDNLSTGHRGAVDKGVKFYEGDIRDHAFLKEVFDQEAIDTVVHFAAFSIVPESMEKPLKYFDNNTAGMVALLEEMRDHDVKRIIFSSTAATYGVPEKSPIEETDRQAPINPYGESKLMMEKIIKWTDQAYGIKFVALRYFNVAGAYPDGSIGEDHGPETHLTPIILQVALGKRDQLQIFGDDYHTPDGTNVRDYVHVLDLADAHILAIDYLKAGNDSDVFNLGSSTGFSVKEMVEAAREATGEAIPAKIAARRPGDPDSLIAASQKARKILKWNPQYDDVKEIIKTAWNWTQKHPNGYEDR

SEQ ID NO: 669 - protein, 334 aa, Pediococcus pentosaceus
MAVLVLGGAGYIGSHAVDRLITKGYDVAVVDNLVTGHRAAVNQQARFYEGDVRDAEFMDSVFTKEDVEGVIHFAAFSVVPESMKNPLKYFDNNTAGMVKLLEVMAKHDVKRIVFSSTAATYGEPERVPIQESDPQVPTNPYGESKLAMEKIMHWSDVADGIKFVALRYFNVAGAKPDGSIGEDHQPETHLVPIILQVAAGERDQLQIFGDDYPTADGTNVRDYVHVVDLADAHILALEYLKQGHDSNAFNLGSSTGFSNRQMLEAAREVTGKEIPAVMAPRRAGDPSTLIAASDKAREILGWQPQYDDVKEIIKTAWNWKVNHPAGYDDRGGQA

SEQ ID NO: 670 - protein, 398 aa, Exiguobacterium acetylicum
MSYAQPDTLGQYGKYGGRYIPETLMHAVIELEEAYATVKEDPAFQARMDELLKEYVGRETPLYFAEHLTQTIGGAKIYLKREDLNHTGAHKINNTIGQALLAERMGKRKIVAETGAGQHGVATATVCALLDLECVIFMGEEDVRRQELNVFRMELLGATVIPVTQGSRTLKDAVNEALRYWVKHVEDTHYLMGSVLGPHPFPQLVRDFQAVIGKETRRQIIEKEGRLPEAIVACVGGGSNAIGMFHPFIDDTDVKLYGIEAAGSGIDTEKHAATMTKGEVGVLHGSMMYLLQDAHGQVQEAHSISAGLDYPGVGPEHSLLKDIGRVQYEAVTDEQALEALQLLSRKEGIIPALESAHAIAYATQLAAEMDKEEILVICLSGRGDKDVVTVRNALKGEA

SEQ ID NO: 671 - protein, 380 aa, Exiguobacterium acetylicum
MNTLNPSTNPTLSIMEKIAGHEQVVFCNDPVSGLQAIIAIHDTTLGPALGGCRMAPYASVDEALDDVLRLSRGMTYKCAAADVDFGGGKAVIIGNPATDKSPELFRAFGRFVDSLGGRFYTGTDMGTTMDDFVHASRETSRIVGIPEAFGGSGDSSIPTAEGVVYGLRATIETLFGSDDLSRATYAIQGLGKVGFKVAEQLLLAGATIYVSDVNEAALAAIVTQAEMAPGTVRVVSPHEIHLTDADVFVPCAYGGVIHAQNIALLPCKAICGSANNQLADEQLAHVLMDRGILYAPDYIVNGGGLIQVADELYGANHERVLLKTRHIYDAVLEVFKESHAENITTVEAANRMCEKRMQIRAKHNNIFTNTTKPKWDIRNH

SEQ ID NO: 672 - protein, 506 aa, Exiguobacterium acetylicum
MIYDIPNKQGSKVQYKERYENYINGKWTAPVGGEYFDNVTPVTGKVLCQVARSGKEDIELALDAAHAAKEAWGKTSVTERSNILNKIANRMEENLEMLAYAETLENGKAVRETLNADLPLAIDHFRYFAGVIRAQEGSVGELDQDTVAYHFHEPLGVVGQIIPWNFPLLMAVWKLAPALAAGNCVVLKPAEQTPASIMVLVELIEDLLPPGVLNIVNGFGLEAGKPLASSKRIAKIAFTGETTTGRLIMQYASQNLIPVTLELGGKSPNIFFEDIMQADDAFFDKAIEGLLMFALNQGEVCTCPSRALIQESIYEPFMERVLERVKAIKIGNPLDSDVMMGAQASNEQMEKILSYLEIGKSEGAECLVGGERNMLEGDLAEGYYIQPTIFKGHNKMRIFQEEIFGPVLSVTTFKTEEEALEIANDTLYGLGAGVWTRDMNRAYRFGRAIEAGRVWTNCYHQYPAHAAFGGYKMSGIGRENHKMMLNHYQRTKNLLVSYNPNKLGFF

SEQ ID NO: 673 - protein, 398 aa, Paenibacillus polymyxa
MTQLPDNNGRFGTFGGRFVPETLMNALIELEESYRKYADDPEFKAELNGLLKDYSGRETPLYHAERLSQHLGGAKIYLKREDLNHTGAHKINNALAQGLLAKRMGKQKVIAETGAGQHGVATATVAALLGLECKVFMGEEDTVRQQLNVFRMQLLGAEVIPVTSGTRTLKDAGNEALRYWVSHVHDTFYILGSAVGPHPYPMMVRDFQRVIGDETRRQILEKEGRLPDVIVAAIGGGSNAIGMFYPFIEDQGVALIGVEAAGKGIETEFHAATMTKGTQGVFQGSMSYLLQDEYGQVQPAHSISAGLDYPGVGPEHSYLKDIERAQYVPITDQEALDALQLLCRTEGILPALESAHAVAQVVKLAPTLTADDIIVICLSGRGDKDVDSIIKYLGGNPS

SEQ ID NO: 674 - protein, 472 aa, Paenibacillus polymyxa
MAYKDFRDFLHTLEKEGQLLTISDEVKPEPDLAAANRALNNLGDKTPALFFNNIYGYTDARIAMNVMGSWPNHALMMGMPKNTPLKEQFFEFARRYEQFPVPVKREETAPFHEVEITEDINLFDILPLFRLNQGDGGFYLDKAILVSRDLDDPDTYGKQNVGLYRMQVKGKNRLGIQPVPQHDIAIHIRQAEERGENLKVAIALGCEPVITTAASTPLLYDQSEYEMAGAIQGEPYRVVKAKDADLDLPWGAEVILEGEVLAGEREYEGPFGEFTGHYSGGRAMPVIQINRVYHRKQPIFEHLYIGMPWTETDYMIGVNTSVPLFQQLKDAFPNEIVAVNAMYTHGLVAIISTKTRYGGFAKAVGMRALTTPHGLGYCKLVIVVDEEVDPFNLPQVMWALSTKLHPKHDAVIVPGLSILPLDPGSDPAGMTHKMILDATTPVAPDIRGHYSQSLDSPLGVAEWEKKLSQMLR

SEQ ID NO: 675 - protein, 388 aa, Clostridium thiosulfatireducens
MKGYFGKYGGAFVSNEVKKALNELEEAFEKAIEDKEFMREYNYYLKDYSGRETPLYFAENLTKFCGGPKVYLKREDLNHTGAHKINNVLGQILLAKRMGKNKVIAETGAGQHGVATATLAAKFGMECEIVMGEEDIKRQELNVFRMKILGAKVTPATSGTKTLNDAVNEALEKWVNNISDTFYVLGSAVGPHPYPKIVKEFQKIIGEEARKQILEKENKLPNYVVACVGGGSNAIGIFTAFLEDKDVNLIGVEAAGFGVETEMHAATITKGKEAIIHGMNTLVLKDDSGDVKEAYSISPGLDYPGVGPEHAFLSEIGRVNYKYITDDEAIKAFMLLSKLEGIIPAIESAHAIAYTIKLSKTLQKNEVIVVNLSGRGDKDVSAINKLLN

SEQ ID NO: 676 - protein, 400 aa, Bacillus velezensis
MYPYPNEIGRYGEFGGKFVPETLMRPLEEIETAFKELKNDPVFHAEYKKLLFDYSGRPTALTFADRVSEYLGGAKIYLKREDLNHTGSHKINNALGQILLAKKMGKTKIIAETGAGQHGVAAATAAAKFGFKCTVFMGEEDVARQSLNVFRMKLLGAEVVPVTSGNGTLKDATNEAIRYWVQHCEDHFYLIGSVVGPHPYPYIVREFQKIIGEEAKEQLRRVEGTLPDKVVACVGGGSNAMGIFQAFLDEDIELIGAEAAGKGINTPLHAATIAKGTLGVIHGSMTYLIQDEYGQIIEPYSISAGLDYPGIGPEHAYLHKSGRVTYESVTDDEAIAALRLLSETEGILPAIESAHALAKAFEMAKDMDKDKIILVSLSGRGDKDVHTLMNVLENGVGTHV

SEQ ID NO: 677 - protein, 277 aa, Bacillus velezensis
MIIPTPYWVSYPEQVKLAGGRPVYAEGLESNQFKISPEQLKQAITEKTKALIINSPSNPTGVMYTKEELAELGKVCLEHGILIVSDEIYEKLTYGGKKHVSIAQLSDKLKEQTIIINGVSKSHSMTGWRIGYAAGSETIIKAMTSLASHSTSNPTSIAQYGAIAAYNGPAEPLEEMRQAFEHRLNTIYAQLGEIPGFTCVKPEGAFYLFPNAKAAAENCGFKDVDEYVKALLEEEKVAVVPGSGFGSPDNVRLSYATSLDLLEEAVERIRRFTEKHS

SEQ ID NO: 678 - protein, 1223 aa, Bacillus velezensis
MFVNTLAIRTEPKGDKQFTDYLAEVRQAALEAYEHQDYPFEELVERLGVQRDTSRNPLFDVMFVLQNMERESLVLNKLHLAQAADTSHKTAKFDATLYASEGSDGSISFDFEFNTDIYQKQTIEKWLSYFTRILTKVIENQAIPLGDIHVLDNAETNRVIYQFNQTKSDYPRHETISRLFERQAKETPDARAVVYDGQILTYRELNERANRIAAALRSNGVGPESVVALLTGRTTELASGILGILKAGGAYLPIGDDVPRERAEWMLKDCKADILLQSDKLDGLPLSGKRLFIEDIQTKAGLSSENPEPLGGPESLAYMIYTSGSTGAPKGVMIEQRSVIRLVKNSNYIDFTPEDRLLFTSSLGFDVTTFEIFGPLLNGASLYVSDQETYLDSDVLETFIQQNGITTLWLTSSLFNHLSEQNEHVFSGLSRLIIGGEALSPSHVNRVRNALPHLSVWNGYGPTENTTFSTCFLIEQSYDHSIPIGRPVGNSTAYIINSRGTPQPIGVIGELCTGGDGVARGYFGRPELTEEKFVPNPFVPGERMYRTGDLARWLPDGTIEYAGRMDDQVKIRGYRVELGEIEAALRSLDGVKEAAVSVRTGQSGNKELIAYMSLQADMDTEKVRSSLSKQLPNYMVPAYMMELEKLPLTPNGKLDRKNLPEPELALQTAYTAPRNELEEQLSVIWQEVLGTKQVGIEDSFFELGGDSIKALQVSARLGRYGWKMTASDLFRHPSIKELAPLIRKAERVIDQRPVEGDIPWTPVQHWFLSQRMENRNHFNQSVMMFSSDALHKQPLKEALEYLVIHHDALRITVSAENESFRQINHGIQKDELYTLDIWDMSGTDTWEREIETEVAALQQRMDIEKGPLLKAGWFKTRSGDYLFITVHHLAVDGVSWRILLEDLSAAYTQAVKGQPVQLPPKTDSFKQYAERLSEYAKSSKLMREEEYWRFIEEETAAELPYEKPQHQTGADSIRQTVSFTLTEEETSVLLQQVNRAYHTDTQDILLTAAALALRDWTGGGRLRIAMEGHGREHIMPELDISRTVGWFTSMYPVLIDLNTAGAELGTAVKTVKDTLGRIPDKGIGYGILKYMTPPEQKTIRFRQAPEISFNYLGQFNDTEDQHTFSLSGLASGHDITPTWQREQAVEMSAMAAQNKLHFSLSYPPSRFRKETMEQLLQTLQQYLRDIMAHCTGKEEAEKTVSDFSSKTLTSDDLDSIASFVEEL

SEQ ID NO: 679 - protein, 187 aa, Lactobacillus brevis
MKQIVIGVTGASGTIYAIDLLKKLRDKPDVETHLVMSPWATKNLALETSYTLAQVKAMADYTYSDRDQGAKIASGSFLHDGMVIVPASMKTVAGVAYGFGDNLIARAADVTIKERRQLIIVPRETPLSVIHLENLTKLAKLGAQIIPPIPAFYNQPQTIQDLVDHQTMKVLDAFGIQQVTAKRWEGD

SEQ ID NO: 680 - protein, 352 aa, Enterococcus gilvus
MTFLNQKFQELVPYTPGEQVDEESFIKLNTNESPYPPAPSVQAAVAEASQTLNRYSDIAVEAVAKPLAEYLGVEQNQLFLGNGSDEVLSYLFQGFTEKGIAFPDVTYGFYQVYSGLYHVDATVVPLKEDFSLELTDYDALSGTVIFANPNAPTGIYLSQTEICAFIEKHPERLVIVDEAYIDFSGESMVSLINRYKNLLVVGTFSKSRQLAGARLGFGVGNAALIADMNRLRFSLNPYNINSLTQAAGGAVLQEQAYVDEKIQETIRVREWTKQELTALGFEQTDSQGNFLFARHPKMAGEALFQALRERKILVRWFNQPRTKEYLRITVGTQEQMEQLAAALRSILEEVKA

SEQ ID NO: 681 - protein, 397 aa, Enterococcus gilvus
MYQEPNEAGFYGEYGGKFVPETLMYAVKELEETYESSKKDPAFQEELDYYLKQYVGRENPLYFAERLTRELGGAKIYLKREDLNHTGAHKINNALGQVLLAKRMGKRKVVAETGAGQHGVATATAAALFGMECTIFMGEVDVKRQALNVFRMDLLGAKVESVTSGSKTLKDAVNEALRYWVATVEDTHYVMGSVLGPHPFPEIVRDYQSVIGIETRKQILEAEDRLPDLVIACVGGGSNAMGMFYPFIEDEDVRLMGVEASGHGLDTEEHAASINKGSVGILHGAKMHLLQDDDGQVLEAFSISAGLDYPGIGPEHSYLHTIGRAEYAAIDDEEAVEAFHYLSRLEGIIPALESSHALAQVMKVAPTMSKEQILVMNLSGRGDKDVQQIKERMEAAE

SEQ ID NO: 682 - protein, 251 aa, Enterococcus gilvus
MKPLTKTLKSRGETEKLFVPYIMAGAQGLDKLEEEIEMLAEQGAAAIELGVPFSDPVADGPTIQAAGLRAFAQQVTLKKLIAKLQNMRSSVPLILMGYSNSFFHYGIKELVEELKETDVQGFIIPDLPYEHRDLVAPDLGDMALLTLVSLTSPKERIEELTKDAEGFIYAVTVNGITGTDQHFRQDLMNHLATVKAVSTIPVLAGFGISTKEQVQNFQEVCDGVVIGSKIVRSLEEQGTEKTGELVAKIFE

SEQ ID NO: 683 - protein, 494 aa, Enterococcus gilvus
MNDKVQLKDQYSLFIDGKWTAYDAERALLAINPANGDCLAKFTDATDDEVDLAVTAANNALKEWRKVSIEERSRILLKIADIIDEHAEHLALVETLDNGKPLRETQTIDIPYGADHFRYFAGVLRSEEGTAQQLDETTLTINLKEPIGVVGQIIPWNFPFLMAAWKIAPALAAGNTIIIHPSSTTSLSILEFARLIQEVLPPGVLNVVTGKGSKSGEYMLHHEGIDKLAFTGSTEVGYNVAISAAKRLVPATLELGGKSANIFFNDMPYEKALDGAQLGILFNQGQVCCAGSRIFVQSGIYDRFVKDLAEAFNKVNVGLPWEEGIQMGAQINENQVKTILKYIDIAKEEGAAIKAGGTRLDTNGLEKGCFVAPTLITNVTNDMRVAKEEIFGPVAVVIKFDEIDEVIEMANDSIYGLGGGVWTKDLNTALTVSRALETGRVWVNTYNQIPAGAPFGGYKKSGIGRETYKSMLDAYSQTKNIMIDTNNEPSGFYS

SEQ ID NO: 684 - protein, 404 aa, Lactobacillus harbinensis
MQEIEKQHTFKTPGHYGEFGGTYVPELLYPELQRVADAYHAARKDPEFNKELNDLLVNYAGRPSLLYYAANMTKDLGGAQIYFKREDLNHTGAHKINNVLGQALVAKRMGKKRLIAETGAGQHGVATATVAALFGMECEIFMGKVDTERQKLNVYRMQLLGAKVTPVTNGSAVLKDAVNAALQNWAARSDDTFYLLGSAVGPYPFPAMVHDFQSVISKESKKQILSQAGRLPDYVVACVGGGSNAIGSFAEYIDQPEVHLVGAEGAGKGADTPENAATMTNGSAGIFHGMKSKFLQDADGQIDKVYSISAGLDYPGVGPEHVMLQESGRAQYYPITDDEAVDAFEYIAKEEGIIAAIESCHAVAQVMKMAPKLPKDKIIICTLSGRGDKDVASIAKYRGVEIDD

SEQ ID NO: 685 - protein, 402 aa, Lactococcus lactis
MTYNQPNNKGFYGQFGGQFVPETLMTAVKQLEEAYVDSKKDPLFQAELKELLKDYVGRENPLYYAKRLTEYAGGAKIYLKREDLNHTGSHKINNALGQVLLAKKMGKNKVIAETGAGQHGVASATAAALFGMECTIYMGEEDVKRQSLNVFRMELLGAKVHSVTDGSRVLKDAVNAALRAWVAQVEDTHYVMGSVLGPHPFPQIVRDYQAVIGQEARAQFLEKENKLPDALVACVGGGSNSMGLFYPFVNDESVAMYGVEAAGLGIDTPHHAATITKGRPGVLHGTLMDVLQDENGQILEAFSISAGLDYPGIGPEHSYFNAVGRAKYVDITDEEALEGFKILSRTEGIIPALESSHAIAYAVKLAKELGADKSMIVCLSGRGDKDVVQVKERLEAEKEVKK

SEQ ID NO: 686 - protein, 471 aa, Pichia kudriavzevii
MSYASRYFPNEPTAPKVVTESIPGPKGKSAIASLGEVFDNRCAYFVADYEKSVGNYIVDVDGNVLLDAYAQIASIPLGYNNPKLIEVAKSDKMTRAIVNRPALGNFPGADFEQMQRDLLKHAPKGQTHVWNGLSGADANELAFKAVFFNYQSKKRGFDKPFTKEEEVSCMENMAPGNPEIAILSFKKAFHGRLFASGSVTRSKPVHKMDMPSFAWPTAEFPAYKYPLEENEEANMAEDARCLAIVEDRLQNWKCPIAGVIVEPVQSEGGDNHASAAFFQGLRDLTLKYGAKLIIDEVQAGCGATGIMWDHERYNITPPPDLVTFSKKMQSAGYWFHDPELIPNQPYRQFNTWCGDPKGVILAAAICDEVVDNNLLEPLRETGDYFYSKLESIQKQYPKLISNLRGKGKACFLAFDMPSGSLRADFLGKMKLAGVNVGGCADVGVRLRPGLTFEKKHVDIFIAAMEKVLPTL

SEQ ID NO: 687 - protein, 673 aa, Pichia kudriavzevii
MTKTHSVVHEANGVIARPTPKPFFEKQPSASLSSKEEYDEMYKQSIQDPEGFFGPMAKKFLSWDKDFTKVKSGTLANGDAAWFINGELNACYNCVDRHAFKNPDKVAIVFEADDESESRKITFGELLRDVSQVAGVLQSWGVKKGDTVAIYLPMTPEAIIAMLACARIGAIHSVIFAGFSAGSIKERVTDANSKVLITTDEGKRGGKIVNNKTIVDEALKDCPSVEKVLVYKRTGNPKINMKEGRDYYWQDLAPEFRGYLPCVSVNSEDPLFMLYTSGSTGAPKGVVHSTGGYLLGAAMTTKYVFDLQEEDVLFTAGDVGWITGHSYALYGPMTLGVSTIIFEGTPAYPNFGRFWRIIERNKATHFYVAPTALRMLKKSGEEEIAKYDLSSLRTLGSVGEPIASEIWQWYDEKIGHGCCHISDTYWQTESGSHLIAPLAGSVPTKPGAATLPFFGIDAVIIDPTSGKVLEGNDVEGVLAIKNTWPSMARTVYKNHKRYMETYLKPYPGYYFTGDGAGRDHDGYYWIRGRVDDVVNVSGHRLSTAEIEAVLLEDSKRVSDAAVVGINDDITGQAVIAFVQLKDNSLVSDEASLLKLRQDLRLSIRATIGPFAAPKTIIIVDDLPKTRSGKIVRRVLRKIVSGEAKALGDQSTLANPECIEPIIVAVESQFGVKN

SEQ ID NO: 688 - protein, 671 aa, Pichia kudriavzevii
MAQKHLENEHLMNIEHMEVPSGFLERHPSKPYLTSLDQYKKMYKESIEQPGQFFAKMARENLSWFKDFTVAKVPEAPHLQDNNGEPSAWFVDGEINACYNCVDRWAIESPNKPAIIYEADEPNEGRVITYGELLKDVCKFAQVLKNLGVKKGDTVAVYLPMIPEAIVALMAIIRIGAIHSVIFAGFSSTSLRDRVLDANSKIVITADESKRGGKIIETKKIVDDAITQCPDVSNVVVFRRTGNSHIPWNSERDVWWHEEVSKYGPYCPAEPMNSEDPLFLLYTSGSTGKPKGILHTTAGYLLGALLTTKYVFDVHPEDIIFTAGDVGWITGHSYVVYGPLLNGATTVVFEGTPAYPNFSRYWEIVDKYGVNQFYVAPTALRLLKRAGEKYIENYKLNTLRVLGSVGEPIAKDVWEWYNEFIGRGKAHICDTYWQTESGSHLIAPLAGITPTKAGSASLPFFGIEPAIVDPVTGEELKGNNVEGVLCVKTAWPSMTRSIWNDYGRYLETYLKPYHGHYFSGDGAARDKDGFYWILGRVDDVVNVSGHRLSTAEIEAALIEHPLVSENAVVGFPDELTGSAVASFVSLKKDVEDREAIKKELILTVRKEIGPFAAPKVILLVNDLPKTRSGKIMRRILRKVLAGEEDQLGDISTLSNPDVVAHIIDVVMQHRK

SEQ ID NO: 689 - protein, 411 aa, Pichia kudriavzevii
MAFEKIKVKTPVVEMDGDEMTRIIWKMIKDQLILPFLDIDLDYYDLGIEYRDKTNDQVTVDSANATKKYGVAVKCATITPDEARVEEFGLKKMWLSPNGTIRNILGGTVFREPIIIENIPRIIQHWEKPIVIGRHAFGDQYKCQNIVTPECGGDLKLVFTPKDGSDVIEVPVYEYKGKGAALAMYNTEESITGFARASFELAISRKLPLYMSTKNTILKQYDGLFKDTFENMYQSEYKDKFEELGIWYEHRLIDDMVAQMIKSKGGYIIAMKNYDGDVESDIVAQGFGSLGLMTSVLVSADGKTFESEAAHGTVTRHYRQHQQGKETSTNSIASIFAWSRGLIKRGELDSTPDVVKFAQVLEKATIDTVRVDGIMTKDLALARGEIDRSAYVTTGEFIESVAKRLTKELGA

SEQ ID NO: 690 - protein, 441 aa, Pichia kudriavzevii
MFAASTRAHLRLAAIKRHFSTSPCALEKIHVKNPIVELDGDEMTRIIWSDIKNKLILPYLDVDLKYYDLSIQSRDASDDQITVDAANAIKKYGVGIKCATITPDEARVKEFGLKKMWLSPNGTIRNILGGTVFREPIVIGSGPDKAPNDIEIPRLVPGWKKPIIIGRHAHADQYKATDFVVPEAGTLEVTFTPKDPRGEKINRTVYEYKGPGVALSMYNTEESIRGFAHSSFKMALNRKAPLFLSTKNTILKKYDGKFKDIFQEIYETTYKAEFESKGLTYEHRLIDDMVAQMLKSQGGFVLALKNYDGDVQSDIVAQGFGSLGLMTSVLMTPDGKAFESEAAHGTVTRHYRKYQQGEETSTNSIASIFAWTRGIAQRGKLDATPEVVEFANTLEKCVLDTVSKDGIMTKDLALLVKKKEYATTEGFLDAVAARLSKNIKV

SEQ ID NO: 691 - protein, 603 aa, Pichia kudriavzevii
MTKDCCEVTKIPVGEEAKVTVPRSTRLSATGPVECDLSGFQVLNSPLFNKGTAFTIAEREAFGLNGLLPPVVNTLEEQVERSYKQLHFLKTPLAKNDFCTSLRLQNKVLFYRLVKEHIKELIPIVYTPTEGDAIIAYSDRFRKPEGLFLDITRPNEIDQRLEQFGEDKDVDYIVITDSEGILGIGDQGVGGVRITIAKAALMTVCAGLHPGRVVSCVLDVGTNNVKLLEDDLYLGNRFPRVRGKEYDDFVNKTIRAMKKRFPSAVIHFEDFGVTTARPVLERFRDEIPCFNDDIQGTGAVVMASMAAALKLTHRNLLDSKVLIYGAGSAGLGIADQIVNHMVSHGATKEEARRKIYCMDRYGLILKGMTSNSPAQEDYAHDPKDWENISTTSLVDVIEKVKPTTLVGCSTQAGAFNEEVIKTMYKHNPRPMIFPLSNPTRLHECFPEDALKWTDFNALVATGSPFPPVEGHVISENNNCFAFPGIGLGAVLARTTRISDNMISAAVDELASLSPAQKDPKLGLLPPIEEIDETSARIATAVILKAVEEGFARVEEEDSPLGGKVKIPREFDPCLRWVKEQMWHPIYRPMIKVAHSDNIHTHQY

SEQ ID NO: 692 - protein, 568 aa, Pichia kudriavzevii
MTKPAELYCTSLEGVQVVGEVSDKPLLSEATPRDILTIDALKFVVLLHRAFNGTRKQLLANRQDVQKRLDAGESLTFLKETEYIRNDPNWRCATNHPKLMCRKVEITGPPDAKMIINAFNTNVHTYMTDFEDSCAPTWSNMLYGQVNLYDAIRDKIDFTNDKTGKRYKINREGRRVPVMIVRPRGWHMVDQHILVDGEPISASILDFGLFFYHNAKYLISQGLGPFFYLPKMEHWKEAKLWNDIFCVAQDCLEIPRGTIKATVLIETLPISYQLDEVLYALKDHSSGLNCGRWDYMFSTIKRLRNQKDKILPDRQQVTMTVPFMTNYVKQLIKVCHKRGVHAMGGMAAFIPIKNDEEANKVALEAVRKDKLREVLAGHDGTWIAHPGLLDTALSVFEEHMPTPNQLYKLKDDVSVTESDLVDTNIEGGQITMKGLNANIYIGLNYMESWLRGLGCVPINHLMEDAATAEVSRLQLWSWCKHQVKMNDTGKTITPDFVCQLIDEEVARCSHKEGNKYELAAQCLKDEISGKKPVAEFLTDILYPYIATPGKPVDLNSLKQSTPVCASRL

SEQ ID NO: 693 - protein, 334 aa, Pichia kudriavzevii
MFSRISARQFSSSAASAYKVTVLGAAGGIGQPLSLLMKLNHKVTNLSLYDLRLGAGVATDLSHIPTNSVVKGYGPENNGLKDALTGSDVVLIPAGVPRKPGMTRDDLFNTNASIVRDLAKAAADHCPNAVLLIISNPVNSTVPIVAEVLKSKGVYNPKKLFGVTTLDVLRSSRFLSEVVNTDPTTETVTVVGGHSGVTIVPLISQTKHKDLPKETYEALVHRIQFGGDEVVKAKDGAGSATLSMAQAGARMASSVLKGLAGEVDIVEPTFIDSPLFKSEGVEFFSSRVTLGPEGVQEVHPLGVLSTAEEEMVATAKETLKKNIQKGVDFVKANP

SEQ ID NO: 694 - protein, 350 aa, Pichia kudriavzevii
MSYEIPQTQKACVFYENGGPITYKDIPVPKPKPTEILVKVLYSGVCHTDLHAWKGDWPLATKLPLVGGHEGAGVVVAKGENVTSFEIGDYAGIKWLNGSCMGCEFCEQGAEPNCPKADLSGYTHDGSFQQYATADAIQAAHISKETDLAGVAPILCAGVTVYKALKTADLRAGEWVCISGAAGGLGSLAIQYAKAMGLRVVGIDGGDEKKELCKSLGAEAFIDFTKTKDIVKAVQEATNGGPHGVINVSVSEAAISQSCEYVRPLGKVVLVGLPAGAQVKTGVFEAVVKSIEIKGSYVGNRKDTAEALDFYTRGLVKSPFKIVGLSELPKVFELMEQGKILGRMVLDTSK

SEQ ID NO: 695 - protein, 377 aa, Pichia kudriavzevii
MLSKTITAALRGNTTRTAFRINAIRSLAIPAIPETQKGVIFYENGGELFYKDIPVPKPKPNEILVNVKYSGVCHTDLHAWKGDWPLATKLPLVGGHEGAGVVVAKGDNVTNFEIGDYAGIKWLNGSCMGCEFCQQGAEPNCPQADLSGYTHDGSFQQYATADAVQAAKIPQGTDLAQVAPILCAGITVYKALKTAELRPGQWVAISGAAGGLGSLAVQYAKAMGLRVLGIDGGEEKGKFAKSLGAEVFIDFTKSKDIVKDIQEATNGGPHGVINVSVSPAAISQSTQYVRTLGKVVLVGLPAHAVCESSVFDHVVKSIQIRGSYVGNREDTSEAIDFFTRGLVKSPIKIVGLSELPKIYELMEQGKILGRYVVDTSK

SEQ ID NO: 696 - protein, 376 aa, Pichia kudriavzevii
MFASTFRSQAVRAARFTRFQSTFAIPEKQMGVIFETHGGPLQYKEIPVPKPKPTEILINVKYSGVCHTDLHAWKGDWPLPAKLPLVGGHEGAGIVVAKGSAVTNFEIGDYAGIKWLNGSCMSCEFCEQGDESNCEHADLSGYTHDGSFQQYATADAIQAAKIPKGTDLSEVAPILCAGVTVYKALKTADLRAGQWVAISGAAGGLGSLAVQYAKAMGLRVLGIDGGEGKKELFEQCGGDVFIDFTRYPRDAPEKMVADIKAATNGLGPHGVINVSVSPAAISQSCDYVRATGKVVLVGMPSGAVCKSDVFTHVVKSLQIKGSYVGNRADTREALEFFNEGKVRSPIKVVPLSTLPEIYELMEQGKILGRYVVDTSK

SEQ ID NO: 697 - protein, 524 aa, Pichia kudriavzevii
MLRLTTRTNTLRSPRVFSALSSIRCYSDLPVYQTITLPNGQTYEQPTGLFINGEFVKSQQHKTFEVINPSTEEEICHVHEARAEDVDLAVDAANKAFHSTWSKMDPSIRGKYLLNLADLMEAHKDTLAAIESMDNGKALVSAQGDVGLVINYLRYCAGYADKLFGKLVDTGSNYFNYIKREPIGVCGQIIPWNFPLLMWSWKVGPALAAGNTIVLKTAESTPLSALYAAKLAQEAGIPKGVINIVSGFGKITGEAISLHPKIKKLAFTGSTATGKHIMKAAAESNLKKVTLELGGKSPNIVFNDADIKKAVNSLVLGIFFNSGEVCCAGSRVFIQEGVYDEVLEEFKKAAENLKVGNPFEDGVFQGAQTSQQQLSKILSYVDSAKSEGATLIAGGERLGDKGFFVKPTIFADVKPTMKIYTEEIFGPFAAVTKFKTADEAIKLANDSEYGLAAGIHTKSLDTATYVANNLEAGTVWINTYNDFHHNMPFGGFKQSGIGREMGEEAFENYTQWKTVRVAINDGPQ

SEQ ID NO: 698 - protein, 253 aa, Pichia kudriavzevii
MMMKNFIRNMATTAAKTPNLKTFKIYRWNPDTPDVKPHMQSYTLDMNKTGPMVLDALLKIKNEHDPTLTLRRSCREGICGSCAMNIGGRNTLACLCKIDKDSGKDLKIYPLPHMYIVRDLVPDLTLFYKQYKSIQPYLQSDKPMPERENLQSIEDRKKLDGLYECILCACCSTSCPSYWWNQQEYLGPAVLMQAYRWMVDSRDQATKMRKDMLQNSMSLYRCHTIMNCSKTCPKGLNPGGAIAEIKKSMALDA

SEQ ID NO: 699 - protein, 640 aa, Pichia kudriavzevii
MLSLQRSVKSISASKRFFSNTPASRQVINRFNNLNGKEASSAMAKDYHVIDHEYDCVVVGAGGAGLRAAFGLVKEGFKVACISKLFPTRSHTVAAQGGINAALGNMHKDDWHWHMYDTVKGSDWLGDQDAIHYMTREAPPSIIELEHYGLPFSRNKEGKIYQRAFGGQTKDYGKGGQAYRTCAVADRTGHALLHTLYGQSLRYDTHYFIEFFALDLLKHNGEIVGCIAYNQEDGTLHRFKAHKTIIATGGSGRAYFSCTSAHTCTGDGSAMVARAGYPLEDMEFIQFHPSGIYGSGCLITEGARGEGGYLINSEGERFMERYAPHAKDLACRDVVSRAITMEINAGRGVGPEKDHMYLQLSHLPPSVLQERLPGISETAKIFAGVDVTKEPIPIIPTVHYNMGGIPTKWSGEALTVNEKGEDVVIPGLYACGEAACASVHGANRLGANSLLDLVVFGRAVAHSIAAELKPGTPHKELPADIGFESIANLDKLRNASGSTPTAELRLEMQKAMQKHVAVFRTQDNLDAGVSELERIDAKFADIKTTDRSMIWNTDLTETLELQNLLTCAKQIATSAAARKESRGAHARDDYPNRDDENWQKHTLSWQTKTGEPVKLGYRKVITTTLDEAECKPVPPTVRAY

SEQ ID NO: 700 - protein, 166 aa, Pichia kudriavzevii
MFRSTARRALHISRPLFIAKPKADSVPIDKTAAPQGYLQGKPVKNYYVDEETNEIVIKVQPLKREGESLETMRKRLTYQSRKRGILETDLLMSRFAKKYLSSFDRGMLEEYDKLLDELDWDIYYWATENYKITPLPDKWKDSKVLKLIQQESRNEKKEILRMPSLN

SEQ ID NO: 701 - protein, 415 aa, Pichia kudriavzevii
MFSTHLAKKLLSRRSVQQVRHLSIHEYRSAALLKSYGVGVPRGEAARSPEEAYKAAKDLNTNEMVLKAQALTGGRGKGHFDNGLQSGVRLVETPEEVKELSAKMLGHKLITKQTGEAGKIVTAVYVVERKYALTEAYLSIVMDRKNQSTMIIASAQGGMDIEGVAKKDPNAIKKYSVDLEAGVSDDLAFEIASQLGFTKDAIPQGAKTIQTLYQIFKDKDATQIEINPLTETKQHEVMCMDAKFNFDDNAAFRQQEVFSWRDVTQEDPDEVVASKYGLNFIKLNGNVGCLVNGAGLAMATMDVVKLYGGEPANFLDVGGAATPETIEKAFELIITEKNVSAIFVNIFGGIVRCDYVADGLIQATKNLGLKIPVVVRLQGTNFEIAKDMINKSGLKLYVEEDLDEAAKKAVELGGK

SEQ ID NO: 702 - protein, 575 aa, Pichia kudriavzevii
MTDKISLGTYLFEKLKEAGSYSIFGVPGDFNLALLDHVKEVEGIRWVGNANELNAGYEADGYARINGFASLITTFGVGELSAVNAIAGSYAEHVPLIHIVGMPSLSAMKNNLLLHHTLGDTRFDNFTEMSKKISAKVEIVYDLESAPKLINNLIETAYHTKRPVYLGLPSNFADELVPAALVKENKLHLEEPLNNPVAEEEFIHNVVEMVKKAEKPIILVDACAARHNISKEVRELAKLTKFPVFTTPMGKSTVDEDDEEFFGLYLGSLSAPDVKDIVGPTDCILSLGGLPSDFNTGSFSYGYTTKNVVEFHSNYCKFKSATYENLMMKGAVQRLISELKNIKYSNVSTLSPPKSKFAYESAKVAPEGIITQDYLWKRLSYFLKPRDIIVTETGTSSFGVLATHLPRDSKSISQVLWGSIGFSLPAAVGAAFAAEDAHKQTGEQERRTVLFIGDGSLQLTVQSISDAARWNIKPYIFILNNRGYTIEKLIHGRHEDYNQIQPWDHQLLLKLFADKTQYENHVVKSAKDLDALMKDEAFNKEDKIRVIELFLDEFDAPEILVAQAKLSDEINSKAA

SEQ ID NO: 703 - protein, 502 aa, Leucosporidium scottii
MSVPSTTLQFPEGHSLKEVTFETGLFINNKFVPGVEGRTIDVLNPSNDKKIAVVSEAGAQDIDIAVDAAEKAFNTVWGEKVPGFERGRMLIALAEAFEANAETLASIEALDNGKAYGFAKGFDVAEAAACLRYYGGWADKNHGKTIETHDKKLAFTRHEPVGVVGQIIPWNFPILMFAWKLGPALATGNTIVIKVAETTPLSAFYAARLIADIFPPGVVNIVTGYGAIAGAAISSHMKISKVAFTGSTLVGRQIMKAAAQSNLKSVTLELGGKSPNIIFDDADLEQAVSWSTFGLFFNHGQCCCAGSRIYVQESVYDKFLELLTAKVKSIKVGSPFAADTFQGPQTSQLQFDRISEHIKSGKDEGATVHIGGERHGTEGYFLQPTIFTDVKPHMRIVKEEIFGPVVVVAKFKDEADIIAQANDTMYGLAAAVFSRDVSRALNTAKQLKAGTVWVNCYNQLHSQTPFGGYKQSGIGRELGEYALANYTSVKAVHINLEQPHPL

SEQ ID NO: 704 - protein, 527 aa, Pichia fermentans
MLKFATKTSAIRASPRLFSASAIAAARFYSSLPLSQTITLPNGQTYEQPTGLFINGEFVKSQQHKTFEVIDPSTEEEITHVYEARADDVDLAVNAAHKAFHSEWSRCDPAIRGKYLFQLADLMEANKDTLAAIESMDNGKALSMAQGDVGLVVDYLRYCAGWADKLNGKLVDTGSNYFNYIKREPIGVCGQIIPWNFPLLMWSWKIGPALAAGNTVVLKTAESTPLSALYAAKLVQEAGIPKGVVNIVSGFGKITGEAISTHPKIKKVAFTGSTATGKHIMKAAAESNLKKVTLELGGKSPNIVFNDADIKKAVQNLIVGIFYNSGEVCCAGSRVFIQEGVYDQVLEEFKSAAEHLKVGNPFEDGVFQGAQTSQQQLSKILSYVDSGKKDGASLVTGGERLGSKGYFVKPTIFADVTPEMKIYSEEIFGPFAVVTKFKTADEVIEMANDSEYGLAAGIHTSSLDTATYVANKLEAGTVWINTYNDFHANMPFGGFKQSGIGREMGEAAFENYTQWKTVRIAVNDGPQ

SEQ ID NO: 705 - protein, 305 aa, Candida akabanensis
MSKYTVAALQIGASKEGTAKTLEKILSYEQELIDKKVKLVVLPEATLGGYPKGSQFGTYLGYRVPEGRKEFAEYFKQSVVVPGPEISQLEGLSSRTGATIAVGVVERGGSTLYCTIVYIDPAKGYVGKHRKLMPTATERLVWGQGDGLTLYVAESKELGKIGGGVCWENYMPLYRASFYAKGINVYVAPTVDDREIWASLIKTVAVEGRLFSISAVPYLPWEASTRELPGYTREQPINGGSLIVSPYGDVLAGPFVGAEGLLTAEVDMDIITEARYDLDPAGHYTRPDVFQLTVDERAKGTVFQN

SEQ ID NO: 706 - protein, 562 aa, Candida akabanensis
MTEISLGRYLFERLNQLRVQTIFGLPGDFNLSLLDKIYEVDGMRWAGNANELNAAYAADGYSRVKGLACLITTFGVGELSALNGVGGSYAEHVGMLHVVGVPSISSQAKQLLLHHTLGNGDFTVFHRMSNNISQTTAFISDINSAPGEIDRCIREAYVHQRPVYVGLPANLVDLAVPASLLDTPIDLSLKQNDPDAQAEVIETVLDLVSQAKNPVILVDACASRHDCRGEVAQLVNATNFPVFVTPMGKSAVNESHPRFGGVYVGTLSEPDVKEAVESADLILSVGALLSDFNTGSFSYSYKTKNIVEFHSDYTKIRQATFPGVQMKEALNNLLAHIGQRVSHYTPVAVPQKKVVPSPGANAPISQEWLWSRVSSWFREGDIIITETGTSAFGIVQSYFPDNCVGISQVLWGSIGFTVGATLGAVMGAQEIDPKKRVILFVGDGSLQLTVQEISTMVKWETAPYLFVLNNDGYTIERLIHGENATYNDIQPWDNLALLPLFKSKNYETTRVSTVGEVESLFNNAAFNENSRIRMIEVMLPRMDAPLNLVKQAEFSSKTNAEN

SEQ ID NO: 707 - protein, 524 aa, Pichia kudriavzevii; identical to SEQ ID NO: 697

SEQ ID NO: 708 - protein, 1894 aa, Leucosporidium scottii
MAYQQPSQGNQGYPHRPSDPSNPFGSSTQALGGQYSAGNSYEGGESDEYQSNQYSAEDDHRQHDGSQEGTYYRGGYNAPSSESFGPPPPSGPFQGAYDRSGADSPGGYTDYESNEQQIPLSKEEIEDVFIDLANKFGFQRDSMRNMYDHLMIQLDSRASRMSPNQALLTLHADYIGGEHANYRKWYFAAQLDLDDAIGQANSGGVGRLASQGFAQGRLVGVKRWLEMSSYDRMRQLALYLLCWGEAAQVRFVPECLCFIFKCADDYYRSPECQNRVEAVPEGLYLRAVVRPLYRFIRDQSYEVTDGAFLKRERDHEHIIGYDDVNQLFWYPEGISRIVLADKTRLVDVPAAQRFMKFDKIDWNKAFIKTYYERRSLLHLLVNFNRIWVLHISIFWMYTAYNCPNIYTSGDSKNPNPPMQWSAVALGGAVATLIMLAATLAEFSYVPTTWNNTSHLMTRFVLLLIVLALTGGPTIWIAAFDQTSNIALIVGIVQFGISVLAIVIFSVIPSGRLFGDRVAGKARKYLASQTFTASYPKLDKKARFASIMLWVLVFGCKLTESYFFLTLSFENPVRVMVGMKVQNCSDKIFGNALCRHQPAFALAIMFCMDLCLFFLDTFLWYVIWNTVYSIARSFSIGLSIWTPWKDIFERLPKRIYAKILATADMEVKYKPKVLVSQVWNAIIISMYREHLLSIDHVQRLLYHQVPSEQDGKRTLRAPMFFISQDDKGLKAEFFPPGSEAARRISFFAQSLTTAIPEPLGVDTMPTFTIIREEDQNTRVTLLEYLKQLHPVEWDNFVRDTKILAEESADLDEKADKKTDDIPFYTIGFKSAAPEYTLRTRIWASLRAQTLYRTVSGFMNYSKAIKLLYRRELERMARRKFRFVISMQRYAKFSKEEIENTEFLLRAYPDLQIAYLDEERPRKEGGEPRIFSALIDGHSEILPDGKRRPKFRVELPGNPILGDGKSDNQNHAIIFHRGEYLQLIDANQDNYLEECLKIRNVLGEFEDYHVSSKSPYSPEGAKEFSKDPIAIVGAREYIFSENIGILGDVAAGKEQTFGTLAARSMAYTGGKLHYGHPDFLNAIFMTTRGGVSKAQKGLHLNEDIYAGMNAFGRGGKIKHTEYYQCGKGRDLGFGTILNFQTKIGTGMGEQMLSREYYYLGTQLPMDRFLTFYYGHPGFHINNILVILSVQLFMFALVFLGTLNKELTICKYTSDGQFVGGQGGCYNLVPVYDWIKRCIISIFIVFFIAFLPLFLQELTERGVIRAVIRLGKHFLSLSPVFEVFGTQISSHSILSNLTYGGARYIATGRGFATTRISFAILFSRFAGPSIYLGLRTLLLLLYVTLTLWIYHLIYFWISIMALCIAPFIFNPHQFSLGDFIIDYREYLRWMSRGNSRAHANSWIGYCRLSRTKITGFKKKKMGHPSEKLSTDVPRVGWKVIVVNEICAPLALAAILTVAYLFVKSFASPSINSLLRIAVISLGPIVFNAVLLIAIFFISLLAGPLLGNCCGNFGSVMAGIAHLGSVVGMVAFFEFLWVLERWNISHAVLGMIATMAIQRAIFKILISVFLSREFKHDETNRAWWTGRWWNRGLGGAAWSQPVREFVVKIVEMSLFAADFLAGHLLLFLLTPPCLIPGIDTMHSTMLFWLRPSKQIRSPIFSFKQRALRRKIIFKYGILYACVFAFFAALIVLPIVFEHSITLDNCSVCDNRAADLRSMPRPSLSAALLVVLALALSSTTNALPARHGKSLEPFGVVVSPKNGFLLDPRDSLHFQYALAHPAASVTVQLISYDPFVQTELGEEEASVTLAEFLVTDPRHHRGYIDVWLGIPVDDLARPYDGKTFKLLVTESEVDFAPGKSFAESPFIKIQPKEGSEAFNSAQLLDQADKSREGLAAHYP

SEQ ID NO: 709 - protein, 234 aa, Leucosporidium scottii
MSAPALDNRTELVYMGRIAEQSERYDEMVQYMKDVAKLGVELTVEERNLLSVSYKNVIGARRASWRIISSIEQKEESKGNESQVAKIKEYRQKVEAELSDVCNDILKVLDEHLIPAAQAGESKVFYHKMKGDYHRYLADSPPTHPIRLGLALNFSVFYYEILNSPEKACSLAKLAFDDAIAELDTLSEESYKDSTLIMQLLRDNLTLWTSDLNEAADAEPEKTEEAAPAPAPEA

SEQ ID NO: 710 - protein, 261 aa, Pichia fermentans
MSLSREDSVYLAKLAEQAERYEEMVENMKAVASCGQELSIEERNLLSVAYKNVIGARRASWRIVSSIEQKEEQKGNESQVKLIRDYRSKIELELSNICDDILNVLNEHLIPTAQSGESKVFYYKMKGDYHRYLAEFAVAEKRKDAADASLEAYKAASEVAVTELPPTHPIRLGLALNFSVFYYEILNSPDKACHLAKQAFDDAIAELDTLSEESYKDSTLIMQLLRDNLTLWTSDMSEAGQEDSNAQAAQPQAAAPEKQEE

SEQ ID NO: 711 - protein, 327 aa, Pichia fermentans
MTNKETRNNIKIVAANSHPELAKAIATKLNLPLSKIEAIQFENQESAVVVQDSVRDEDVYIIQTGCGGYEKLNDYLMELLLMVHACTQASARSITAVIPNFPYARQDRKDKSRVPISAKLIANLLTTAGCTHVITMDLHASQIQGFFSIPVDNLYAEPNVLKWIQDNYKNTEDVMMVSPDAGGAKRVASLADKLDTQFALIHKERAKANEVSRMVLVGDVKDKSCILVDDMADTCGTLCKASDILLAEGAKEVIAIVTHGIFSGNAIERLNKSSLKKIICTNSMPLAQHVQDCAILEILDISPTLAEAIRRLHNGESISYLFNNVAV

SEQ ID NO: 712 - protein, 320 aa, Pichia fermentans
MSANSIKLLAPDIDRGLAELVAKRLGLPLTPVEFKRDSNKEVLFSIGESIRDEDIYVIMQIGAGPVNDKVFELLVMLNACRAASARRITAVLPNFPYARQDRKDKSRAPITAKLMADMLTTAGCDHVITMDLHASQIQGFFDSPVDNLYAEPSVVRYIKDKIDIGNAIIISPDAGGAKRAAGLADQLDLNFALIHKERARANEVSRMVLVGDVTDKICIIVDDMADTCGTLAKAANVLLDNGAKSVIAIVTHGILSGKAIENINNSRLERVVCTNTVPFESKLLQCPKLDTLDISGVLAEAIRRLHNGESISFLFKNAPY

SEQ ID NO: 713 - protein, 261 aa, Pichia fermentans; identical to SEQ ID NO: 710

SEQ ID NO: 714 - protein, 1871 aa, Pichia fermentans
MSYDDNYDPNRANQGYYDQGYYEQGPGQAQGDQGQSQRGYYDESQQPQQQYPQDPYYGNPQEYDQQQFNQPPPQQGGYYDQQNPNDAETYSDFSYGAGNMPGTPYDNGGNYNQGYGANYTPSQMSYGDARDSGASTPYYGAGGMNGMYDQGMIALPTDPYPAWTADNQAPVTIEQIEDVFIDLCNKFGFQRDSMRNMFDYFMVLLDSRSSRMTPAQALLSLHADYIGGDSANYKKWYFAAQMDVDDRVGFANIDLGKIKKSKKKSKKSIFKRKKKDDNLEVDNPDQVLNEIEGDDSLEAGDFRWKSTMNKTTAIEKVQQIALYLLVWGEANQVRFTPECLCFIYKCAADYLKSDACQNRVDPIPEGDYLNRIITPLYRFLRDQVYEIADGRFVKREKDHNKIVGYDDVNQLFWYPQGMARMYVGETRLIDLPQEERYLQLGEIDWNSTFVKTYKETRTWLHVITNFNRIWVFHISIYWMYCAYNSPTLYTHNYVQVLNNQPLASSRWASAALGGAVASFINIMATLFEWMYVPRSWAGAQHLTRRLIFLLILFGINIGPVIFVFAYAGLTTVSTAALAVSIVMFFFAVGTVVYLTIMPLGGLFTSYMKGSSRRYLAQQTFTASFYQLEGLDRYLSYMVWITVFAAKFSESYYFLILSIRDPIRNLSTMTMRCHGEQWWGDVLCKQQAKIVLGLMYATDMLLFFLDTYMWYILVNTIFSVGRSFYLGISILTPWRNIFSRLPKRIYSKVLATTDMEIKYKPKVLISQVWNAIVISMYREHLLAIDHVQKLLYHQVPSEIEGKRTLRAPTFFVSQDDNNFATEFFPKDSEAERRISFFAQSLATPIPEPLPVDNMPTFTVFTPHYSEKILLSLKEIIREDDQFSRVTLLEYLKQLHPIEWDCFVKDTKILAEETVAFEDEKDDDVKQEIDDLPFYCIGFKSAAPEYTLRTRIWASLRSQTLYRTVSGFMNYARAIKLLYRVENPEIVQMFGGNAEGLERELERMARRKFKFVVAMQRLAKFKKEELENAEFLLRAYPDLQIAYLDEEPPLEEGGEPRIYSALIDGHCEIMPNERRRPKFRVQISGNPILGDGKSDNQNHAVIFSRGEYLQLIDANQDNYLEECLKIRSVLAEFEELNETAKVTHPVAIVGAREYIFSENAGILGDIAAGKEQTFGTLFSRTLAQIGGKLHYGHPDFLNAIYMLTRGGVSKAQKGLHLNEDIYAGMTALCRGGRIKHCEYYQCGKGRDLGFGSILNFTTKIGAGMGEQMLSREYYYLGTQLPLDRFFSFYYAHLGFHINNLFISVSLQMFMLTLVNINSLAHESIICIYDKNKPITDVVYPLGCYNLMPTIDWIRRYTLSIFIVFFISFVPLLVQELIERGIWKMAYRFARHFSSLSPLFEVFVAQVYSTALVNDVAIGGARYIATGRGFATSRIPFSVLYSRFAEGTIYVGARCVIMLLFGTIAHWQPALLWFWTIIVALMFSPFVFNPHQFSWEDFFIDYRDYIRWLSRGNTKWHRNSWIGYVRLARSRVTGFKRKTIGDQSESAAGDAPRAHRSTVLMSDTIPCAIYTAGLFVAYTYINAQTGVRDAKLVNATLRLIICALAPIVIDIGVLFGCLGFSCCSGPLFGMCCKRTGAVMAGVAHGIAVVIHLVFYVVMWVLEGFHFARMLIGLITMIYVQRLIFKCMTLFLLTREFKNDHSNVAFWTGKWYGSGLGIAAWTQPSREFCAKIIELSHFSGDFVLGHILLFLQFPLVCIPYVDRWHSMMLFWLKPNRQIRPPIYSLKQARLRKRMIKKYSVLFYTIMVIFIALIAAPAVVGSLKGVDIHATAEFPSFADGLFQPRHQDNNDTGFGSGSYHPRWTTTTSLVTFSTKK

SEQ ID NO: 715 - protein, 730 aa, Pichia fermentans
MSYDDNYDPNRANQGYYDQGYYEQGPGQAQGDQGQSQRGYYDESQQPQQQYPQDPYYGNPQEYDQQQFNQPPPQQGGYYDQQNPNDAETYSDFSYGAGNMPGTPYDNGGNYNQGYGANYTPSQMSYGDARDSGASTPYYGAGGMNGMYDQGMIALPTDPYPAWTADNQAPVTIEQIEDVFIDLCNKFGFQRDSMRNMFDYFMVLLDSRSSRMTPAQALLSLHADYIGGDSANYKKWYFAAQMDVDDRVGFANIDLGKIKKSKKKSKKSIFKRKKKDDNLEVDNPDQVLNEIEGDDSLEAGDFRWKSTMNKTTAIEKVQQIALYLLVWGEANQVRFTPECLCFIYKCAADYLKSDACQNRVDPIPEGDYLNRIITPLYRFLRDQVYEIADGRFVKREKDHNKIVGYDDVNQLFWYPQGMARMYVGETRLIDLPQEERYLQLGEIDWNSTFVKTYKETRTWLHVITNFNRIWVFHISIYWMYCAYNSPTLYTHNYVQVLNNQPLASSRWASAALGGAVASFINIMATLFEWMYVPRSWAGAQHLTRRLIFLLILFGINIGPVIFVFAYAGLTTVSTAALAVSIVMFFFAVGTVVYLTIMPLGGLFTSYMKGSSRRYLAQQTFTASFYQLEGLDRYLSYMVWITVFAAKFSESYYFLILSIRDPIRNLSTMTMRCHGEQWWGDVLCKQQAKIVLGLMYATDMLLFFLDTYMWYILVNTIFSVGRSFYLGFGNH

SEQ ID NO: 716 - protein, 725 aa, Pichia fermentans
MAPRNLTSRAPLPGHSNTNSNTNSELSDENLNFENPFSQDNDTDSSHIHLPYGNQEYEDSTSSGNSNTHLNQTGRFNTSSASPEIKQHPLNPNGGNGNPGSFRNSSTSSSSLLNPFSSSNRLSTLANETSKTPEYGRYPKNLSGSRINSMHSLNGKHPYNISSTDNENENDDSNSNSDRSSNPFMVDPDFSPFGGYPTSSFPLMIDEKEDDDYLHNPDPIEDAKYQKHRMWNDLKTMDKRSSTTLFGLLFFFLGAMALFVVLPALTFTHAVHHTVPVKGGSTGSNAFYGPAGSNAEYTKNGTIVLTEYLYPQLSAIRTSLVDPDTPEQYHTRTAKDGSDWKLVFSDEFAAEGRTFYEGDDQFWYAPDFHYDATKDLEWYDPDAVTTANGTVNMRMDAFMNHNLYYRSGMLHSWNRMCFTQGVMEVSARLPNYGNITGLWPGMWAMGNLGRPGYMASTDGVWPYSYDTCDAGITFNQSSPDGINYLPGQRLNSCTCPGDDHPNPGTGRGAPEIDILEGEVDTNIRVGVASQSMQIAPMDIWYIPDYNWVEIHNASVTTMNTYAGGPFQQAVSGITTLNTDWYNRGVGERYFQKYAFEYLNDNNDGYVRWFVGDNPTFTVHANALAPNGNIGWRRISKEPMSMIINMGISKNWAYIDFPSIDFPVTLEVDSVRIYQPSDQINVSCDPEDYPTYDYINEHPLAYNIWNYTLWNQTGYSIPKNTLVGCK

SEQ ID NO: 717 - protein, 1218 aa, Yarrowia lipolytica
MEQEKTVPVDMNVPHKNSVSLKIGLIGDAQIGKTSLMVKYAEGNFDEDYVQTLGVNFMEKTVSIRDTEITFLIWDLGGQREFVNMLPLVSNDSVAILFMFDLTRKSTLNSVKEWYRQARGFNKTAIPFLVGTKYDLFVQLPKEDQEEITQQAKKFAKAMKASLIFCSTSHSINVQKIFKIVLSKAFDLKLTIPEITNTGEPILVYQVSYQRPNPNPFEGERLSDSDHEGYNDTGHPNLSNPHLNQDTSYNPSYNYTPNTSAPLPLNRTPSGNHYEDPSEYGYHGNTSNLYQMDSLTPNHTINDFHEHEGDITRASFQNDDDRVPLRDETAYHGYQGPFVSENEHHNAQQAPLPYPYPHQQHHEIHHAESTTALPQGEQIGGEGEFIGDVSNGTPEPSYNTIPEDGTLNEYHDGVYAGQPGYPSSDFDPNFPNYPGSDGRTTSLLSTGSDGWQKRQQVNLKRFPTRKVKLAKGAVFSTEYPVPSAIKNSILPEYIDAETGRTEFTHMRYTAATCDPDDFTLENGYKLRAHTYGRQTELLIAITYYNEDKVLTARTMYGIMQNVRDICRLKKSEFWKSGGTEPWQKIVVSLVFDGIDPCDKEVLDMLATIGLYQDGVMKKDIDGKETVAHIFEYTTQLCVTPKQQLVKPTSNDPMSLPPIQMIFCLKQKNSKKINSHRWLFNAFGKILQPEIFILLDAGTKPGPKSILYLWESFYNNKNVGGACGEIHAMLGKGHRKLLNPLVAAQNFEYKISNILDKPLESSFGYVSVLPGAFSAYRYSAVEGRPLEQYFHGDHTLGSRLGKKGIDGMSIFRKNMFLAEDRILCFEVTFKAGCKWHLAYIKQSKAETDVPEAIDEFIGQRRRWLNGSFAATLYSVAHFPPNLPEIYNLVNLVLSWFSLASYFLTTTVIMDLAANPRKYGGDENSHGFPFGDTASPIISLILKYLYCACLVISFILALGNRPKGSKTTYYIMVCIFGCIQIYVLVISFWLAANAFIDNKITSASDFFSDFFDSITGLIVVALASTYGLYFISGILYLDPWHCIHSFPQYMFFMQSFVNILNVFAFCNWHDVSWGTKGSDKADALPSVQSKKNKEDGEDEAVIEEADKPQKDIDMQFQQVVKRALTPYKPPPPEKGLSRDDENRNFRTNLVIVWLITNGALAIGVTSQSIHAFGIDASQTTKTAYFFGALLWSTAVVALIRFIGCLYFVIKSTFKRLIAKR

SEQ ID NO: 718 - protein, 640 aa, Yarrowia lipolytica
MPTKKPIFTNYSGIFGYINYLVPKTRGQILNTLIEGLQRQEYRGYDSAGLAIDADADGTVDIYREVGKVAALRKLIEASDANTEELFDVHAGIAHTRWATHGQPQRKNCHPQRSDPNNEFTVVHNGIITNYRELKALLTSKGIQFGFIYDQNKDQDLDFSQLAKLVVVELEGAYGLLIKSTHFPDEIVATRKGSPLLVGVKTEKKLKVDFVDVEFPDMAVQTEAPTAAGSNSLQLGVPGSDALRHSQSRAFLSDDGVPMASEFFLASDPAAVVEHTKKVLFLEDDDIAHIYDGELHIHRTLEMELNQIMKGEFDHFMQKEIFEQPESIVNTMRGRIDFEAKTVQLGGLRTWLTTIRRCRRLIMIACGTSYHSCLAVRSIFEELTEIPVSVELASDFLDRRSPVFRDDVCVFVSQSGETADSLLALQYCIDRGALTVGITHCGVHINAGPEIGVASTKAYTSQYTALVLFALSLSDDSIHKKERREAIIDGLSKISEQISEVLKLNDSIKQMCDEVLCEQKSLLLLGRGYQHATALEGALKIKEISYMHSEGVLAGELKHGVLALVMSAVEQVVARSGNPIIICNKGDKTMDKFSDGKFKTIELPSTVDCLQGLLNVIPLQLIEALMSTSPRNLAKSVTVE

SEQ ID NO: 719 - protein, 260 aa, Yarrowia lipolytica
MSSETFLARLCEQADRYDEMVNYMKDVAKSGEELTVDERNLLSVAYKNVIGARRASWRVIFPIEQKEEAKGATHHLELLKTYRAKIEAELEDICSDAENAESKVFYYKMKGDYHRYLAEFTSGEKRKEAATAAHESYKSATDVAQTELSSTHPIRLGLALNFSVFYYEILNSPDRACHLAKQAFDDAIAELDTLSEESFRDSTVIMQLLRDNLTLWKNDLEESLQAQQSEETPATDAAAASTEAAAPKEEAKPAAEEPKE

SEQ ID NO: 720 - protein, 319 aa, Yarrowia lipolytica
MSSNSIKLLAGNSHPALFKLVSERLGVPLSNIGVFQFSNLETSVTIGESVRDEDVFVLQTGCGEVNDFLMELLIIIHACKTASARRITAVIPNFPYARQDKKDKSRAPITAKLMANMLQTAGCDHVITMDLHASQIQGFFNVPVDNLYSEPSTLRYIREHVDVSSAVIVSPDAGGAKRAAALADRLDLNFALIHKERQRANEVSRMVLVGDVKGMTCVLVDDMADTCGTLAKAAQTLKENGARDVIAIVTHGILSGPAVQRINDSELLKVVCTNTVPHDHLKAECPKLDTIDVSPTLAEAIRRLHNGESVSYLFRNAPM

SEQ ID NO: 721 - protein, 263 aa, Yarrowia lipolytica
MLSVDLFVTREDNIYLARLSEQAGRYEDMVEYMKEIATGDQELSVEERNLLSVAYKNVIGAHRAWWRVVSSCEQKEEQKGKETKIIDDFRQKIEAGLQDICHDILNVLEKHLIPKLEKPSAEATEAAAKDGADPSELSESIVFYYKMKGDYYRYLAEFTTDDKRKEAAEKSLQAYQFASDEATSKLPPTHHIRLGLALNFSVFYYEILNSPERACQLAKQAFDDAIADIDSITEERSKDYALIMQLLRDNLTLWTNNDEPEQA

SEQ ID NO: 722 - protein, 463 aa, Yarrowia lipolytica
MRNLTGEPENPFDQQSYQSSDERSHGSGDYLYPENDSYHDVTSQTDTPNPSGTEHLMPQVPSRATKPYFDSNHDGASSRQHLVDRSSSSGSLAGMGGSMTPNGFDRYPDRISSVNIRSATASEVGSISENDDNPFVVNADFSPFGGYPASSFPLHIDEKEQDDYLHNPDPVLDQEMDKRCQCQKMDRRGISSLIAFILLIGGLIVVFIVLPILTYSGVTERVAHPVVHREVEVLSAYQFPQLSFRKELVDPDTPSSAMTHTADDGSKWDLVFSDEFNMEGRTFYPNDDPFWTAVDIHYAATKDLEWYDPDAAITENGTLVLQLDAFKSHDLYYRSGMVQSWNKVCFTQGYIEISASLPGQGRTPGLWPGLWTMGNLGRPGYLSTTDGVWPYGYNSCDAGITPNQSSTDGISYLPGQRLNKCTCKGEEHPNPGTGRGAPEIDALEGSVGPKVGVASQSLQVAPL

SEQ ID NO: 723 - protein, 159 aa, Yarrowia lipolytica
MNTYAGGMFQQAISGITMLNNDWYDVVSVEGQDESELHYQTFGFEYLNDDDKGYIKWFVGQDPTFNLHGYALGPNGNVGRRDISKEPMSIIMNLGLSNSWTYIDWPALNFPSKLRIDYVRIYQPSDQHSITCDPDDYPTYDYIEKHKNAYENANLTLCT

SEQ ID NO: 724 - protein, 845 aa, Yarrowia lipolytica
MAVKAATAPVAPATPPSLQKPCRQLQLSYDYNYDYQQPGQQGGDGQHNGQNQQHPGQQEYYDDYYDDGYGNQYGAQEGYQEGVDQHGNPYQHDPHAGVAAATSGGYRNVKDDGSETFSDFTEQNGQGYNQYNQGYNQGQYNQGYQGQYNQGYGGYDQYGQYNDASQISFRSSGASTPIYGLDYAASQQGIGAGSGHSREPYPRLEEIEDVFIDLTNKFGFQRDSMRNMYDFLMALLSLHADYIGGDNANYRKWYFAAQLDLDDDIGFRNMKLGKTNKRTRKARKKFRKEMQDPDADPAKTLEEIEGDNSLEAAEYRWKTKMNALSPLERVRHIALWLLCWGEANQVRFTPECLCFIFKCADDYYTSAECQQRVEPVEEGDYLNRIITPLYRFIRGQGYEIFDGKFVKRERDHNKVIGYDDVNQLFWYPEGIERITFEDESRLVDVPQSERYMKLGDVIWDKVFFKTYKETRSWFHVFVNFNRIWIIHVTFYWYYASFNSPTLYMKNYVPTLDNHPPPACKWGAGAIGGVIATGLQIIATLSEWAFVPRKWAGAQHLTRRLMFLIGILIVNLVAPVYVLGVVGTTHESTSALAVGIVGFIISIFTFIFFSIMPLGGLFTSYMKKSTRRYVASQTFTNSYPRLEFHDKIMSYLLWVCVFGAKLSESYYFLILSLRDPIRDLSQMKMRCFGEKWFGVEYHDALCKVQPQITLGLMYATDLILFFLDTYLWYIICNTIFSVARSFYLGISIWTPWRNIFSRLPKRIYSKILATTDMEIKYKPKVLISQIWNAIVISMYREHLLAIEHVQKLLYHQVPSEVEGKRTLRAPTFFITQDDHAFETEFFPPKL

SEQ ID NO: 725 - protein, 974 aa, Yarrowia lipolytica
MPTFSVLVPHYSEKILLSLREIIREDDQFSRQLHPVEWDCFVKDTKILAEETAGFGEGSNDDLAEKDSDEVKAKIDDLPFYCIGFKSAAPEYTLSNSNLGFSPIPDSVPNCLLYRVENPEVVQMFGGNTEKLERELERMARRKFKFIVSMQRLTKFKPDEMENTEARSPRLFSALIDGHCEILENGRRRPKFRIQLSGNPILGDGKSDNQNHALIFHRGEYIQLIDANQDNYLEECLKIRSVLAEFEELNVENVNMSPYTPGCQQQDPLSQYIFSENIGILGDIAAGKEQTFGTLFARTLAQIGGKLHYGHPDFLNSIFMCTRGGVSKAQKGLHLNEDIYAGMNALLRGGRIKHCEYYQCGKGRDLGFGSILNFTTKIGTGMGEQMLSREYYYLGTQLPLDRFLSFFYAHPGFHINNLLIITSVQMFMIVMMSIGPLAHETKETICWYDKDKPITDPQTPVGCYNLKPVLDWIRRCVLSIFIVFFISFVPLVVQELTERGVFRAAFRFARHFMSLSPLFEVFVCQVYANSFINDLAFGGARYIATGRGFATARLPFSVLYSRFAGDSIYLGARSTLMLLFGTIAMWQAALLWFWVTLIAMCISPFVFNPHQFAWTDFFIDYRDFIRWLSRGNAKWHKNSWIGYVRLTRTRITGYKRKVLGDESEKGAGDLSRAGISNVFITEIFLPLIVAAFCFCGFTFINAQTVICAIGPIVINAGLLLVLVCISCCAGPMLGLCCKKTGPVMAGIAHGIAVIIHLIFFELMWFFEGWSFVKGLCGTVTAIAIMRLIFNILTILCLTREFKHDHANQAWWTEFVCKLIEMSLFAGDFYLGHWLLFFQLPVLCVPYIDKWHSMMLFWLRPSRQIRPPIFSLKQNQLRKRIVKKYATLYFIILIIFLVVLIAPASLAGGKADNDSIQDTNILKGLIQVRSQNQNDTGRCSTGNGTECLLPTTGSWSTHVWWTFTPSHTTSYSTKP

SEQ ID NO: 726 - protein, 624 aa, Leucosporidium scottii
MAADSKQQEAVGADLHDYRSAPTHPISKRTDGSSKDHHTPHANTEQYETMYKESITQPEVFWDKMAKEHILLAPSLLDRYGGLVRGWRRSMVPRGRTQRILQLRRPLGVQALPTRPPSSGRPTSPDKRVELTYEQLLQEVRKTANILKSYGVKKGDTVAIYLPMVPEAAIAFLACARLGAIHSVVFAGFSAESLRDRVQDAKSRVVITTDEGKRGGKSIATKSIVDAALTECPLVEHVLVLKRTGGNVKWTEGRDKWWHEEKEGVQPYCAPEIVSSEDPLFILYTSGSTGKPKGVVHSSGGYLLGALMTLKYVFDVHHDDRYACMADVGWITGHTYIVYGPLANGVTTTIFESTPVYPTPSRFWETVAKHKLTQFYTAPTAIRLLRRLGEQHTKGHDLSTLRTIGSTETGSIIITPLPGATKTKPGAATLPFFGIEPVLLDPTTGTLIEGNEKEGVLAVKRPWPSIARTVYGDHKRFLETYMTPYPGYYFTGDGAGRDHDGYYWIRGRVDDVINVSGHRLSTAEIESALIQHNGVAETAVVGIPDELTGQAVVAYVTMKPDFSFDSSEEPALLKELVLQVRKTIGPFAAPKRIVLVVDLPKYQVGKDHAPVVDQIQSKFAEGSK

SEQ ID NO: 727 - protein, 164 aa, Leucosporidium scottii
MAIPKESRIKVEKPLVELDGDEMTRVIWAKIRNELITPFLDIDLKYYDLGLEYRDQTDDQVTIDAANAILEYGVGVRCATITPDEARVEEFKLKKMWKSPNGTIRNILGGTVFREPIIVKKVPKSVPGWVKPIIVGRHAFGDQYRATDIIIPEAGKLEPRLHPR

SEQ ID NO: 728 - protein, 345 aa, Leucosporidium scottii
MLSAARMSLGRRAFSSSARSNVHVAVLGAAGGIGQPLSLLLKQNPLVTKLTLFDIRGSPGVAADLSHVNSPAEVIGYAPEQDGLKKALKGAEVIIIPAGMPRKPGMTRDDLFNTNASIVRDLAAAAAETAPNARIGIIANPVNSTVPIVAEVFKKAGVYDPKRLFGVTTLDVVRSSTFLSGLAGTAPKDTDVPVVGGHSGATIVPILSQTAEGKKIVEAGGEGLAALVKRIQFGGDEVVKAKDGAGSATLSMAYAGAEFTDAILRALNGEKDVTLCTYVESPLYADKGVTFFSSPVTLGSDGTVAKINPVGALHPTEEKLLEACLPDLAKNIAAGVKFVEANPPQ

SEQ ID NO: 729 - protein, 435 aa, Leucosporidium scottii
MPGLTDRRVEITGPVDRKMVINALNSGAATFMADFEDSNSPTWANNLDGQVNLRDAVRRTITFKNPGADGKEYKLNDKIAQLIVRARGWHLDEPHITVDGQAMSGSIFDFGLFFFHNAAELLARGQEPLLLHHLEARLWNDIFRMAQDLLNIRRGSIRATCLIETITAAFQMDEIIYELREHSSGLNCGRWDYIFSFIKKMRFNPDFVLPDRSNVAMTVPFMDAYVRLLIKTCHKRGVAAIGGMSAQIPIKNDPKRNDAAIAKVRADKEREVAAGHDGTWVAHPALVKVALEIFDKGMTGPNQYHIRREEVKVTALDLLNTNVPGGITEAGVRSNCMALLHYCANWVGGLGCVPVDFMMEDAATAEISRCQLWSWVYHGSSTVEGKKITTTYVDKILDEETAKCKKTGLDSKRVELSASDLTPHLDEYSSPSAKL

SEQ ID NO: 730 - protein, 622 aa, Leucosporidium scottii
MLARITGRAPKATSPRRFLLPSPASTTLSSTSTMLSSSEPEELDFVLLSDLLRPVSRLPASPSFSPTRSHTVAAQGGINAALGNMTEDDWRWHAYDTVKGSDWLGDQDAIHYMCREAPNSVLELEHYGLPFSRQAYRRAAAADRTGHAMLHTLYGQSLRHNTEYFIEYFATDLIMEDGECVGVMAYNQEDGTLHRFRAHKTVLATGGYGRAYFSCTSAHTCSGDGAGMVARAGLPLQDLEFVQFHPTGIYGAGCLITEGSRGEGGYLLNSEGERFMERYAPTAKDLASRDVVSRSMTVEIREGRGVGPEKDHCYLQLSHLPPDVLHERLPGISETAAIFAGVDVTKEPIPVLPTVHYNMGGIPTKYTGEVLTVDENGQDKVVPGLYAAGEAACVSVHGANRLGANSLLDIVVFGRACAHHIAENLKPGMPHKKISEDAGMDSVRSLDEVRTSNGPKHTSEIRLDMQKAMQNDAAVFRTQDSLEHGVKELSRVLSTWKDVGIKDRSMIWNSDLVETLELRNLLTCADQTIVSAEARKESRGAHAREDFPDRDDEKWMRHSVSFQKDINTDKVRLAYRGVTATTLDEAEMKPIPPFVRLLLIEDDDHGDLLGVERLRVCFMYRC

SEQ ID NO: 731 - protein, 670 aa, Pichia fermentans
MSEKHLENEHLMNIEAHEVPKGFLDRHPSKPYLQSLGEYEKMYKESIESPATFFGKMAKDNLSWSKPFTTAKLPEAPHLKDNNGEPSAWFVDGELNACYNCVDRWAIKNPNKPAIIYEADEPNEGRIITFGELLKDICKFAQVLKSLGVKKGDTVAVYLPMIPEAIVALMAIVRIGAIHSVVFAGFSSTSLKDRVLDANSKIVITTDESKRGGKIIETKKIVDDALIHCPDVTNVVVFKRTGNSHIPWNSKRDVWWHEEVIKYGSYTPPEPMNSEDPLFLLYTSGSTGKPKGILHTTAGYLLGAMLTTKYVFDVHPEDTLFTAGDVGWITGHSYVVYGPLLNGAATVVFEGTPAYPNFSRYWEIVDKYKVNQFYVAPTALRLLKRAGEKYIANYKLDSLRVLGSVGEPIAKDVWEWYNEFIGRGQAHICDTYWQTESGSHLICPLAGVTPTKAGSASLPFFGIEPAICDPVTGEELPGNNVEGVLCVKTSWPSITRSIWNDYNRYLDTYLKPYHGYYFSGDGAARDKDGFYWILGRVDDVVNVSGHRLSTAEIEAALIEHPLVSENAVVGYPDELTGSAVAAFVSLKKEVDDVAAVKKELILTVRKEIGPFAAPKLILLVEDLPKTRSGKIMRRILRKVLAGEEDQLGDISTLSNPEVVAQIIDVVHAMK

SEQ ID NO: 732 - protein, 674 aa, Pichia fermentans
MTAPTHSVVHEANGVVARPTPQPFFEKQPAKSLSSKEEYDAMYKQSIEDPEGFFGPMAKQFLSWDKDFTKVKSGTLQNGDAAWFLGGELNACYNCVDRHAFANPDKVAIVFEADDESENKKITFGELLREVSQVAGVLKSWGVRKGDTVAIYLPMTPEAIIAMLACARLGAVHSVIFAGFSAGSIKERVTDAQSKILITTDEGKRGGKTINNKKIVDEALKECPSIEKVLVYKRTGSDKIYMQEGRDFYWQDVAAEFPGYCPPVSVNAEDPLFMLYTSGSTGAPKGVVHCTGGYLLGAAMTTKYVFDLQPEDVLFTAGDVGWITGHSYALYGPLSLGVSTIIFEGTPAYPNFGRFWRIIEQNKATHFYVAPTALRMLKKSGEDEIAKYDLSSLRTLGSVGEPIASEIWQWYDEKIGHGCCHISDTYWQTESGAHLIAPLAGAVPTKPGAATLPFFGIDAVIIDPTTGKVLEGNDVEGVLAVKNTWPSMARTVYKNHKRFMETYLKPYPGYYFTGDGAGRDHDGYYWIRGRVDDVVNVSGHRLSTAEIEAVLLEDSARVSDAAVVGVNDDITGQAVIAFVQLKDNSIITDDATMLKLRQDLRLSIRATIGPFAAPKTIIIVDDLPKTRSGKIVRRVLRKIVSGEAKGLGDQSTLANAEVIEPIIVAVEKQYGVKN

SEQ ID NO: 733 - protein, 351 aa, Pichia fermentans
MSNFEIPETQKGCIFYENGGPIEYKDIPVPKPKPTEILIKVLYSGVCHTDLHAWKGDWPLAVKLPLVGGHEGAGVVVAKGENVTSFEIGDYAGIKWLNGSCMGCEFCMQGAEPNCAKADLSGYTHDGSFQQYATADAIQAAHIPKGTDLAGIAPILCAGVTVYKALKTADLRAGQWVAISGAGGGLGSLAIQYAKAMGLRVLAIDGGDDKDKLCKSLGAEVFIDFMKTKDIVADIVKATDGGAHGVINVSVSEKAIAQSCQYARTLGKVVLVGLPAGAKINTPVFDAVVKSIEIKGSYVGNREDTAEALDFYIRGLVHSPFKVQGLSELPQVFDDMAQGKILGRVVLDTSK

SEQ ID NO: 734 - protein, 527 aa, Pichia fermentans; identical to SEQ ID NO: 704

SEQ ID NO: 735 - protein, 376 aa, Pichia fermentans
MFSRTLTINKQAIKNNQRFFLRGVASAAPSIPKTQKGVIFYENGGELQYKDIPVPEPKANEILINVKFSGVCHTDLHAWKGDWPLATKLPLVGGHEGAGVVVAKGENVTNFEIGDLAGIKWLNSSCMGCEFCQQGAEPNCPRADLSGYTHDGSFQQYATADAIQAAPIPKGTDLAHVAPILCAGITVYKALKTANLRPGQWVAISGAAGGLGSLAVQYAKAMGLRVLGIDGGKEKGEFVKSMGGEVFIDYTKSSDIVKDIQEATNGGPHGVINVSVSPAAISQSTKYVRTLGKVILVGLPANAICESSVFEHVIKSIQIKGSYVGNREDTTEAIDFFTRGLVKSPIKVVGLSDLPKIYELMEQGKILGRYVVDTSF

SEQ ID NO: 736 - protein, 377 aa, Pichia fermentans
MLRTAFRRQALRAVRFQSTTTPVFTIPEKQMGVIFETHGGPLEYKELPVPKPKPTEILINVKYSGVCHTDLHAWKGDWPLAAKLPLVGGHEGAGVVVAKGSAVTNFEIGDLAGIKWLNGSCMSCEFCEQGDESNCEFADLSGYTHDGSFQQYATADAIQAAKIPVGTDLANVAPILCAGVTVYKALKTAQLRAGQWVAISGAAGGLGSLAVQYAKAMGLRVIGIDGGEGKKELFEACGGDVFIDFTKYPRDAPEQMNKDIKAASNGLGPHGVINVSVSPTAISQSCEYVRATGKIVLVGMPAGAVCKSDVFQHVVKSLQIKGSYVGNRQDTREALEFYIDGKVKSPIKVVGLSKLPEIYELMEQGKILGRYVVDTSK

SEQ ID NO: 737 - protein, 376 aa, Pichia fermentans
MFSRTITINKQAIKNNHRFFLRGIASAAPSIPKTQKAVIFYENGGELQYKDIPVPQPKPNEILINVKFSGVCHTDVHAWKGDWPLATKLPLIGGHEGAGVVVAKGENVTNFEIGDLAGIKWLYSSCMGCEFCQQGAEPNCPKANISGYTHDGSFQQYATADAVQAAHIPKGTDLAHIAPILCAGITVYKALKTADLRPGQWVAISGAAGGLGSLAVQYAKAMGLRVLGIDGGTEKGEFVKSMGGEVFIDYTKSSNIVKDIQDATNGGPHGVINVSVSPAAISQSTKYVRTLGKVILVGTPTDAICESSVFEHVIKSIQIKGSCVGNREDTAEAIDFVTRGLVKSPIKVVGLSDLPKVYELLEQGKILGRYVVDTSF

SEQ ID NO: 738 - protein, 411 aa, Pichia fermentans
MAFEKITVKTPVVEMDGDEMTRIIWKMIKDELILPFLDIDLKYYDLGIEYRDQTDDKVTVESAEATKKYGVAIKCATITPDEARVEEFGLKKMWLSPNGTIRNILGGTVFREPIIIENIPRIIQHWEKPIVIGRHAFGDQYKCQNIVTPECGGDLKLVFTPKDGSAAIEVPVYHYDGKGCALAMYNTEESIIGFATASFELAVSRKLPLYMSTKNTILKQYDGLFKDTFERIYEESYKTKFEELGIWYEHRLIDDMVAQMVKSKGGYIIAMKNYDGDVESDIVAQGFGSLGLMTSVLVSADGKSFEAEAAHGTVTRHYRQHQQGKETSTNSIASIFAWSRGLLKRGELDETPAVVQFAETLEKATIDTVKVDGIMTKDLALARGETDRSSYVTTGEFIEAVGKRLTKELGA

SEQ ID NO: 739 - protein, 445 aa, Pichia fermentans
MFSAAARAQARLSSIHRHFSTSVSVGAETISKIKVKNPIVELDGDEMTRIIWSDIKSKLILPYLDVDLKYYDLSIQSRDATDDQITIDAAKAIQKYGVGIKCATITPDEARVKEFNLKKMWLSPNGTIRNILGGTVFREPIVIGSGPNKDPNDIEIPRLVPGWKKPIIIGRHAHADQYKATDFVVPEAGTLELTFTPKNANGEKITRKVYEYKDAGVALAMYNTDESIEGFAHSSFKMALSRNAPLFLSTKNTILKKYDGRFKDIFQQIYESTYKTQFEAKGLTYEHRLIDDMVAQMLKSQGGFVIALKNYDGDVQSDIVAQGFGSLGLMTSVLMTPDGKAFESEAAHGTVTRHYRRYQQGEKTSTNSIASIFAWTRGLAQRGKLDNTPEVVDFANTLEKCVLDTVSKDGIMTKDLALLVHRKEYADTEGFLEAVASRLSKTVTK

SEQ ID NO: 740 - protein, 603 aa, Pichia fermentans
MTQDCCEIKKTPVGEEAKVTVPQSTRLSAVGPIECPLKGFQLLNSPLFNKGTAFTLEEREAFGLNGLLPPVVNTLEEQVQRSYRQLHFLKSLLAKNDFCTSMRLQNKVLYYKLVKEHIRELIQIVYTPTEGDAIIAYSERFRKPEGCFLDITRPDEIDLRLAPFGNDKDIDYIVVSDSEGILGIGDQGVGGVRITIAKAALMTLCGGLHPGRVMSVVLDVGTNNKKLLEDDLYLGNRFPRVRGQEYDDFVHKAMTAMQKRFPNAVIHFEDFGVTTARPVLNRYRNVLPCFNDDIQGTGAVVMASMAAGLKLTGRDLLDSTVLIYGAGSAGIGIADQIVNHMVIHGASTELARSKIFCMDRFGLLLKGMDTNSEVQNLFAKDPAEWEGVDTKSLVEVIKKVQPTALVGCSTQAGAFNEDVIKQMYKHNPRPMIFPLSNPTRLHECFPDDALKWTEFNALVATGSPFPPVEGHVISENNNCFTFPGIGLGAVLSRATTISDAMISAAVDELASLSPAMENPKAGLLPPIEQIDETSARVATALILQALKEGHARIEEETAPSGGKVSVPREFEACLSWVKEQMWRPVYRPMVKVEHSATIHTHQY

SEQ ID NO: 741 - protein, 334 aa, Pichia fermentans
MFSRTSARQFSSSAKSAYKVTVLGAAGGIGQPLSLLMKLNTKVTKLSLYDLRLGKGVATDLSHIPTNSTVEGFGPEEDGLANALKGSDVVLIPAGVPRKPGMTRDDLFNTNASIVRDLAKAAAENCPNAALLVISNPVNSTVPIVAEVLKSKGVYNPKKLFGVTTLDVLRSSRFLSEVVNTNPATETVTVVGGHSGVTIVPLLSQTKHKDLPKDQYDALVHRIQFGGDEVVQAKNGAGSATLSMAQAGARMAGSVLKGLAGEADVTEPTFIDSPLFKSEGVEFFSSRVTLGVDGVKEVHPLGNLSTAEEEMVTVAKDTLKKNIQKGIDFVKANP

SEQ ID NO: 742 - protein, 556 aa, Pichia fermentans
MPAQIYVTSLDDVQVLGEVSDKTLLSPTTPKDILTKEALKFVVMLHRAFNETRKQLLANRQEVQKKLDAGESLHFLKETEYIRNDPNWRCNPTHPKLMSRKVEITGPPDAKMIVNAFNTDVHTYMTDFEDSCAPTWSNMLYGQVNLYDGIRDQIDFTNEKTGKRYKINKEGRRVPVMIVRPRGWHMVDSHITVSGEPISASILDFGLFFFHNAKYLISQGLGPFFYLPKMEHWLEAKLWNDIFCVAQDALEIPRGTIKATVLIETLPISYQLDEVLYALRDHSSGLNCGRWDYMFSTIKRLRNQKDHILPDRQQVTMSVPFMSNYVKQLIKICHKRGVHAMGGMAAFIPIKDDPAANSTALEAVRKDKLREVLAGHDGTWIAHPGLLDTALSVFEKHMPTPNQLFAQKTDNVTEADLVDTNIKGGEITMKGLNANIFIGLNYMESWLRGLGCVPINHLMEDAATAEVSRLQLWSWCKHQVKMDDTGKTITADYVCQLIDEEVAKLDHREGNKFAIAAGALKEELTGRKPLAEFLTDILYPYIATPGTPIDLSTLKA

SEQ ID NO: 743 - protein, 573 aa, Pichia fermentans
MVDQISLGTYIFEKLKESGVHSVFGVPGDFNLALLDHIKEVDNLRWVGNANELNAGYEADGYSRINGFAALITTFGVGELSAVNAVAGAYAEHVPLIHIVGMPSQSAEKKKLLLHHTLGDLRFDEFVEMSKNISIKVKVINDLDTAPAEINDLIETAVLTKRPVYLGLPSNFSDALIPKSLVSSLKLKLSLPPNDKETENEFVENVYGVIEKAERGIILVDACASRHAVTEEVKKLAQLTKFPVFTTPMGKSSFDEDNEEFYGLYVGELSSPDVKEIVESTDCILSIGGLLSDFNTGSFSYAYSTKNVVEFHSNYCKFKAATYTDLQMNGALANLTNQLKGYTKQQQVIPVPKSKFEYESAKVTPEGKLTQKYMWNRLSYFFQENDIIVSETGTSSFGILSAHFPKNSKAISQVLYGSIGFSLPAAVGAAFAAEDIKNFEEPSLDRRTSLFIGDGSLQLTVQAISDACRWNVKPYLFVLNNNGYTIEKLIHGPYESYNNIQPWKHQLMLEFFADKTQYENHTVKTAKEFDTLLKDPEFNKPTKIRVIELMLDEFDAPEALVKQGKLSEKMNSA

SEQ ID NO: 744 - protein, 414 aa, Pichia fermentans
MFSAAVTKTVLKKSFQQVRNLSIHEFRSAALLKSYGIGVPRGEAAFTADEAYKAAKDLNTKELVIKAQALTGGRGKGHFDNGLQSGVRLIESPEEAKDLAEKMIGHKLITKQTGAAGKLVTAVYVVERKYALQEAYLSIVMDRKNQSTMVIASSQGGMDIEGVAKKDPNAIKTYPVDIDAGINDSLATEIASQLGFTADAVPKAASTIQKLYTIFKEKDATQIEINPLSETKEHDVMCMDAKFGFDDNAEYRQKEVFSWRDTTQEDPDEVTASKYGLNFIKLDGNIGCLVNGAGLAMATMDVVKLYGGAPANFLDVGGAATPETIEKAFELILTEKKVSAIFVNIFGGIVRCDFVADGLIQATKNLGLKIPVVVRLQGTNFKIAKEMIDNSGLKLYLEEDLDKAAEKVVELGKN

SEQ ID NO: 745 - protein, 321 aa, Pichia fermentans
MLGFRRSFHSARQLRNYADTINNLKINKDTKVIFQGFTGRQATFHAEQALAYGTQIVGGTNPKKAGEVHLGKPVFATVAEAMKHTGATASGVFVPPPIAASAVREAIEAEIPLVVCITEGIPQQDMLRISQMLKTQSKTRMVGPNCPGIIAPEQCKIGIMPQSIHKRGKIGIVSRSGTLTYEAVAQTTQVGLGQSLVIGMGGDPSPGTNFIDALTLFLNDPETEGIIMIGEIGGSAEEEAAEFLKQHNLTRDVPKPVVSFIAGVTAPPGRRMGHAGALISGGKGTAQSKIEALTAANVEVVPSPGRLGEALHQQFVDRKLL

SEQ ID NO: 746 - protein, 643 aa, Pichia fermentans
MLSRLARHGALSRAALSSRQLSTTTPRAQIVSNLNSLNGKEAASSMGKDYHVIDHEYDCIVIGAGGAGLRAAFGLVKEGFKVACISKLFPTRSHTVAAQGGINAALGNMHKDDWHWHMYDTVKGSDWLGDQDAIHYMTREAPPSIIELEHYGLPFSRTKEGKIYQRAFGGQTKDFGKGGQAYRTCAVADRTGHALLHTLYGQSLRYDTHYFLEFFAMDLLKHNNEIVGCIAYNQEDGTLHRFKAHKTIIATGGSGRAYFSCTSAHTCTGDGNAMVSRAGYPLEDMEFIQFHPSGIYGSGCLITEGARGEGGYLINSEGERFMERYAPHAKDLACRDVVSRAITMEINAGRGVGPEKDHMFLQLSHLPASVLQERLPGISETARIFAGVDVTKEPIPILPTVHYNMGGIPTKWTGEALTINEKGEDEVIPGLFACGEAACASVHGANRLGANSLLDLVVFGRAVAHTIAAEMKPGMPHKELPADIGFESIENLDKLRNANGNVATADLRLEMQKAMQKHVAVFRTQDNMDAGVTELEKIDAKFADIKTTDRSMIWNTDLTETLELQNLLTCARQIALSAANRKESRGAHARDDYQERDDVNWQKHTLSWQTKTGEPVKLGYRDVVTHTLDENECKAVPPAVRAY

SEQ ID NO: 747 - protein, 616 aa, Yarrowia lipolytica
MSEDHPAIHPPSEFKDNHPPLRRPPPRLSAGLPPAAQGMANELISWSTPFETVRSGGFEHGDVAWFPEGQLNASYNCVDRHAFANPDKPAIIFEADEPGQGRIVTYGELLRQVSQVAATLRSFGVQKGDTVAVYLPMIPEAIVTLLAITRIGAVHSVIFAGFSSGSLRDRINDAKSKVVVTTDASMRGGKTIDTKKIVDEALRDCPSVTHTLVFRRAGVENLAWTEGRDFCTDPTLPPVPVASEDPIFLLYTSGSTGTPKGLAHATGGYLLGAALTAKYVFDIHGDDKLFTAGDVGWITGHTYVLYGPLMLGATTVVFEGTPAYPSFSRYWDIVDDHKITHFYRAGTHHIKHDLSSLRTLGSVGEPIAPDVWQWYNDNIGRGKAHICDTYWQTETGSHIIAPMAGVTPTKPGSASLPVFGIDPVIIDPVALARSSRVTTLRVFLPCDLPGPPWPEPPYPGYYFTGDGAARDNDGFYWIRGRVDDVVNVSGHRLSTAEIEAALIEHAQVSESAVVGVHDDLTGQAVNAFVALKNPVEDVDALRKELVVQVRKTIGPFAAPKNVIIVDDLPKTRSGKIMRRILRKVLAGEEDQLGDISTLANPDVVQTIIEVVHSLKK

SEQ ID NO: 748 - protein, 320 aa, Yarrowia lipolytica
MTIPKTQKAIVFETSGGPLEYKDVPVPVPGDHQILVNVKYSGVCHSDLHAWMGDWPLPTKLPLIGGHEGAGVVVAKGKNVTTFEIGDYAGIKWINQAPNCPKAQISGYTMDGTFQQYALADAVQAAHIPQGTDLSQVAPILCAGVTVYKAIKTSGRKAGEMYAKAMGFRVLAIDTTEEKEKMCLELGAEVFVDFAKTDNLVARVQEITGGGPHGVINVSVSEFAINQSLEYVRSVGTVVLVGLPAGAVCKSPIFSQVARAITIKGSPVGNRADTQEALSFFTRGLVHSPIHVVGLSELQKVFTLMEEGKIAGRYVVDTSK

SEQ ID NO: 749 - protein, 343 aa, Yarrowia lipolytica
MSAPVIPKTQKGVIFETSGGPLMYKDIPVPVPADDEILVNVKFSGVCHTDLHAWKGDWPLDTKLPLVGGHEGAGVVVAKGKNVDTFEIGDYAGIKWINKACYTCEFCQVAAEPNCPNATMSGYTHDGSFQQYATANAVQAAHIPKNCDLAEIAPILCAGITVYKALKTAAILAGQWVAVTGAGGGLGTLAVQYAKAMGYRVLAIDTGADKEKMCKDLGAEVFIDFAKTKDLVKDVQEATKGGPHAVINVSVSDTCEPWGTVVLVGLPAGAVCKSPIFQQVARSIQIKGSYVGNRADSQEAIEFFSRGLVKSPIIIIGLSELEKVYKLMEEGKIAGRYVLDTSK

SEQ ID NO: 750 - protein, 330 aa, Yarrowia lipolytica
MTTIPKTQKAVIFETSGGPLMYKDVPVPVPADDEILVNVKFSGVCHTDLHAWKGDWPLDTKLPLIGGHEGAGVVVAKGKNVTTFEIGDYAGIKWINKACYTCEFCQVSAEPNCPKATMSGYTHDGSFQQYATANAVQAAHIPKNCDLAQIAPILCAGITVYKALKTAGLKAGEWAAVTGAGGGLGSLAVQYAKAMGYRVLAIDTGADKEKMCKELGAEVFIDFAKSKDLVKDFAVNQSVEYVRTLGTVVLVGLPAGAVCKSPIFQQVARSIQIKGSYVGNRADSQEAIEFFARGLVKSPIIIVGLSQLESVYKLMEEGKIAGRYVLDTYK

SEQ ID NO: 751 - protein, 408 aa, Yarrowia lipolytica
MSTTATRGLSTKIKVKNPIVELDGDEMTRIIWKSIKDKLILPYLDIDLKYSRSGHRVTIDAAEAIKKYQVGVKCATITPDEARVKEFGLKKMWLSPNGTIRNILGGTVFREPIVIPAVPRLVPGWKEPIIIGRHAHGDQYKAQDAVIPGAGELTLNFKPANGGDEQVIKVYTYDAPGVAMAMYNTDESITGFAYSSFNLALQKKLPLYMSTKNTILKKYDGRFKDIFQEIYDKEYKDKFDAAGIWYEHRLIDDMVAQMIKSKGGFIMALKNYDGDVQSDIVAQGFGSLGLMTSVLVTPDGKTFESEAAHGTVTRHYRQHQQGKETSTNSIASIFAWTRGLIQRGILDETPEVTKFAEALEKATVDTVDKDGIMTKDLALAGGKTDRSSYVLTEEFIDAVANRLKKDLA

SEQ ID NO: 752 - protein, 493 aa, Yarrowia lipolytica
MGPVTTVPSSNTDAILKGVEIRANIPANAQHIFSKEALAFIATLHRTFDARRHELLAARVARQARIDAGESPAPTDRKMVINALNSDVWTYMADFEDSSAPTWSNMVDGQVNLYDGVRRTITFQAPGGKSYKLRSDKEKLPTLIVRPRGWHLDETHFLVDGKPISGGLFDFGLYFFNNAKESVARGAGPYFYLPKMESHLEARLWNDVFKLSQDWIGMPRGTIRGTVLIETILAAFEMDEIIYELREHSSGLNCGRWDYIFSFIKKFKNHPEFVLPDRGDVTMTVPYMSAYVKLLIQTCHKRGVHAMGGMAAQIPIKNDAAANKVAMEGVYKDKLREVTAGHDGTWVAHPQLAIIASEVFNKHMPTPNQIYRRQEDNLFIGLGYMEAWLRGLGCVPINYLMEDAATAEVSRSQLHQWVKHGVTTAEGKKVTKDYAVKLLNEETDKLIKNSKPGNKFAEAAAYFKPEIVGDKYSDFLTTLLYDQITSVGSSSKL

SEQ ID NO: 753 - protein, 254 aa, Yarrowia lipolytica
MFALRASRNVLKSRPVFARGLASTAEAPKVPAPRIKKFGIYRWNPDTPEKKPELKEYEVDLSQCGPMVLDALIKIKNEQDPTLTFRRSAETPLACLCRINPDIAKEEKIYPLPHMFVVRDLVPDLTQFYKQYKSIEPYLQRDEVPADGKENLQSIADRRKLDGLYECILCACCSTSCPSYWWNQQEYLGPAVLMQAYRWMIDSRDEATAKRQQMLENSMSLYRCHTIMNCARTCPKGLNLGLAIAKIKRSMAFV

SEQ ID NO: 754 - protein, 612 aa, Yarrowia lipolytica
MLRAIKNPRAVLKSRHFSTSPVVAKVFANGPVKAQEAPSHVASKYAVVDHEYDCVVVGAGGAGLRAAFGLAEAGFNTACISKLFPTRSHTVAAQGGINAALGNMHPDNWKWHMYDTVKGSDWLGDQDAIHYMTKEAPKSIIELEHYGVPFSRNDEGRIYQRAFGGQSKDYGKGGQAYRTRAVADRTGHAMLHSLYGQSLRHNTHFFIEYFAMDLLMEDGACVGVVAYNQEDGTLHRFRAHKTVLATGGYGRAYFSCTSAHTCTGDGMAMVTRAGLPLQDLEFGSRGEGGYLLNKNGERFMERYAPTAKDLASRDIREGRGVGQHGDHIFLQLSHLPASVLHERLPGISETAAIFAGVDVTKEPIPVLPTVHYNMGGIPTRYTGEVLTQDENGQDKVVEGLFACGEAACVSVHGANRLGANSLLDLVVFGRAVAHRITETLTPGAPLPPVSADIGYESIANLDKMRNADGPLSTATIRDKMQRTMQMDVSVFRTQESLEDGVRGITAVDRLIDQVGVTDRSMIWNTDLTETLELQNLLTCAMQTAYSAVARKESRGAHAREDYPDRDDVNWMKHTLSWQDKPGDEIKLGYRAVQMHTLDESECPTVPPAKRVY

SEQ ID NO: 755 - protein, 331 aa, Clavispora fructus
MFKAATRSFSSSPSAAYKVAVLGAGGGIGQPLSLLMKLNQKVTDLALYDLRGAPGVAADVSHVPTNSTVKGYEPEQLDEALKGADVVVIPAGVPRKPGMTRDDLFNTNASIVRDLAKAVAENAPNAAVCIISNPVNSTVPIVAEVFKSKGVYNPKKLFGVTTLDVLRASRFVSEIAGTNPSHEHVTVVGGHSGITIVPLLSQTTHKDLPVETRDALIHRIQFGGDEVVQAKNGAGSATLSMAQAGARFAGAVLNGLAGEKDIVEPSFVDSPLFKDEGVEFFSSKVTLGVEGVKTIHSLGELSDHEEELVKKAKETLITNIKKGVEFVAQNP

SEQ ID NO: 756 - protein, 333 aa, Clavispora fructus
MVKVTVCGAAGGIGQPLSLLLKLNPQVTELSLFDVVNVPGVGADLSHINSGATTQSFLPSSREDTTALAASLKGSDLVVIPAGVPRKPGMTRDDLFNINASIVQSLAKGIAENAPDAFVLVISNPVNSTVPIVAETLKQYKVFNPSKLFGVTTLDIVRANTFVSQLFPDETKPTDFEVPVVGGHSGETIVPLYSLGAPEYYAKLSEEKKKELVHRVQFGGDEVVQAKNGAGSATLSMAYAGYRLAESLLKALSGSAVTECTFLYLDESIKGAAEAKKLVNVDFFSLPATLGQTGITAVDYSVLEKANADEKKLLEVAIEQLSKNIEKGVSFGK

SEQ ID NO: 757 - protein, 558 aa, Clavispora fructus
MVFSSLDNVAVLAPVEFAAKHESGTTQADILTRSALSFVVMLHRAFNSTRKHLLANRQKVQAEIDAGQPLDFVRDAHWEKIRADPVWRGAAPGPGLADRRSEITGPPERKMVVNALNTPVRTYMCDFEDSLAPTWASVVDGQVNLYDAVRNQIDFIFAATGKSYAVNRAPGRHIPTLIVRPRGWHMVDKHVVVDGEPVSASLLDFGLYFFHNARALVAAGRGPYFYLPKMEHHLEAKLWNDVFNVAQDALTIPRGTIRATVLIETLPAAYQMEEIIYQLRDHSAGLNCGRWDYIFSTIKRLRNHKDKVLPNRGLVTMKLPFMEAYCKRLINVCHRRQVHAMGGMAAQIPIKDDAAANAAAMAKVKADKLREATMHYDGTWVAHPALAPIANGVFDEHMPTPNQIHIVPEENVAAEDLSNTAIAGFEVTTAGIRENLYIALCYMELWIRGVGCVPINNLMEDAATAEVSRLQLYLWVKHGVTLADTNEVVTPDLAQALLEDETAKLKQKYASVPHKFDVAQKYLLPEIRGDSLTEFLTTLVYDEVVTAGEPVDLSALHE

SEQ ID NO: 758 - protein, 551 aa, Clavispora fructus
MSSPFPTTALKVQGVQILGPIPPNAKHIYSAEALALVATLHRNFQPQRKKLLAARKEQQQLRDSGVLPDFLPETAYIRDDPTWTGPPLAPGLRDRRVEITGPTDRKMVINALNSGVATYMADFEDSLTPAWDNLVDGQVNLYDAVRRDISYSANGKHYKLNLDPGRHIPTLIVRPRGWHLDERHVLVDGEAVSGGIFDFAIYFFNNAKESLARGAGPYFYLPKMEHHLEAKLWNDVFNHAQDYVGIPRGTIRGSVLIETLPAAFQMDEIIYQLRQHIGGLNCGRWDYIFSYIKSLRNHKEFILPDRSQVTMAAPFISSYVRLLVHTCHKRQVHALGGMAAQIPIKEDEARNRAALENVAKDKLREVMAGCDSCWVAHPALVPVVLKVFNEHMKGPNQINVPPRVPYKPVTARDLLSPFVPGAKITEQGIRANCVIGLSYIEAWLRNVGCVPINYLMEDAATAEVSRTQLWQWVTHGASTDAGQRIDKAYVSKLLNEEYQKLASAAKPGNKFKRALEYFKPEALGEKYSDFVTTLIYDEVTTVGRPILAEKL

SEQ ID NO: 759 - protein, 716 aa, Clavispora fructus
MSLSNPGSATKHRHPAAAICRCHPAAAAIPPLPSRRRHYAATICRRHPAAAAPPPKSLFLRWVYPPDTVTAYSGYIYHPPPRSGYAPPKMMLVGKNRTSTLRNIRAVRFVSDATVQAHTIKTPVGVKAAIAALKPKTTRLSIEGPIECDLQGFQLLNSPIFNKGSAFTQEERKAFNLSGLLPSKVNNLQEQVDRAYAQFQYLKTPLAKNDFLTSMRIQNKVLYYELVRNHIREMLPIIYTPTEGDAIAAYSHRFRKPEGCFLDITAPEEIEERLAAYGEDKDIDYIVLSDGEGILGIGDQGVGGIRIAIAKLGLMTLCAGIHPGRVLPVVFDVGTNNKELQEDDLYMGNKFERVRGEQYWSFVDKFIQSVKKRFPLAVLHYEDFGVSTGRTMLHRYRSDLPSFNDDIQGTGAVVMASMTAALQFSRRDLLETQVLIYGAGSAGLGVADQIVNHMVSHGLTVEDACKRITIMDRRGVVLQSYPNSPEGQLRYADPDAKWDGVNTKNLQEVVAKVKPTVLVGCSTQAGAFTEQVIKEMYKHNPQPIVFPLLNPTRLHEAFPVDIMRWTDNNALIATGSPFQPVDGYYISENNNCFTFPGIGLGAVLSRCTTITDTMISAAVDQLALMSPKMANPKNGLLPRLEEISHVSAHVATAVILQSLKEGTARVESEEKPDGGSVEVPRDFDKCLKWVQSQMWKPVYRPLVKVSHTPEIHTFQY

SEQ ID NO: 760 - protein, 428 aa, Clavispora fructus
MLRSTIKQTQSARLFSAASAASGKIKVTNPIVELDGDEMTRIIWARIKDKLINPYLDVDLKYYDLGIQARDKTDDQITVDAANAIKEYGVGVKCATITPDEDRVAEFGLKKMWLSPNGTIRNILGGTVFRESIIIPRIPRLVPGWEKPIVIGRHAHGDQYKATDLVIEEPGKLEMVFTPANGGEKVTRTIYDYKNRGVGLAMYNTDESITGFAHSSFKMALSQNLPLYLSTKNTILKKYDGRFKDIFQEIYEKEYAGQFEKQGLWYEHRLIDDMVAQMIKSKGGFVMALKNYDGDVQSDIVAQGFGSLGLMTSALMTPDGKAYESEAAHGTVTRHYRQHQQGKETSTNSIASIFAWSRGIAQRGRLDGTADVVDFANTLEHATVATVQEDGIMTKDLALACGKTNRESYVTTTEFLDAVSDKLKSLKA

SEQ ID NO: 761 - protein, 410 aa, Clavispora fructus
MSQKITVKNPIVEMDGDEMTRIIWKFIKDKLIFPYLEIDLKYYDLGIEYRDETDDKVTTDAANAILKYGVGVKCATITPDEARVVEFGLKKMWLSPNGTLRNILGGTVFREPIVIDNIPRIVPSWEKPIIIGRHAFGDQYKATDLVIPKAGNLSLVFKPEDGSDEQVFAVYDYKGPGVALSMYNTDKSITDFAESSFRLALTRKMNLFSTTKNTILKKYDGRFKDIFESLYENKYKKDFDAAGIWYEHRLIDDMVAQMLKSKGGYIIAMKNYDGDVQSDIVAQGFGSLGLMTSVLVTPDGKAFEAEAAHGTVTRHYRQHQQGKETSTNSIASIFAWTRGLIQRGTLDGTEDVVKFGQNLEKAVIDTVALDSVMTKDLALTQGKTDRSSYVTTEEFIDAVQKRLNKNLAKS

SEQ ID NO: 762 - protein, 518 aa, Clavispora fructus
MIRTTFTKTAIRKAWSPSLIRLYSNLPLSVTVNLPNGTSYEQPTGLFINGKFVLPQQKKTFEVISPSTEEEVTHVYEAREEDVDVAVKAAQAAFEGGWSTADPAVRAAALNKLADLLEANAETLAAIESLDNGKSISNARGDVALSIGCLRSTAGWADKILGTVVETGDSHFNFTRREPLGVCGQIIPWNFPLLMFAWKVAPAIATNNTIVLKTSETTPLSALFVCKLIEENNVLPPGVLNVVNGFGKITGNAITDHPTIKKVAFTGSTATGKHIMAKCANTLKKITLELGGKSPHIIFNDADLDVAVQNVVTGIFYNSGEVCCAGSRLYVQEDIYDQFVEKFVTAAKNVKVGNPFDEEVLQGAQNSWNQLSKILGFIESGKKEGATLLTGGKRAGDKGFFVEPTVFGDVTEDMTIVKEEIFGPVITVHKFKTVDDAVKLANNSQYGLAAGIQSTNVNTCIDVARRVKAGTVWVNTYNDFHQMVPFGGFGASGVGREMGKEVLENYTQTKAVRMAIHK

SEQ ID NO: 763 - protein, 348 aa, Clavispora fructus
MSIPTTQKAVIFETNGGPLEYRDIPVPTPKPNELLINVKYSGVCHTDLHAWKGDWPLDTKLPLVGGHEGAGVVVALGSNVKGWKIGDYAGIKWLNSSCNSCEFCQNTNESNCPDAVLSGYTHDGSFQQYATADAIHAARIPQGTDLALVSPILCAGITVYKALKTANLKAGEWVAISGAAGGLGSLAIQYAKAMGYRVIAIDGGEDKGEFVKSLGAEAYVDFTKSKDVVADVQKVTDGGPKGVINVSVSEHAIGQSVAYVRSTGTVVLVGLPAGAKVTAPVFDAVVKSISIRGSYVGNRADSAEAIEFFTRGLITCPIKIVGLSELPSVYKLMEEGKILGRYVVDTSK

SEQ ID NO: 764 - protein, 413 aa, Clavispora fructus
MFSRVARASRVCNKRFLSLHEYRSAALLESYGVGVPKGYAATTPEGAFEAAKKLGTNELVIKAQALTGGRGKGHFDNGFQGGVKLISSPEEAKDLAEKMLNHKLITKQTGAAGKEVTAVYVVERRDARTEAYLAILLDRSTQLPMIVASAQGGMDIEGVAAENPDAIKTFSVSLEEGVTDKLAVEIASVLGYTDAAIPEAAKAVQNLYRVFEEKDCTQVEINPLSETPDHKVLAMDAKLGFDDNASFRQEEVFGWRDPTQEDPQESEAGKYGLNFIKLDGNIANIVNGAGLAMATMDIIKLYGGEPANFLDCGGTATPETIEKAFELILSDKKVNGIFVNIFGGIVRCDYVAEGLIAATKNFNLDIPVVVRLQGTNMEKAKELIDNSGLKLFAFEDLDPAAEKIVQLAPKPTV

SEQ ID NO: 765 - protein, 324 aa, Clavispora fructus
MLSKQFARGFASTPVARNYASTIKNLKVNKDTKVIYQGFTGKQATFHAEQAIAYGTKVVGGTNPKKAGQTHLDKPVFASVKDAIRETGANATGIFVPPSIAAAAIEEAIAAEIELAVAITEGIPQKDMVRIAQILKTQSKTRLVGPNCPGLIAPDQCKIGIMPSSIHMRGKVGIISRSGTLTYEAVAQTTKVGLGQSLVIGMGGDPFPGTNFIDALTLYLNDPETEGIILIGEIGGTAEEEASEFLKQYNLTRPEGPKPVVSFIAGVSAPPGRRMGHAGAIVAGGKGDAKSKIAALESAGVVVEQSPARLGNSLLKEFKNKGLL

SEQ ID NO: 766 - protein, 672 aa, Clavispora fructus
MPEHLVMDHEGAKNPPQGFFERTTHTPHLASLDEYHTLHKQSVEDPASFFGDMARKHLSWSRPFDTARYPADPKNDFADGDLPAWFLGGQLNACYNAVDRWAVENPNKPAIIYEGDEPNTGRIISYGELLKDVCKLAQALVKAGVKKGDTVAVYLPMIPEALVTLLAIVRIGAVHSVVFAGFSLTSLRDRIVDGDSRVVITADESKRGGKTIETKKIVDEALKDLPQVRNVFVFKRTGNSHVPFNPARDLWWHEELAKYGNYFPPVAVDAEDPLFLLYTSGSTGKPKGVQHNVAGYLLGALLTTKYTFDVHRDDIVFTAGDIGWITGHTYVVYGPLLNGATTVVFEGTPAYPDYSRYWQIVDEYKVNQFYVAPTALRLLKRAGTSYIEKYKLDSLRVLGSVGEPIAAEVWHWYNDNIGRGKAHIVDTYWQTESGSHLLTPLAGLTPTKPGSASFPFFGIDAHVLDPVTGEILTEDGVEGVLAIKNAWPSIARGIFNDYSRFIDTYLGNYKGYYFTGDGAARDRDGFYWILGRVDDVVNVSGHRLSTAEIEAALIEHKMVGESAVVGYADELTGQAVAAYVSLKSQYKSGDKESIEAIKKELILTVRKEIGPFAAPKQILLVDDLPKTRSGKIMRRILRKVLAGEEDQLGDTLTLSDPSVVQQIIDVVKETRK

SEQ ID NO: 767 - protein, 675 aa, Clavispora fructus
MSHAVVHEANGVAPRHTPAEFFTKQPAKGHISSLEQYQQMYDQSINDPEAFFGPLAKELLHWDKPFTTVKAGDLNNGDVQWFVGGELNASYNCVDRWAYAHPEKLALIYEADDEKDSYSLTYGELLREVSATAGVLKSWGIGKGDNVAIYLPMNAQAIIAMLAVARLGAVHSVIFAGFSSGSIRDRVIDAQCKALITCDEGKRGGKTINIKKLCDEALLSCPSVEKVLVHRRTGNPDIAVTEGRDFWWDEEAAKFPGYLPPTPVNAEDPLFLLYTSGSTGSPKGVVHTTGGYLLGAALTTKYVFDVHALDVVFTAGDVGWITGHTYALYGPLLLGVPTVVFEGTPAYPDYGRLFQIVDKHKATHFYIAPTALRLLRKAGEQEIEKYDLSSLRTLGSVGEPISPDIWEWYNEKIGRGRCHISDTYWQTESGSHFIAPLAGITPNKPGSASLPFFGVDTRLIDPVSGKEIVGNDVEGVLAIKSTWPSMARTVYRNHQKYMDTYLKPYPGYYFTGDGAARDNDGYYWIRGRVDDVVNVSGHRLSTAEIEAALLEHHGVSESAVVGINDDLTGQAVVAFVALKDEFAASINGKETSEEAFVLRRDLVLVVRKEIGPFAAPKSVIIVQDLPKTRSGKIMRRILRKISSLEADQLGDISTLANPQSVAGIIDSFDAQFGKK

SEQ ID NO: 768 - protein, 562 aa, Clavispora fructus
MAEITLGRYLFERLNQLSVQTIFGLPGDFNLSLLDKIYEVDGMRWAGNANELNAAYAADGYSRVKGLACLVTTFGVGELSALNGVGGAYAEHVGLLHVVGVPSISSQAKQLLLHHTLGNGDFTVFHRMSNNISQTTAFISDIDSAPKEIDRCIREAYVNQRPVYVGLPANLVDLAVPASLLDTPIDLSLKQNDPDAQAEVIETVLELIDQAQNPVILVDACASRHDCKPEVAALIDSTQYPVFTTPMGKSGVNESHPRFGGVYVGSLSEPSVKEAVESADLILSVGALLSDFNTGSFSYSYKTKNIVEFHSDYTKIRQATFPGVQMKEALNALLKDIGSHTANYTPGPVPAQKVVAAPAATEPINQEWMWSRVSDWFQEGDIIITETGTSAFGIVQSKFPNNCIGISQVLWGSIGFTVGATLGAVMAAQEVDPKKRVILFIGDGSLQLTVQEISTMVKWETTPYLFVLNNDGYTIERLIHGETASYNDIQPWDNLALLPLFKSKDYETTRVSTVGEIESLLNDAAFKENTRIRMVEVMLPRMDAPQNLVKQAEFSAQTNAQN

SEQ ID NO: 769 - protein, 629 aa, Clavispora fructus
MLRSIRNFSTSRVAKQVIGAAKGESVNSTKYLGQKYHVIDHEYDCVVVGAGGAGLRAAFGLAEAGFKTACVTKLFPTRSHTVAAQGGINAALGNMHKDDWHWHMYDTVKGSDWLGDQDAIHYMTKEAPESIYELENYGVPFSRNEEGRIYQRAFGGQSKEYGKGGQAYRTCAVADRTGHALLHSLYGQSLRHDTHFFIEFFATDLMMENGECVGVMAYNQEDGTLHRFRAHKTVLATGGYGRAYFSCTSAHTCTGDGYAMASRAGLPLQDLEFVQFHPSGIYGSGCLITEGARGEGGYLINSEGERFMERYAPSAKDLASRDVVSRAITMEINEGRGVGPEKDHMFLQLSHIPAAVLKERLPGISETAHIFAGVDVTKEPIPILPTVHYNMGGIPTKWTGEVVKKNEKGEDEVVPGLLACGEVACASVHGANRLGANSLLDLVVFGRAVSHTIRDSLTPGTPLKPVSKDIGLESIANLDKLRNANGTKSTADIRLAMQKTMQKGCAVFRTQETLDECVENINAVDETFAHVKTTDRSMIWNSDLVETLELQNLLTCATQTAASAAARPESRGAHARDDYPDRNDVDWMKHTLSYQESFGAPVTLDYRKVINTTLDENDCKPVPPAKRVY

SEQ ID NO: 770 - protein, 504 aa, Debaryomyces hansenii
MVSTNLPLEIPITLPNGIKYTQPTGLFINNEFVRSKQGNKFEVLSPSTEEVVTSVYEAREDDVDIAVQHALRAFEESSWAKADPCQRGAALYKLANLIEENFETIASIEAMDNGKAIGNAKGDVTLAISVLRSTAGFSDKMLGSVIESGDSHFNFTRREPLGVCGQIIPWNFPLLMFTWKIAPALVTGNCVVIKSSETTPLSALYVSNLIKEANLFPPGVLNVISGFGKYTGNAITEHPLIKKVAFTGSTATGKTIMRKCAESNLKKVTLELGGKSPHIIFNDADMDTTLKSVVTGIFYNSGEVCSAGSRLYIQEGIYDAFVEKFVQTTKSDVKVGDPFLPDTIQGAQNSVDQLDKILKYIQIGTDEGAKILAGGERLQGKGYFIKPTIFGDVKEDMRIVQEEIFGPVITISKFKTTDDVVRMANNTDYGLAAGIQTSNVNRAIDVSRRLKAGTVWVNTYNDFHPMVPFGGYNLSGMGREMGVEVLQNYTQTKAVRMSIIKPKD

SEQ ID NO: 771 - protein, 346 aa, Debaryomyces hansenii
MSIPKTQKAIIFETSGGELKYADIAVPKPKPNEILINVKFSGVCHTDLHAWKGDWPLPTKLPLVGGHEGAGEVVAIGENVQGWEIGDLAGIKWINGTCLNCEFCQNSNESNCAKADMSGYTHDGTFQQYATADAVHAARIPKGTDLASVSPILCAGITVYKALKTSGAKPGQWVAISGAAGGLGSLALQYAKAMGFRVLAVDGGDKGEFVKSLGAESYVDFTKSKDVVKEILETTGGGPHAVINVSVSVAAMNQSTEYVRSCGTVVLVGLPHAKLEAGIFNTVVKCVSIKGSYVGNRADSAEAIDFFARGLIKCPIKVVGLSELASIYKLMEEGKILGRYVVDTSK

SEQ ID NO: 772 - protein, 521 aa, Debaryomyces hansenii
MFKNSIAKQARSNVAYAKSFIRMSSNLPLQVSIKLPNGTTYEQPTGMFINNEYVYPKQKKTFDVISPSTEEHITDVYEALEEDIDTAVEAASAAFKSSWSTGDPSVRANALLKLADLVDANADTLAHIEALDNGKSLMCSRGDVALTAMYFRSCAGWADKILGTVPETGSTHFNYTRREPIGVCGQIIPWNFPLLMLAWKVGPATATGNTIVLKTAESTPLSGLFLTGLIKEAGFPPGVVNILTGFGKNAGNAIASHPKIKKVAFTGSTATGRHIMKSAAESNLKKVTLELGGKSPNIVFNDADVQKSVQSLITGIFYNTGEVCCAGSRIYVQEEIYDNVLEELKNASSKIKIGNPFEEDTFMGALASSQQLDKILKCIETGKNEGAKLISGGERVQGKGYFIKPTIFGDITEDMQIVKEEIFGPVVTVTKFKTVDEVVDLANDSEYGLAAGIHTENINTAIGVANRLQAGTVWVNTYNDFHPMVPFGGYDQSGFGREMGAEALDNYTQVKAVRIGLTEKH

SEQ ID NO: 773 - protein, 349 aa, Debaryomyces hansenii
MSSIPETQKAVVFESNGGPLEYKEIAVPKPKSTEILINVKFSGICHTDLHAWKGDWPLPVKLPLVGGHEGAGVVVAIGENVKGWEIGDLAGIKWLNGTCMNCEFCQNSNESNCPNADLSGYTHDGSFQQYATADAVQAAKIPKGTDLAEVAPILCAGVTVYKALKSANLKAGQWVVISGAGGGLGSLCIQYAAAMGYRVISIDGGEEKGEFVKSLGSEAYVDFTKSKDIVADIKKITNGGAHGVINVSVSEKAMSQSCEYVRSRGTVVLVGLPAGAEIKTPVFDAVVRSIAIVGSYVGNRADTTEAIDFFSRGLIKCPIKIVGLSELPPVYEFMEQGKILGRYVVDTSK

SEQ ID NO: 774 - protein, 671 aa, Debaryomyces hansenii; identical to SEQ ID NO: 501

SEQ ID NO: 775 - protein, 679 aa, Debaryomyces hansenii; identical to SEQ ID NO: 498

SEQ ID NO: 776 - protein, 410 aa, Debaryomyces hansenii
MGFNKIKVDQPIVEMDGDEMTRIIWKFIKDKLIFPYLDVDLKYYDLGIEYRNQTDDKVTTDAAEAILKYQVGVKCATITPDEARVEEFKLKKMWLSPNGTLRNILGGTVFREPIVIDNIPRIVPQWESPIIIGRHAFGDQYKATDVVIPKAGQLELVFKPADGSATEVYPVYNYDAPGVALAMYNTEKSITDFAESSFKMALDRKLILFSSTKNTILKKYDGRFKDIFEDLYEKKYKKQFEEAGIWYEHRLIDDMVAQMLKSKGGYIIAMKNYDGDVQSDIVAQGFGSLGLMTSVLMTPDGKAFEAEAAHGTVTRHYRQHQQGKETSTNSIASIFAWTRGIIQRGKLDNNADVVKFGESLEKATIDTVALDNVMTKDLALAQGKTERSSYVTTEEFIDAVAKRLNKNLGA

SEQ ID NO: 777 - protein, 437 aa, Debaryomyces hansenii
MFRNGVMRNPAMSGYSKYSMRSFSSSLINLDKIKVKNPIVELDGDEMTRIIWQRIKDKLINPYLDVDLKYYDLGIESRDKTDDQITIDAANAIKEYGVGVKCATITPDESRVEEFNLKKMWLSPNGTIRNILGGTVFREAIIIPRIPRLVPGWKEPIVIGRHAHGDQYKATDLVINEPGKLEMTFTPENGGAPETRTVYDYKGPGVGLAMYNTDESIIGFAHSSFKMALTKKLPLYLSTKNTILKKYDGRFKDIFHEIYESTYKKEFETNNIWYEHRLIDDMVAQMIKSKGGFVMALKNYDGDVQSDIVAQGFGSLGLMTSVLMTPDGKTFESEAAHGTVTRHFRQHQQGKETSTNSIASIFAWTRGIAQRGRLDDTPDVVKFAEIVEKATFDTVQEDGIMTKDLALALGRTDRESYVTTTEFLDAVSDKLQKQVQV

SEQ ID NO: 778 - protein, 627 aa, Debaryomyces hansenii
MLRRYFGTSATRFQTIGNIKGTQLNATKYLSKDYHVIDHQYDCLVVGAGGAGLRAAYGLSEAGYKTACISKLFPTRSHTVAAQGGINAALGNMHKDDWHWHMYDTVKGSDWLGDQDAIHYMTKEAPASIYELENYGVPFSRNEEGRIYQRAFGGQAKEFGKGGQAYRTCAVADRTGHSLLHTLYGQSLRNDTHFFIEFFAMDLMMQDGECIGVIAYNQEDGTIHRFQAHKTIIATGGYGRTYFSCTSAHTCTGDGFAMVSRAGLPLEDMEFVQFHPSGIYGSGCLITEGARGEGGFLLNSEGERFMERYAPHAKDLASRDVVSRAMTLEINEGRGVGKEKDHIYLQLSHLPPSVLKERLPGISETAHIFAGVDVTKEPIPILPTVHYNMGGIPTNYKTEVLKKGADGKDEIVPGLFACGEAACASVHGANRLGANSLLDLVVFGRAVGHTISEQLTPGTPFKPLDEHMGKESIENLHHLRTADGSQTTASIRAEMQKTMQKGCAVFRTQDLLDQCVEDIDKIDKTFEHVKTTDRSMIWNSDLVETMELQNLLTCATQTAYSAAARKESRGAHARDDYPNRDDENWRKHTLSYQKNFGDKVELDYRDVVRTTLDESDCKPVPPAVRVY

SEQ ID NO: 779 - protein, 643 aa, Debaryomyces hansenii
MLSLRRSALAATKFSNNKRFFTSSCVKLQTIGDNIKGNDLNTAKYMGKQYHVIDHEYDCVVVGAGGAGLRAAFGLAEAGFKTACISKLFPTRSHTVAAQGGINAALGNMHKDDWHWHMYDTVKGSDWLGDQDAIHYMTREAPDSIYELENYGVPFSRNDEGRIYQRAFGGQSKEFGKGGQAYRTCAVADRTGHALLHSLYGQALRHNTHFFIEFMAMDLLMQDGECVGVMAYNQEDGTLHRFRSHKTIMATGGYGRTYFSCTSAHTCTGDGYAMVSRAGLPLEDMEFIQFHPSGIYGSGCLITEGARGEGGFLVNSEGERFMERYAPTAKDLACRDVVSRAITMEINEGRGVGPEKDHMHLQLSHLPPSVLKERLPGISETAHIFAGVDVTKEPIPVLPTVHYNMGGIPTKYNGEVITKGPNGEDKVVPGLLACGEVACASVHGANRLGANSLLDLVVFGRAVSHTIRDSLTPGTPLPPLAADSGKESIENLDKLRTADGSKSTAQIRLEMQKTMQKGCAVFRTQETLDECIEHIGQVDKTFSDVGTTDRSMIWNSDLVETLELQNLLTCATQTAASAAARKESRGAHAREDYPDRDDVNWWKHTLSYQTNFGDDVKLDYRDVIQTTLDESECKPVPPTVRAY

SEQ ID NO: 780 - protein, 578 aa, Debaryomyces hansenii
MLQNKEETISLGTYLFERIHQLKVQSIFGVPGDFNLTLLDKIDEVKNLTWRGNANELNAAYAADGYSRVRSTESSANGFACLVTTFGVGELSALNGIAGSYAEHVGLLHVVGIPATSAQDKQLLLHHTLGNGDFTVFRRMSSSITQTTGMVADAASGPQEIDRVIREAYINQRPSYLAFPTNMVELEVPKSALDTPIDLSIPDNDPETENEVLDRVTELISNSKNPIILVDACCARHGATGEARKLIDLTKFKFAVTPMAKGAKYIDEDHDRFAGVYVGTLSYPSVKEQVESSDLILSLGAMLSDFNTGSFSYSYQTKNVVEFHSDYTKIRSANYPNVRMKHVLQKLLESNKLKEAASKYEPVKVEKDPFPEEKRDELSKITQQWLWSKLSGWLRENDIVITETGTSSFGIIQTQFPKNTLGISQILWGSIGYTVGATCGAVMAAEEIDPNRRVILFVGDGSLQLTVQEISSMIKNKTKPYIFVLNNNGYTIEKLIHGETADYNSIQPWDHLKLLETFKAEDYESIRVSTVKELLDLFSDHKFAKNDKIRLIELMFDTMDSPQNLIEQARITAQTNSN

SEQ ID NO: 781 - protein, 551 aa, Debaryomyces hansenii
MSSPFPKTADKLKGVEILASIPDRAKHILNAEALALVATLHRAFQPTRKQLLANRKEQQAKRDRGELPDFLPETEQIRNDPTWTGPPLARGLEDRRVEITGPVDRKMVINALNSGVATYMADFEDSLTPAWDNLIDGQVNLYDGVRKNISFEQNGKKYALNTDPKRHLPTLIVRPRGWHLDEKHVRVDGEPVSGGIFDFAIYFYNNAKESVAQGFGPYFYLPKMEHHLEAKLWNDIFNHAQDYIGMTRGTIRGSVLIETLPAAFQMDEIIYQLRQHIGGLNCGRWDYIFSYIKSLRNHPEFILPERSQVTMSAPFMSSYVKLLVNTCHKRQVHALGGMAAQIPIKEDKARNQAALENVAKDKLREVNAGCDSCWVAHPALVPVVLKVFNEHMKGPNQINVPPKVPYTPVTARDLLSPYVPDAKITEQGIRTNIIIGLSYIEAWLRNIGCVPINYLMEDAATAEVSRTQIWQWVTHGSKTDEGKTITKEYVGKLLKEESDKLSKNAKSGNKFSQALVYFKPECLAEKYSDFVTTLLYDDVTTIGRPTAAEKL

SEQ ID NO: 782 - protein, 338 aa, Debaryomyces hansenii
MVKVTVCGAAGGIGQPLSLLLKLNPKIDELSLFDVVNVPGVGADLSHICSNSSTSSHLPSSREDKSALAESLKGSDLVIIPAGVPRKPGMTRDDLFNINASIVRDLAQGIAENAPKAFVLIISNPVNSTVPIVAETLKKNGVYNPQRLFGVTTLDIVRANTFISQKYAKETKATDFNINVIGGHSGETIVPLYSIGNSKSYYDKLSEEDKKALINRVQFGGDEVVKAKDGAGSATLSMAYAGYKLAESILKALTSKGEEVVECTFLNLDDSIKGAAEAKKLVKNLDFFSLPVRLGANGIEEVKYDILNNISADEKKLLEVAIEQLSGNIDKGVAFIKK

SEQ ID NO: 783 - protein, 332 aa, Debaryomyces hansenii
MFTKVAARSFSSSASSAYKVAVLGANGGIGQPLSLLLKLNHKVTDLALYDLKGAPGVAADVSHIPTNSTVSGYDPEGLEQALTGSDIIVIPAGVPRKPGMTRDDLFNTNASIVRDLAKAAADYAPDAAVCVISNPVNSTVPIVAEVLKSKGTYNPKKLFGVTTLDVLRASRFVSEVAGSNPVHEKVTVVGGHSGITIVPLLSQTEHKSLDQETRDALIHRIQFGGDEVVQAKNGAGSATLSMAQAGARFTGAVLDGLAGERDIVEPSFVDSPLFKSEGVEFFSSKVTLGQDGVSTVHPLGGLSDHEESLVKEAKDTLIKNIQKGVDFVKQNP

SEQ ID NO: 784 - protein, 637 aa, Debaryomyces hansenii
MLKANNFNTRIAKTTKLGKIQIRSNSNGVNNSNSSIHTHTIKTPVGIKAAIASLKPKTTRLSIEGPIECDLQGFALLNAPGFNKGSAFSKEERQAFGLEGLLPSRINSLDEQVERAYRQFSYLKTPLAKNDFCTSMRIQNKVLYYELVRRHIREMIPIIYTPTEGDAIAAYSHRFRKPEGCFLDITEPDMIDKRLSAFGEDKDIDYIVVSDGEGILGIGDQGVGGVRIAIAKLGLMTLCGGVHPGRVLPIVLDVGTNNQELLHDELYMGNKFPRVRGKEYWDFIDKFINAVKQRFPNAVLHYEDFGVSTGRKMLQKYRESLPSFNDDIQGTGAVVMASMTAALQFSDRNLLDSKVLIYGAGSAGLGIADQIVNHMVSHGATEEQAVASIHCMDRRGLLLKSFDEMSDAQTKYADVDSEWEGVDTRNLVEVIRHVKPTVLVGCSTQAGAFTEQVIKEMYNHNKQPIVFPLSNPTRLHEAFPIDIMKWTDNKALIATGSPFEPVNGFAISENNNCFTFPGIGLGAVLSRCTTISDTMVSAAVDQLALLSPKMENPKNGLLPRLEQIDEVSAKVATAVILQSLKEGTARVESEEKPDGGFVEVPKDFNKCLKWVQSQMWKPIYRPLVKVKHVPEVHTYQH

SEQ ID NO: 785 - protein, 324 aa, Debaryomyces hansenii
MMNKQFIRGFASTNPAKNYASTIKNLKVNSDTKVIYQGFTGKQGTFHAEQAIAYGTQVVGGTNPKKAGSKHLDRPVFATVKDAMKETGASATAIFVPPSIAAGAIEEAIEAEIALAVAITEGIPQHDMVRIAQMLKTQSKTRLVGPNCPGIIAPEQCKIGIMPSHIHKRGKVGVISRSGTLTYEAVSQTTQVGLGQSLVIGMGGDPFPGTNFIDALTLFLNDPETEGIILIGEIGGTAEEEAAEFLKQHNLTRPEGPKPVVSFIAGVSAPPGRRMGHAGAIVAGGKGDANSKIAALQSAGVVVEKSPARLGNSLLQEFKNKGLL

SEQ ID NO: 786 - protein, 414 aa, Debaryomyces hansenii
MLSRNIARASKTVANQKRFLSLHEFRSAALLKTYGVGVPDGSAATTPEKAYEVAKALGTNDLVVKAQALTGGRGKGHFDNGFQGGVKLISSPEEAKELAEKMLGHKLITKQTGEAGKEVTAVYIVERRDARTEAYLAILMDRSTQTPLIVASSQGGMDIEGVAAKDPDAIKSFPVPLEEGVSDKLATDIASVLGYTQEAIPEAAKTVQNLYKVFMERDCTQVEINPLSETPDHKVLAMDAKLNFDDNAAFRQKEVFSWRDPSQEDPEEVTAAEYGLNFIKLDGNIANIVNGAGLAMATMDIIKLYGGAPANFLDCGGTATPETIEKAFELILSDKKVNGIFVNIFGGIVRCDYVAEGLIAATKNFNLDIPVVVRLQGTNMAKAKELIENSGLKLYAFEDLDPAAEKIVALAPKA

SEQ ID NO: 787 - protein, 564 aa, Hanseniaspora uvarum
MSEITLGRYVFERIKQVGVNTIFGLPGDFNLSLLDKIYEVEGLRWAASLNELNAAYAADGYSRIKGLGVIITTFGVGELSALNGIAGAYAEHVGVLHIVGVPSLASQAKQLLLHHTLGNGDFDVFHRMSANISETTAMITDLAAAPAEIDRCIRTAYIAQRPVYLGLPANLVDLNVPAKLLETKIDLALKANDAEAENEVVETILALVADAKNPVILSDACASRHNVKAEVKQLIDVTQFPAFVTPLGKGSIDEKHPRFGGVYVGTLSSPEVKQSVESADLILSVGALLSDFNTGSFSYSYQTKNIVEFHSDYIKIKNASFPGVQMKFVLEKLIAKVGAKIANYSPVPVPAGLPKNAPVADSTPLAQEWLWNELGEFLEEGDIVVTETGTSAFGINQTRFPTDAYGISQVLWGSIGYSVGAMVGATFAAEELDKAKRVILFVGDGSLQLTVQEIACLIRWGLKPYIFVLNNNGYTIEKLIHGPTAQYNMIQNWKHLDILPTFGATDYEAIPVKTVGEWKKLTADPAFKKNSTIRLIEVFLPEMDAPSSLVAQANLTAAINAKQD

SEQ ID NO: 788 - protein, 564 aa, Hanseniaspora uvarum; identical to SEQ ID NO: 581

SEQ ID NO: 789 - protein, 175 aa, Hanseniaspora uvarum; identical to SEQ ID NO: 568

SEQ ID NO: 790 - protein, 363 aa, Hanseniaspora uvarum; identical to SEQ ID NO: 604

SEQ ID NO: 791 - protein, 361 aa, Hanseniaspora uvarum
MAIPKTQKGVTFYENNGELKYETIDVPTPKADEILINIKYSGVCHTDLHAWKGDWPLPVKFDPYCVGGHEGAGVVVAIGDNVKGWNLGDYAGIKWLNGSCMNCEECELSNESNCPEADLSGYTHNGSFQEYATGLAVQAAHIPKPEEGSQWYGKDDEYLAEVAPILCAGITVYKALKSADCKPGQWVAISGAAGGLGSLAVQYAKAMGLRVIGIDGGEGKEDLFKKCGGEIFVDFTKEKDVPAAINKATNGGAHGVISVSAAEAAISQSTQYVRTNGTIVLVGLPANAYCKSNVFEQVVRSYKIVGSYVGNRADTREALDFFERGLVRSPIKIVGLSELPRVFEEMAAGKILGRYVVDTTH

SEQ ID NO: 792 - protein, 339 aa, Hanseniaspora uvarum
MLKLLSTAPRNSFRAIALTSAPRFRFQSTFTIPETQKAVVFETNGGPLEYRDIPVPKSDWDLQTKLPLVGGHEGAGVVVGLGENVTGWKLGDYAGVKWLNGSCMSCELCEEGHESNCDDADLSGYTHDGTFQQGTDLAEVAPILCAGITVYKALKEASLKQGQWVAISGAGGGLGSLAVQYAKAMGFRVLAIDGGSDKGQLVKSLGAEEYIDFTTVQDVPKAAIATTGGGPHAVINVSVSPQAMQQSTEYVRKTGTVVLVGLPAGASINSPVFDTVLKCVTIKGSYVGNRADTREAIDFFARGLVKSPIKIAGLSELPRIFKEMEAGNILGRYVVDTSY

SEQ ID NO: 793 - protein, 625 aa, Hanseniaspora uvarum
MPAEHLTLDHEGKLAPPKGFTERSLSKPNLPDFETYQKLYKESIENPSKFFGEKALETYPESPKDDFKDGDIPAWFVGGELNASYNAIDRWAAKNPNKPAIIYEADEVNEGRIITYGELLKDVSKLAQALSKLGTLVTLLAIVRIGAVHSVVFAGFSSTSLKDRILDADSRIVITADESKRGGKTIETKKIVDDALKDCPNVRNVIVFERTGNPHVPFQKGRDLWWHEEVAKYGPYFPPVPVNAEDPLFLLYTSGSTGYLLGALLTTKYTFDVHEEDIIFTAGDIGWITGHTYVVYGPLLNGATTVVFEGTPAYPNYSRYWEIVDKYKINQFYVAPTALRLLKRAGTKHIEPYDLSSLRVLGSVGEPIAAEVWHWYNDNIGRGKAHIVDTYWQTESGSHLLTPLAGITSTKPGSASLPFFGIDAKILDPVTGEELTQANAEGVLAIKNAWPSITRGIFNDYARYIDTYLKPYPNYYFSGDGAARDADGFFWILGRVDDVVNVSGHRLSTAEIEAALIEHDLVAELAVVGYSDDLTGQAVAAYVSLKSTPANATADDLDAIRKELILTLILLVDDLPKTRSGKIMRRILRKILAGEEDQLGDISTLSNPAIVAHIIEVVKNSSKKK

SEQ ID NO: 794 - protein, 674 aa, Hanseniaspora uvarum
MSTNHVEVHEANGVSFRQAPEHFFKSQPSKSYIVDEAQYKAWYDQSINDPESFYGALAKEYLHWDKPFTKVRSGDLNNGDISWFLQGELNACYNCVDRHAFANPDKIALISEPDEESEAYSITFQQLLEKVCKVAGVLQSWGVKKGDTVAVYLPMTPEAVIAMLAIARIGAVHSVVFAGFSAGSLKDRVVDAGSKVVITCDEAKRGGKTINTKKIVDEGLNGVQSVSKILVFKRTGNPDVKMTPGRDYYWDEVCATQRSYVPCVPTNAEDPLFLLYTSGSTGQPKGVVHTVGGYLLNAALSTRFVFDLHPEDVFFTAGDVGWITGHTYALYGPLSLGTASIIFESTPAYPDYGRYWRIVNRWKATHFYVAPTAMRLIKKVGEAEIAKYDISSLRVLGSVGEPIQPDLWEWYNEKVGNNNCCIVDTYWQTESGAHLITPLAGAFPTKPGSASLPFFGIAPAIIDPATGKELEGNDVAGVLAIKSTWPSVARTVYNDHSRYMETYLKPFAGYYFTGDNAARDNDGYYWIRGRADDVVNVSGHRLSTNEIETVLDEHSGVTECACIGINDDLTGQAVVAFISLKDGACDITNESDFTVFKKSLVMEVRGVIGPFASPKAIIAVSDLPKTRSGKIMRRVLRKIASNEMEQLGDLSTMANPECVPKIIAAVDSQFFVKK

SEQ ID NO: 795 - protein, 655 aa, Hanseniaspora uvarum
MTQFVHQVAHEANDIKPRPTPKEFFERQPNKGHLETIDQYYELYNKSIQDPEGFFGPLAKELLHWDKDFSKVKNGSLKDGDVSWFLGGELNASFNCIDRHAFVNPTKPAIIYEADEEKDSSILTYGELLQQVCKVAGVLKSWGIKKGDTVAIYLPMTSQAIIAMLAVARLGAIHSVIFAGFSSGSIKDRVIDASCKALITCDEGRRGGRTVNIKKLCDEALNLCPSVENVLVFKRTGSEGIYMKEGRDFWWDEETAKFPGYLPPVPVNSEDPLFLLYTSGSTGTPKGVVHLTGGYLLGAALTTKYIFDVQPEDVFFTAGDVGWITGHTYALYGPLALGVPTIVFEGTPAYPDYGRLWQIVEKHKATHFYVAPTALRLLRKAGEQEIEKYDLSSLRTLGSVGEPISPDIWECPDPISLLQLPESLQNKPGSASLPFFGIETCIIDPVSGKEIEGNDVEGVLAVKSSWPSMARTVWNNHTKYMDTYLNPYPGYYFTGDGAARDNDGYYWIRGRVDDVVNVSGHRLSTAEIEAALIEHHGVSEAAVVGINDDLTGQAVIAFVSLKSEAPDAKEEEALFKLKKELILQVRTVIGPFAAPKHIVIVGDLPKTRSGKIMRRILRKVSAGEADQLGDITTLANPQSVAEIITAVDQQFFGKK

SEQ ID NO: 796 - protein, 439 aa, Hanseniaspora uvarum
MLRTTVRAVNAGRFTPTFISSRSFSQNLSLLDKIKVKNPIVELDGDEMTRIIWQRIKDKLINPYLDVDLKYYDLGIQARDATDDQITIDAAEAIKKYGVGVKCATITPDEQRVEEFGLKKMWVSPNGTIRNILNGTVFRESIIIPRIPRLIPGWEKPIVIGRHAHGDQYKATDLVISEPGKLEMTFTPADPSSKPETKLIYNYKSPGVGLAMYNTDESIIGFAHSSFKMALTKNLPLYLSTKNTILKKYDGRFKDIFQEIYESTYKSEFESKGLWYEHRLIDDMVAQMIKSKGGYVMALKNYDGDVQSDIVAQGFGSLGLMTSVLMTPDGKAFESEAAHGTVTRHYRQHQQGKETSTNSIALIFAWSRGIAQRGRLDGTPAVVEFADALEKATIDTVQEDGIMTKDLALACGKTDRSSYVTTLEFLDAVADKLKNKVQV

SEQ ID NO: 797 - protein, 416 aa, Hanseniaspora uvarum; identical to SEQ ID NO: 562

SEQ ID NO: 798 - protein, 330 aa, Hanseniaspora uvarum
MPAEKIKVVTPVVDLDGDEMTRIIWKFIKDKLIFPYLDIDLKYYDLGIEYRDETDDKVTVDSAEAILKYGVGIKCATITPDEQRVKEFGLKKMWLSPNGTLRNILGGTVFREPIPIIIGRHAFGDQYKATDVIVPQAGKLQLVFKPEDGSEETVYNVRSRIFAESSFKLALDRKMNLFLSTKNTILKKYDGRFKDIFESLYETKYKKDFDAAGIWYEHRLIDDMVAQMLKSKGGYIIAMKNYDGDVQSDIVAQGFGSLGLMTSVLTTPDGKAFEAEAAHGTVTRHYRQHQQGKGDFHQLNCADLRLDQRVDSKREFIDAVANRLNKNLAK

SEQ ID NO: 799 - protein, 685 aa, Hanseniaspora uvarum
MLINRLLSLKLSKSGESKCGQIKELSSNIERWRVGISRVIHSSNYDAPEEYISHVNLNYYYFLIELDQISLSESFQFTLQFLSNSFTLLMHYDERNYNRKRNGESEDEKKVIGFSLSTLFWYLKLFQVVIGEGVKEKTTNAAKFVGENYHIVDHEYDCIVVGAGGAGLRAAFGLAEAGFKTACISKLFPTRSHTVAAQGGINAALGKCAQRRLALAYAPKAIYELEHYGVPFSRNSESRIYQRAFGGQTKEYGKGGQAYRTCAVADRTGHALLHTLYGQSLRHNTHFFIEFFALDLLMQDNECVGVIAYNQEDGTLHRFRAHKTVIATGGYGRAYFACTSAHTCTGDGYAMVARAGLPLEDMEFVQFHPSGIYGSGCLITEGARGEGGYLVNSEGERFMERYAPLAKDLACRDVVARAITMEINEGRGVGPDKDHMFLELSHIPAAVLKERLPGISETAHIFAGVDITKEPIPIIPTVLTKDPSTGEDKVVPGLFACGEAACASVHGANRLGANSLLDLVNYQEDLGKKSIENLDRARNANGSKSTAEIRTSMQKTMQKGCAVFRTEETLQECVRNITKVDSAFSDVRTTDRSMIWNSDLVETLELQNLLACATQTAAAAAARKESRGAHAREDYPDRDDVNWMKHTLSYQKTGGSDVTLEYRDVISTTLDEKECKAVPPTIRAY

SEQ ID NO: 800 - protein, 631 aa, Hanseniaspora uvarum
MLRQLRQFSTTRIARQTIGNDIKGTNLNSTKYLGQKYHVIDHEYDCIVVGAGGAGLRAAFGLAEAGFKTACISKLFPTRSHTVAAQGGINAALGNMHKDDWHWHMYDTVKGSDWLGDQDAIHYMTREAPKSIYELENYGVPFSRNEEGRIYQRAFGGQSKEYGKGGQAYRTCAVADRTGHALLHSLYGQSLRHNTHFFIEFFAMDLMMQDGACVGVVAYNQEDGTLHRFRAHKTVIATGGYGRAYFSCTSAHTCTGDGYAMVSRAGLPLEDLEFVQFHPTGIYGSGCLITEGSRGEGGFLVNSEGERFMERYAPSAKDLASRDVVSRAITMEINEGRGVGPEKDHMFLQLSHLPAAVLKERLPGISETAHIFAGVDVTKEPIPILPTVHYNMGGIPTKWNGEVVTQDPKTGEDVIVPGLLACGESACASVHGANRLGANSLLDLVVFGRAVAHTITDLLTPGTPLPPMPADLGKESIENLDKIRNASGPKATADIRLEMQKTMQKGCAVFRTQETLDEGLEKILAIDKTFKDVGVTDRSMIWNSDLVETLELQNLLTCATQTAKSATERKESRGAHARDDYPERDDVNWRKHTLSWQKEFGDDVVLGYRDVVKTTLDENECKPVPPAKRVY

SEQ ID NO: 801 - protein, 568 aa, Hanseniaspora uvarum
MMMISHIRSYATKSVHTHTIKTPVGIKAALATLKPKTTRLSIEGPIECDLDERTAFKLNGLLPAQVNTLDEQVDRAYSQFSYLKTPLAKNDFCTSMRIQNKVLYYELVRRHIREMLPIIYTPTEGDAIAAYSHRFRKPEGCFLSITDPDGIEDRLALYGEDKDIDYVVVSDGEGILGIGDQGVGGIRIAIAKLEFLPICLDVGTDNKELLNEELYMGNKFPRVRGEEYWTFVDKFIHALKKRFPSAVLHYEDFGVRTGRTMLHRYRETLPSFNDDIQGTGAVAMASMTAALKFSNRELLDSRVLIYGAGSAGIGIADQISNHMRLHGLILDTHDYPTPAQKVYADKASEWEGVDTKSLLEVIKKVKPTVLVGCSTQPGAFTEEVIKEMYKHNKQPIVFPLSNPTRLHEAFPVDIMKWTDNNALIATGSPFPPVDGHVISENNNCFTFPGIGLGAVLSRCTTITDTMISAGVDQLASLSPKMEDPKNGLLPRLEEIDEVSAKVATAIILQALEEGTARVEEEERPNGGRVQVPRDFNKCLKWVQSQMWKPVYRPLVKVEHVPEIHTHQY

SEQ ID NO: 802 - protein, 434 aa, Hanseniaspora uvarum
MADFEDSTSPKWANLLNGQVNLYDAIRGQVDFVDPNTGKSYVVDKSPSRHIPTILVRPRGWHMVEKHLIIDGEPCSASIFDFGLYFFHNAKELIAKGHGPYFYLPKMEHHLEAKLWNDIFNVSQDILQISRGTVRATVLIETLPAAYQMEEILYQLRDHSSGLNCGRWDYIFSTIKTFKNRSDKILPDRGLVTMTVPFMSSYCKRLIEICHKRGVHAMGGMAAQIPIKNDVEANQIAMDKVTKDKLREVTMHHDGTWVAHPALATIANAIFDQYMPTPNQIFVTTTANISETDLSNTSIVGGTVTLAGIRQNIYIALCYIESWLRGVGCVPINYLMEDAATAEVSRLQLYSWVKNKVILDDCKAAITPELMESMLKEETAKLVQLASEGNKFEMAANSLLPEIRGDSISDFLTTLIYDNIVEAGAPIDLGTLKQ

SEQ ID NO: 803 - protein, 337 aa, Hanseniaspora uvarum
MLQTTFSRRLFSQSMANQYKVAVLGASGGIGQPLSLQMKLNHKVSELRLYDLRLAKGVAADLSHIPTDSKVIGYSNDEPEGLAKALDNADVVLIPAGVPRKPGMTRDDLFSINAGIVRDLAEAVAKNCPNASICVISNPVNSTVPIVAKVLQKHGVYNPKKLYGVTTLDIIRASRFISEVEGTNPTQEKVNVVGGHSGITIIPLISQTNHKLMPKEVKDKLIHRIQFGGDEVVKAKDGAGSATLSMSYAGAVFADKVLDGLLGEKDVVVNSFVESPLYKEEGIDFFSSPITLGPEGVQKVHPIGEISSEEEALLAECKETLKKNIAKGYKFVEESKL

SEQ ID NO: 804 - protein, 512 aa, Enterobacter asburiae
MTNNPPSNRILPGEYGYPLKLKPRYDNFIGGEWVAPVEGEYYQNLTPITGQPLCEVASSGKKDIDLALDAAHKAKAGWAQTSVQDRAAVLLKIADRMEQNLELLAAAETWDNGKPIRETSAADVPLAIDHFRYFASCIRAQEGGISEVDNDTVAYHFHEPLGVVGQIIPWNFPLLMASWKMAPALAAGNCIVLKPARLTPLSVLLLMEVVGDLLPPGVLNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDATTQMGAQVSHGQLETILNYIDIGKKEGADVLTGGRRKLLEGELKEGYYLEPTILFGKNSMRVFQEEIFGPVLAVTTFKTMDEALELANDTPYGLGAGVWSRNGSLAYKMGRGIQAGRVWTNCYHAYPAHAAFGGYKQSGIGRETHKMMLEHYQQTKCLLVSYSDKPLGLF

SEQ ID NO: 805 - protein, 506 aa, Pantoea sp.
MRYAAPGEQGSLITLQKNYGNFINGEFVAPVNGNYFTNTSPVNGSAAGEFPRSDVADVDNAVAAAAAAAEAWGKTSPQQRSLLLLKIADRLEQHLETMAVYETWDNGKPVRETLAADMPLAVDHFRYFAGCVRAQEGSAAEIDEFTAAYHFHEPLGVVAQIIPWNFPLLMAAWKLAPALGAGNCVVLKPAEQTPLSITVFVDLIKDLLPPGVLNVVHGFGKEAGEALASHSGIAKVAFTGSTATGGHILELAAKSLIPSTVELGGKSPNIFFEDIMQAEESFIEKAAEGVVLGFLNQGEVCTCPSRALVQESIYEPFMAAVMKRVKTIKRGDPLDTETMVGAQASQQQFDKILSYLEVARQEGAEVLVGGGVETLDDSLNSGYYIQPTLLKGNNSMRVFQEEIFGPVIGITTFKDEAEAISIANDSIYGLGAGVWTRDINRAYRVGRAIKAGRVWTNCYHLYPAHAAFGGYKKSGIGRETHKMMLDHYQQTKNLLVSYSIEPLGFF

SEQ ID NO: 806 - protein, 550 aa, Pantoea sp.
MSTFTVGDYLLTRLQEIGVKHLFGVPGDYNLQFLDHVIAHPAISWVGCANELNAAYAADGYARCNGAGALLTTFGVGELSAINGIAGSYAEYLPVIHIVGAPATQAQLQGDCVHHSLGDGDFQHFIRMATEVSAATAQLTADNATAEIDRVIVSALQARRPGYLSMAVDVAAMEVQPPAQPLNSHQSSSPAARRAFSDAAERLLAPAQRVSLLADFLALRWQQQSALAALREQRAIPCASLLMGKGVLDEQQPGYVGTYAGEASAGQVCEQIEQVDVAICVGVRFTDTITAGFTQQFNPERLIDLQPLSASVGGERFAPLSMADALSELLPLFERYGQQWQPGATPPAAQPAEPAAAISQQAFWQAMQAFLQPGDLILAEQGTAAFGAAALRLPSQAQLVVQPLWGSIGYTLPAAFGAQTADPDRRVILIIGDGSAQLTIQELGSMLRDQQRLILFLLNNEGYTVERAIHGATQRYNDIAQWNWTALPHALSLQGQAQSWRISETVQLEEVMARLSEPKWLSLVEVVMQKEDLPPLLRKVTACLNQRNGG

SEQ ID NO: 807 - protein, 567 aa, Debaryomyces hansenii
MSEVSLGRYIFERLRQLLVQTVFGLPGDFNLSLLDKIYEVDGLRWAGNANELNAAYAADGYSRVKGLACLITTFGVGELSALNGIGGAFAEHVGLVHIVGVPSISSQAKQLLLHHTLGNGDFTVFHRMSNNISQTTAFISDIKSAPKEIDRCIREAYIFQRPVYIGLPANLVDINVPAVLLNIPIDLSLRENDPEAQEEVIDNILQLISEASNPVILVDACTSRHNCNGEVEALVNKTQFPVLTTPMGKSSFNESHPRFAGVYVGTMSHVEVKNLVDGADLILAVGALLSDFNTGSFSYSYKTKNVIEFHADCIKIKQGTYPGVQMKEVLNVLIDKIDPAVKHYNPIAIPSPTFLTNSVTNSDVLSALLTQEWLWSKVSAWFREGDIIITETGTSAFGIVQTKFPNNTIGISQVLWGSVGFTVGATLGAVMAAEEIDPNKRVILFVGDGSLQLTVQEISTMVKWETRPYLFVLNNDGYTIDRLIHGMSATYNDIQPWNNLALLPLFNAKYYDAIQVSTTDELEKLFCDEEFAINSKIRMIEVMLPRMDAPINLIKQMEFISKMNADT

SEQ ID NO: 808 - protein, 578 aa, Debaryomyces hansenii; identical to SEQ ID NO: 780

SEQ ID NO: 809 - protein, 307 aa, Debaryomyces hansenii
MKHNVAALQIGASPLGTKATMEKIMSYESRIKELNVQLVVMPEATIGGYPKGSTFGTYLGYRTQSGREEFAKYHRSAISLPGPETEALLDFSKRTGATLVIGVIEKDGATLYCTMIYIDPEVGYIGKHRKLMPTASERLVWGQGDGSGLITPDNKHLGKLGGAICWENYMPLYRATMYAKGINVYCAPTVDDRDIWKSLMRTIGTEGRLFVISAVQFLPTPEECGLDLPEWEKGKNCINGGSVIVNPYGDIIAGPLTGEEGLLTAEIDLDMIVEARYDLDVTGHYARNDIFKLTVDERPKDGVSFIN

SEQ ID NO: 810 - protein, 525 aa, Galactomyces geotrichum
MSIARTFNLASKTLKVSPTKSLAFSAMRLYSTKLPLSTEVTLPNGLKYEQPTGIFINNEFKPSISGKTFKVENPSTEQVVAEIYEGDVEDINVAVDAAEKAFKTWSVLPPSERGRLLCKLADKIEENLELLASIESTDNGKAIALARGDVTLVARVLRYYGGFADKITGTVIETNDGHFTYTRREPIGVCGQIIPWNFPLLMWSWKVGPALATGNTVVLKTAESTPLSALVASKLAAEVGFPPGVLNIVSGYGKAGAALSSHMRVKKVAFTGSTNTGRSILRAAAESNLKKTTLELGGKSPNIVFADADIGKAIEMTNLGIFYNSGEVCCAGSRIYVQDSIYDKFLQELKVRSEANKVGDPFDSETFQGPQTSKTQLDKILHYIDIGKKDGATLVTGGKRLDRPGYFIAPTVFADVKEDMQVVKEEIFGPVVTVSKFSSVDEVIELANNSEYGLAAGIHTQDVNKAIDVSNRLNAGTIWVNTYNSFHEAVPFGGYGQSGIGREMGEQALDNYTQVKAVRLAIEKK

SEQ ID NO: 811 - protein, 573 aa, Rahnella aquatilis
MKQSVAAYLAKTLEAAGVKRIWGVTGDSLNGLSDSLNRMGTIEWLGTRHEEVAAFAAGAEAQITGELAVCAGSCGPGNLHLINGLFDCHRNHVPVVAIAAHIPSSEIGSGYFQETHPTELFRECSHYCELISNPEQLPQVLAIAMRKAILNRGVSVIVLPGDVALKPAPEDAKISWYPPVLPKVTPQPTELEKLAELLNGSTNITMMCGSGCAGAHDEVIKLAETLKAPVVHALRGKEHIEWDNPYSVGMTGLIGFSSGYHAMLNADTLILLGTQFPYRAFYPTDAKIIQIDINPGSIGAHCHVDMALVGDIKSTLTALLPQLQVKNERKFLDKALKHYEEARKDLDGLATPNDKQAIHPQYLAQQISRFAAADAIFTCDVGTPTVWACRYLQMNGQRRLLGSFNHGSMANAMPQAIGAQAIDRSRQVVALCGDGGFAMLMGDFLTLAQQKLPVKIIIFNNSVLGFVAMEMKSGGYLTDGTELKNPDFAAIAEAAGIKGIRVEKASDIDTALQDAFAYEGPVLIDVITATEELAMPPQIKFEQAKGFSLYMLRAVISGRGDEVVDLAKTNWLR

SEQ ID NO: 812 - protein, 472 aa, Rahnella aquatilis
MQTNMLINGELVAGEGTSLPVYNPHNGQEIVRLAQASEQQTKQAVDLAHKAFTEWGQTTPKTRSELLLALADRIEENAEALAKLESLNCGKPFHLALGDEIPAVADVFRYFAGASRCLNGLASGEYLTGHTSMVRRDPLGVIASIAPWNYPLMMAAWKIAPALAAGNCVVIKPSEITPLTALKLGELAQDLFPAGVLNVLFGDGQTVGNALTHHDKVRMISLTGSVATGEKIVAQATSGIKRTHMELGGKAPVIVFDDADIDQVVEGVRTFGFYNAGQDCTAACRLYVQKGVYSRLVNALGAAVSTIKLGTDESAEMGPLVSAAHLERVEGFVQRAKQQAHIQVVTGGERVRGEGYYFQPTVLAGARQEDEIVQREVFGPVVSITEFDTEDQVLDWANESNYGLASSVWTQNIGRAHRLSARLQYGCTWVNTHFMLVSEMPHGGQKQSGYGKDMSMYGLEDYTAIRHVMIKH

SEQ ID NO: 813 - protein, 487 aa, Rahnella aquatilis
MSDAEFVASFSDKHAINGDLLHGEGATQSIFNPATGDIIAEVAETSLAQVDMAVNAASQAFTRWSRTTPAERGTLLLRIADAIEKQAPQLARLEALNCGKPLHQALNDDLPAAVDVFRFFAGAVRCQQGQLAGEYLPGHTSMVRRDPLGVVASIAPWNYPLMMSAWKIAPALAAGNTVVFKPSEHTPLTILALLPALQDILPPGVLNVITGSGESVGNALVSHSHVRLISLTGDIVTGQRILQAAVKTVKRTHLELGGKAPVIVCNDADIDDAVHAVSTWGYYNAGQDCTSACRVYAQAGIYERLVEKLGDAIAQLPFAKKNDSENFMGPLISARQRDRVSSFVERALSQPHIERITGAASHSGSGFYYQPTLLAGCLQSDEIVQREVFGPVVSVTRFDSLEQVVSWANESEYGLASSVWTQNIDLAMQISSHLQYGTTWINTHFSLVSEMPHGGLKRSGYGNDLSSYSLQDYSVVRHIMAKFKPQF

SEQ ID NO: 814 - protein, 476 aa, Rahnella aquatilis
MAFDDLRSFMRALDENGQLLKITEQVKAEPDLAAAANATGRIGEGAPALYFDNVEGFTDARIALNTLGSWPNHAIAMGLPPSTSTNEQIAEYIRRWDTFPITPERRENPAWAENTVDGEDINLFDILPLFRLNDGDGGFYLDKACVVSRDPTDPDSFDKQNVGIYRMEVKGKRKLGLQPVPMHDIALHLHKAEERGEDLPIVITLGNDPIITLMGATPLKYDQSEYEMAGALRQAPYPIATAPLTGFDVPWGSEVILEGVIEGRKREIEGPFGEFTGHYSGGRNMTVVRIDKVSYRNNPIFESLYLGMPWTEIDYLMGPATCVPLYQQLKAEFPEVQAVNAMYTHGLLAIISTKKRYGGFARAVGLRAMTTPHGLGYVKMVIMVDENVDPFNLPQVMWALSAKVNPAGDLVQLPNMSVLELDPGSSPAGITDKLIIDATTPVAPDNRGHYSQPVRDLPETKDWVAKLNSMLDGRKA

SEQ ID NO: 815 - protein, 289 aa, Rahnella aquatilis
MKGIILAGGSGTRLYPVTMGVSKQLLPIYDKPMIYYPLSVLMLAGIREILIITTPEDRWSFERLLGDGSSFGVKLSYEVQPSPDGLAQAFIIGENFIGLDSVCLVLGDNIFFGQGFSSKLRSVAERTDGATIFGYHVIDPERFGVVDFDAKFNALSIEEKPKNPKSSWAVTGLYFYDNSVIEIAKNIKPSERGELEITAVNEEYLRRSKLQVELLGRGFAWLDTGTHDSLIEAGAFVETVQKRQGMMVACPEEIAWRNGWLSDEELIARGEKFNKNSYGQYLLKLIHSV

SEQ ID NO: 816 - protein, 437 aa, Rahnella aquatilis
MSAQTGSPRAAGVPHTDSYYASSAHNHAPWPELTDNIECDVCIVGAGYTGISSALYLCEAGYDVVVLEAARVGWGASGRNGGQVVNSYSRDIDVIEERYGRQTADMLGSMMFEGANIIRQRIDQYAIDCDYRPGCIFAALSARQLTKLRDQQKLWNRYGHTELRLLDETAVRREIATDRYVGGLLDKNGGHLHPLNLVLGEAEAVRRHGGRIFEGSAVTRIDHGEPALVHTAKGQVKAKYVILAGNAYLSQQLAPRLTRLSMPCGSQIVATEPLSDDMALSLLPNNYCVEDCNYLLDYFRLTADNRMLYGGGVTYGGKNPPNIDSVILPKLNRTFPQLKGVKIDYRWGGNFLLTLSRLPQFGRLENNIYYMQGDSGHGVTLTHLAGKLITEMLRGDAERFDAFARLPHMPFFGGRNFQVPFTMLGAAYYSLRDRLGV

SEQ ID NO: 817 - protein, 267 aa, Rahnella aquatilis
MGNIFSTTSTGKETRYRPVIGVVMCENTVDENPALTVHEKYLDAIFNADALPVCLPHELAAREGAIDQILRGLDGIFLTGSPSNIEPHQYGEEGVEELADPGRDRLSLQLIRATLEKKIPLFAACRGLQELVVATGGSLHRKVQDVPGYMDHREDSSLPHDEQYALVHPVHIEPGGLLSELLPDYQQFQVNSLHGQGANRLGDVLTVEARAPDNLVEAVSVRNHPFALGVQWHPEWHSLTDPVSRQLFEAFIAACRKGHQARSAREE

SEQ ID NO: 818 - protein, 478 aa, Rahnella aquatilis
MQATELMNEIKKEISEPLAKHAEERSSAFQDEVTQYLERHPQTLHVDVLLTDLNGSFRGKRIPVSALRKLEKGCYFPASVFAMDILGNVVEEAGLGQELGEPDRTCIPVPGTLTPSASDPEHIGQLLLTMLDEDGTPFNVEPRNVLNHIWQTLRQRGLFPVVAVELEFYLLDRQRDAEGYIQPPCTPGTQERSMHTQVYSVDNLDHFADVLSDIDRLAHIQGLPADGAVAESSPGQFEINLHHSENILRACDYALMLKRLVRLVAENHDMDATFMAKPYDEYAGSGMHIHLSVLDDNGKNLFAGAGGEDSELMKRSLAGMIALMPASMAVLAPNVNAFRRFQPGMYVPTQASWGHNNRTVALRVPCGGTADHRVEYRVAGADANPYLVVATVLAGMLHGLDNDLPLPEPVTGNGLEQEGIPLPIRQSDALYDFDDQPALKKILGERFSHVYHTCKSNELLQFERRVTETEIDWMLRNA

SEQ ID NO: 819 - protein, 461 aa, Rahnella aquatilis
MKVTQSNKDDVYASAELASSLPTSVFPIAECEPRNIFNAIRDELLLDGNSRQNLATFCQTWVDDEIRELMDLSIDKNMIDKDEYPQTAEIEARCVRMLADLWNSPMPTTTLGCSTIGSSEAAMLGGLALKWQWRKKRALQGLPSDKPNLICGPVQICWHKFARYFDVELREIPLEGDRLIMSPEEVLKRVDENTIGVIPTLGVTFTCQYEPVKAVSDALDKLQLQTGQDIPMHIDGASGGFLAPFCAPELEWDFRLPRVKSINASGHKFGLAPLGAGWVIWRESSDLPEELIFNVNYLGGNMPTFALNFSRPGGQIVAQYYNFLRLGREGYAKIHNACYATAQHLAAEIGKLGPFEIIFDGDSQKGIPALAWTLKEGAYLGGYTLYDLAEKLRVRGWQVPAYSMPSHREDLVVQRILVRHGVSYDLGCLLIEDMKRALNDFMSHPLSQPSSASRTGGFNHA

SEQ ID NO: 820 - protein, 458 aa, Pseudomonas koreensis
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVTKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISILDKAGKNIFASEDPEQNAALRHAIGGVLETLPAQMAFLCPNVNSYRRFGAQFYVPNSPCWGLDNRTVAIRVPTGSADAVRIEHRVAGADANPYLLMASVLAGVHHGLVNKIEPGAPVEGNSYEQNEQSLPNNLRDALRELDDSEVMAKYIDPKYIDIFVACKESELEEFEHSISDLEYNWYLHTV

SEQ ID NO: 821 - protein, 497 aa, Pseudomonas koreensis
MTTLTRADWEQRARDLKIEGRAFLNGEYTDAVSGETFECISPVDGRLLGKIASCDAADADRAVENARATFNSGVWSRLAPTKRKATMIRFASLLKQHAEELALLETLDMGKPISDSLYIDVPGAAQALSWSGEAIDKIYDEVAATPHDQLGLVTREPVGVVGAIVPWNFPLMMACWKLGPALSTGNSVILKPSEKSPLTAIRIAALAIEAGIPKGVLNVLPGYGHTVGKALGLHNDVDTLVFTGSTKIAKQLMVYAGESNMKRVWLEAGGKSPNIVFADAPDLQAAAESAASAIAFNQGEVCTAGSRLLVERSIKDKFLPMVIEALKAWKPGNPLDPATNVGALVDTQQMNTVLSYIESGHSDGAKLVAGGKRILQETGGTYVEPTIFDGVSNAMKIAQEEIFGPVLSVIAFDSAEEAIQIANDTPYGLAAAVWTQDISKAHLTAKALRAGSVWVNQYDGGDMTAPFGGFKQSGNGRDKSLHAFDKYTELKATWIKL

SEQ ID NO: 822 - protein, 410 aa, Pseudomonas koreensis
MTQTSNTSDLRNGPDANGLFGAFGGRYVAETLMPLILDLAREYEAAKEDPAFKEELAYFQRDYVGRPSPLYFAERLTEFCGGAKIYLKREELNHTGAHKINNCIGQILLARRMGKKRIIAETGAGMHGVATATVAARFGLDCVIYMGTTDIERQQANVFRMKLLGAEVIPVVAGTGTLKDAMNEALRDWVTNVDNTFYLIGTVAGPHPYPAMVRDFQAVIGKETRDQLQAQEGRLPDSLVACIGGGSNAMGLFHPFLDDKSVEIIGVEAAGYGIETGKHAASLNGGVPGVLHGNRTFLLQDDDGQIIDAHSISAGLDYPGIGPEHAWLHDIGRVQYTSVTDDEALEAFHKCCRLEGIIPALESAHALAEVFKRAPKLPKDHLMVVNLSGRGDKDMQTVMHHMQQSQQEKH

SEQ ID NO: 823 - protein, 506 aa, Pseudomonas koreensis
MRYAHPGTDGAKVSFKSKYGNYIGGEFVAPVKGQYFTNTSPVNGQPIAEFPRSTAEDIDKALDAAHAAADAWGATSVQARSLILLKIADRIEENLELLAITETWDNGKAIRETLNADIPLAADHFRYFAGCLRAQEGSAAEIDGNTVAYHIHEPLGVVGQIIPWNFPLLMAAWKLAPALAAGNCVVLKPAEQTPLGICVLMELIGDLLPPGVLNVVQGFGKEAGEALATSKRIAKIAFTGSTPVGSHIMKCAAENIIPSTVELGGKSPNIFFEDIMQAEPSFIEKAAEGLVLAFFNQGEVCTCPSRALVQESIYDEFMQAVMKKVSQIKRGDPLDTDTMVGAQASEQQFDKILSYLEIAKGEGAELLTGGKVEKLEGSLATGYYIQPTLLKGTNKMRVFQEEIFGPVVSITTFKDEAEALAIANDTEFGLGAGLWTRDINRAYRMGRAIKAGRVWTNCYHLYPAHAAFGGYKKSGVGRETHKMMLDHYQQTKNLLVSYDINPLGFF

SEQ ID NO: 824 - protein, 296 aa, Pseudomonas koreensis
MTTTNRKGIILAGGSGTRLHPLTLGVSKQMLPIYDKPMIFYPLSVLMLAGMREILIISTPEDLPCFRKLLGDGSVYGIKLTYAEQPSPDGLAQAFIIGEDFIGEDPCCLILGDNIFYGQHFSDNLRSASSQQKGATVFGYHVSDPERFGVVEFDNTGRALSIEEKPLKPKSNYAVTGLYFYDNDVVEIAKSIKPSDRGELEITDVNRAYLERKTLNVEMLGRGFAWLDTGTHDSLLEASHFVHTIEQRQGLKVACLEEIAFHNGWITAEQLGAQADALKKTGYGQYLQKLLDSSFR

SEQ ID NO: 825 - protein, 427 aa, Pseudomonas koreensis
MANTQYPESYYAASANAVPPRPVLQDDVETDVCVIGAGYTGLSSALFLLENGFRVTVLEAAKVGFGASGRNGGQIVNSYSRDIDVIERTVGPKQAQLLGEMAFEGGRIIRERVARYNIQCDLKDGGVFAALSAKQMGHLESQKRLWERFGHTQLELMDQRRIREVVGCDQYVGGMLDMSGGHIHPLNLALGEAAAVESLGGTIYEQSPAVRIERGANPVVHTPQGKVRARFIIVAGNAYLGNLVPELAAKSMPCGTQVITTEPLGDELAKALLPQDYCVEDCNYLLDYYRLTADKRLIFGGGVVYGARDPANIEAIIRPKMLKAFPQLKDVKIDYAWTGNFLLTLSRLPQVGRLGDNIYYSQGCSGHGVTYTHLAGKVLAEALRGQAERFDAFADLPHYPFPGGQLLRTPFAALGAWYYGLRDKYGL

SEQ ID NO: 826 - protein, 427 aa, Pseudomonas koreensis
MKQQHVNSYYAATRNEVIDFPILEEALDCDVCIIGAGYTGLSSALFLSEAGYKVTVLEAAKVGYGASGRNGGQLVNSYSRDVDVIEERYGDKTAEILGSMIFEGADIIRSRIKDYDIKCDYRPGGIFAAMNKKQLNGLAEQKRNWERYGNRNLKMLDAADIRREVGSDAYVGGLLDMQGGHVHPLNLALGEAAAIVRLGGKIYEQSAAVEITYGEPITVRTAKGLVRAKYLLIAGNAYLPQGLDNRVTAKSMPCGSQIVVTEPLTEQQARSLITNNYCVEDCNYLLDYYRLTADNRLLYGGGVVYGAREPDDIEQLIRPKILKTFPQLKDVKIDYRWTGNFLLTMSRMPQFGRIEKNAYYMQGYSGHGVTCSHLAGKLISEMIRGDAERFNAFASLPHMPMLGGRTFSAPLTALGAVYYSLRDRFGV

SEQ ID NO: 827 - protein, 496 aa, Pseudomonas koreensis
MTTTRNDWEQRFQSLSIESRAFINGEYRPALSGDTFECLSPVDGRFLAAVASTDEADANLAVEAARQSFNSGIWAKKAPAERKRVLIRFADLILQHQEELALLETLDMGKPISDSMSIDIPATANAIRWSAEAIDKIYDEVAATPHDQLGLVTREPSGVVAAIVPWNFPLIMASWKFAPALAAGNSFILKPSEKSPLTAIRIAQLALEAGIPKGVFNVLPGYGHTVGKALALHMDVDVLAFTGSTAIAKQLMIYAGQSNMKRVWLEAGGKSPNVVFADAPDLRAAAQAAASAIAFNQGEVCTAGSRLLVERSIREQFIPLLVEALQAWKPGHALDPATTVGAVVDQRQLDNVLRYISIGREQGAELIAGGQRTLEETGGLYVQPAIFDGVTNAMTIAQEEIFGPVLSLITFDTAEEALQIANDSIFGLAAGVWTSNLSKAHTFARGLRAGSVWVNQYDGGDMTAPFGGFKQSGNGRDKSLHAFDKYTELKATWIKL

SEQ ID NO: 828 - protein, 458 aa, Pseudomonas koreensis
MSVPLRTVQLNEANAFLKKYPEVLYVDLLIADMNGVVRGKRIERTSLHKVYEKGINLPASLFALDINGSTVESTGLGLDIGDADRICYPIPGTLSIEPWQKRPTAQLLMTMHEIEGQPFFADPREVLANVVRKFDDLGLTICAAFELEFYLIDQDNVNGRPQSPRSPVSGKRPVSTQVYLIDDLDEYVDCLQDILEGAKEQGIPADAIVKESAPAQFEVNLHHVSDPIKACDYAVLLKRLVKNIAYDHEMDTTFMAKPYPGQAGNGLHVHISILDKEGNNIFASEDPEQNAALRHAIGGVLETLPAQMAFLCPNVNSYRRFGAQFYVPNSPSWGIDNRTVAVRVPTGSADAVRIEHRVAGADANPYLLMASVLAGIHHGLTNQIEPGAPVEGNSYEQNEQSLPNNLRDALRELDDSEVMARYIDPMYIDVFVACKESELAEFENSISDLEYNWYLHTV

SEQ ID NO: 829 - protein, 253 aa, Pseudomonas koreensis
MAFKPLIGVTACVKQIGLHPYHISGDKYVRAVSVGAQGLPVVIPSLGNLTEIDDLLGQLDGLLLTGSPSNVEPFHYQGAASAPGTDHDPARDATTLPLLRAAIAAGVPVLGICRGFQEMNVAFGGSLHQKVHELPGMLDHREADSPDVAVQYAPAHAVSVIAGGVFEALELPDEFQVNSIHSQGIDRLAPGLRAEAVAPDGLIEAISVEHSPAFALGVQWHPEWQVLDNPNYLKIFQAFGAACRQRAAKRSQR

SEQ ID NO: 830 - protein, 357 aa, Pseudomonas koreensis
MATMKAAIFVEKNRIVLDDKPIPEVGPLDALIRVTTTTICGTDVHILRGEYPVAKGLTIGHEPVGIIERLGSQVRGFVEGQRVIAGAITPSGHSYACLCGCGSQDGPDTRHGFKAIGGWKFGNTIDGCQADYVLVPNAQANLCPIPDELSDEQVLMCPDIMSTGFSGAERGEIAIGDAVAVFALGPIGLCAVAGARLKGATTIIGVDAVPERMAMARQLGATHTVNFKDGNVVEQIMALTDGRGVDVSIEALGTQGTFESALRVLRPGGRLSSLGVYSSDLHIPLGAFAAGLGDYSIVSTLCPGGKERMRRLMAVVQSGAVDLSPLVTHRFRLDDIEQAYELFAHQRDGVMKVAITP

SEQ ID NO: 831 - protein, 474 aa, Enterobacter asburiae
MQHRLLINGELIVGAGEKQPVYNPATGEVLLEIAEASAPQVDAAVRAADAAFVEWGQTTPKTRAECLLKLADVIEENADVFARLESQNCGKPLHCVLGDEIPAVVDVFRFFAGAARCLNGLAAGEYLEGHTSMIRRDPLGVVASIAPWNYPLMMAAWKLAPALAAGNCVVIKPSEITPLTALKLAELAKDIFPAGVLNVLFGRGKTVGDPLTGHEKVRMVSLTGSIATGEHIIGHTASSIKRTHMELGGKAPVIVFDDADLDAVVEGVRTFGFYNAGQDCTAACRLYVQKGVYSALVEKLGKAVASLKMGAPDDETSELGPLSSAAHLARVSEAVENAKALAHIQVITGGEKATGPGYYYQPTVLAGAKQEDAIVQREVFGPVVSVTEFDDEAQVLAWANDSQYGLASSVWTRDVGRAHRLSARLQYGCTWVNTHFMLVSEMPHGGQKLSGYGKDMSVFGLEDYTVVRHVMVKH

SEQ ID NO: 832 - protein, 460 aa, Enterobacter asburiae
MNRLPSSASALACSAHALNLIEKRTLDNEEMKALNREVIDYFKEHVNPGFLEYRKSVTAGGDYAAVEWQAGSLNTLVDTQGQEFVDCLGGFGIFNVGHRNPVVVSAVQNQLAKQPLHSQELLDPLRAMLAKTLAALTPGKLKYSFFSNSGTESVEAALKLAKAYQSPRGRFTFIATSGAFHGKSLGALSATAKSTFRKPFMPLLQGFRHVPFGDINAMRAQLSECRKTGEDVAAVILEPIQGEGGVILPPPGYLPAVRKLCDEFGALLIFDEVQTGMGRTGRMFACEHENVQPDILCLAKALGGGVMPIGATIATEEVFSVLFDNPFLHTTTFGGNPLACAAALATINVLLEENLPAQAEQKGDILLDGLNLLAREYPDLVQEARGKGMLIAIEFVDNEIGYNFASEMFRQQILVAGTLNNAKTIRIEPPLTLTIEQCEQVLKAAGKALAALRVATTEAL

SEQ ID NO: 833 - protein, 293 aa, Enterobacter asburiae
MKGIILAGGSGSRLHPITRGVSKQLLPIYDKPMIYYPLSVLMLAGIREILIITTPEDKAYFQRLLGDGSEFGIELQYAEQPSPDGLAQAFIIGESFINGEPSCLVLGDNIFFGMGFSPKLHKVAARNEGATVFGYQVMDPERFGVVEFDDNFNAISLEEKPKQPKSNWAVTGLYFYDHQVVEFAKRVKPSERGELEITSINQMYLEAGQLNVELLGRGFAWLDTGTHDSLIEASMFVQTVEKRQGFKVACLEEIAWRNGWLSDEEVKRTADSLAKTGYGQYLLEILRARPRQY

SEQ ID NO: 834 - protein, 471 aa, Pantoea sp.
MTNLVEVEDFTLHSEEKRTSAFQLEVKTWLERHPDTQYVDILLNDLNGVFRGKRIPVSALPKLEKGCYFPASVFAMDILGNTVEEAGLGQSLGEPDNLCLPVTGTLVPSASDPQHIAQLLLTMCNQDGTPFDVEPRNVLNRLWQQLRNRGLFPVVAVELEFYLVDKKRDAEGFIQPPCSPGSDERNMQSQVYSVDNLDHFADVLRDIDDLARQQGIPADGALAEASPGQFEINLHHTRDVLRACDHAVQLKRLIRQVAENHGMTATFMAKPYEEYAGSGMHVHISMLDAADHNAFACDDGSDSPLMKRALAGMIDLMPASMALLAPNVNAYRRFVPDAYVPLQASWGHNNRTVALRVPCGDIDNHRIEYRVAGADANPYLVVSAILAGMLHGLDTQLPLPHPVTGNGHHAEGLALPIRQSDALYEFDNSYPLQKLLGERFASVWHSCKHHELMQFERLITSTEIDWMLKNA

SEQ ID NO: 835 - protein, 425 aa, Pantoea sp.
MNYVESYYAATANPHAPWPTLQESIQCDVCIIGGGFTGLSAALHLTEVGYDVVVLEAARVGFGASGRNGGQVVNSYSRDVDVIEQRYGKESARMLGSMMFEGAEIIRDRIKRYAIDCDYRPGGVFAALNARQMAHLRKQKALWQQYGNHDLELLDERAIRREVATERYVGGLLDRRGGHLHPLNLALGEAEAIRRHGGRIYEQSAATSVVYGTPNRVKTAQGEVSATFVIFAGNAYLAPQLEPRLSRKSMPCGSQIVATEPLSTDQALSLMPNNYCVEDCNYLLDYFRLTADNRLLYGGGVVYGAREPADIEALIRPRLRRTFPQLQNVKLDFSWSGNFLLTLSRMPQFGRLEKNVYFMQGDSGHGVTSTHLSGKLISEVLRGDAERFDAFARLPHLPFPGGRRFKVPLTAMGAVWYALRDRLGV

SEQ ID NO: 836 - protein, 573 aa, Pantoea sp.
MKQTVAALVAKTLESAGVKRIWGVTGDSLNGLSDSLNRMGTIEWMPTRHEEVAAFAAGAEAHISGELAVCAGSCGPGNLHLINGLFDCHRNRVPVLAIAAHIPSSEIGSGYFQETHPQELFRECSHYCELVSNPEQLPQVLGIAMRKAILNRGVSVVVLPGDVALKLAPESASAEWYPPQLPQVLPQPAELAQLAQTLNEASDITLLCGSGCAGAHQEVVALAEALKAPIVHALRGKEHIEYDNPYDVGMTGLIGFSSGFHAMMNAGTLVLLGTQFPYRAFYPEKAKIIQIDINPGSLGSHCHVDQAYVGDVKSTLQALLPQLTHKSDRSHLDSAVKHYVEARKSLDELAQPNDKQPIHPQYLAQQISHYASDDAIFTCDVGTPTVWAARYLKMNGRRRLLGSFNHGSMANAMPQALGAQSIDRNRQVVALCGDGGFSMLMGDFISLAQLKMPVKLVIFNNSVLGFVAMEMKAGGYLTDGTELENPDFAAIAEACGIRGIRVEKASDLNGALEQAFAHDGPVLVDVITAKEELAMPPEIKMEQAKGFSLYMLRAIMNGRGDEVVELAKTNWLR

SEQ ID NO: 837 - protein, 293 aa, Pantoea sp.
MKGIILAGGSGTRLHPITRAVSKQLLPVYDKPMIYYPLSVLMLAGIRDILLITTPEDRAQFERLLGDGSEFGIRLSYAVQPSPDGLAQAFIIGESFIGEDNCCLVLGDNLYFGQGFSPKLRKVVEQNRGATVFGYQVMDPERFGVVEFDDNFKAISIEEKPQQPKSRWAVTGLYFYDNQVIEFAKQVKPSARGELEITAINQMYLERGELTVELLGRGFAWLDTGTHDSLVEASMFVQTVEKRQGFKIACLEEIAWRNSWLSDDQLRAAGEALTKTGYGQYLLDLLHARPRQY

SEQ ID NO: 838 - protein, 1886 aa, Clavispora fructus
MSYDNNHNYYDPNQQHGAAEGEGYYQQGPYDETGQAQYQQGGEFYDPNQQYQQQPYDMEGYQNYGQQGAAGYNADPEAFSDFSYGGQNPGASGYDQYGTQYTPSQMSYGGARSSGASTPIYGANPNYDPTQFQLSSNLPYPAWSADPQAPIKVEHIEDVFIDLTNKFGFQRDSMRNMFDYFMTLLDSRASRMSPAQALLSLHADYIGGDNANYRKWFFASQQDLDESIGFANMKMGKIGRKARKASKKSKKARKAVEEHGEDMDALANDLEGDYSLDAAEIKWKAKMNVLTPEERVRDIALYLLLWGEANQVRFTPECLCYIYKTAMDYLLSPQCQQRQEPVPEGDYLNRTITPIYRFLRSQVYEIYDGRFVKREKDHNKVIGYDDVNQLFWYPEGISRIILLDGTRLIDIPQEERYLRMGEVEWTNVFFKTYKEIRTWLHFVTNFNRIWVIHVVMYWFYTSYNSPTLYTKHYVQTLNNQPTASSKWAAPAIGGIIASFIQICATLFEWMFVPREWAGAQHLTRRMVFLGLIFLLNLVPVVYTFYWAGLQSISKSAHVVSIVGFFIAVATMIFFAVMPLGGLFTSYMQKKSRRYMASQTFTANFYKLKGLDMWMSYLLWTTVFAAKFSESYFFLTLSLRDPIRNLSTMTMRCNGEYWFGDKLCKQQSKIVLGLMILVDLLLFFLDTYMWYILCNCVFSIGRSFYLGISILTPWRNIFTRLPKRIYSKILATTEMEIKYKPKVLISQVWNAIVISMYREHLLAIDHVQKLLYHQVPSEIEGKRTLRAPTFFVSQDDNNFDTEFFPRNSEAERRISFFAQSLATPILEPLPVDNMPTFTVFTPHYSEKVLLSLREIIREDDQFSRVTLLEYLKQLHPVEWECFVKDTKILAEETAAFENGDEEERQDENGLKSKIDDLPFYCIGFKSAAPEYTLRTRIWASLRSQTLYRTVSGFMNYARAIKLLYRVENPELVQYFGGDPEGLEMALEKMARRKFKFVVSMQRMTKFKEDEMENAEFLLRAYPDLQIAYLDEEPPLNEEEEPRVYSAVIDGHCEVLENGRRRPKFRIQLSGNPILGDGKSDNQNHAIIFHRGEYIQLIDANQDNYLEECLKIRSVLAEFEELNVEHVNPYAPNLRNSKEEKEAPVAILGAREYIFSENSGVLGDVAAGKEQTFGTLFARTLAQIGGKLHYGHPDFLNATFMFTRGGVSKAQKGLHLNEDIYAGMTAMLRGGRIKHCEYYQCGKGRDMGFGSICNFTTKIGAGMGEQMLSREYYYLSTQLPLDRFLSFYYGHPGFHINNLFIQLSLQSFMLVLANLNALAHEAILCEYNKNVPVTDVLKPYGCYNLDPAVDWIRRYTLSIFIVFFISFIPLTVQELIERGLWKATQRFCRHFVSLSPLFEVFLAQIYSTSLFIDLTVGGARYISTGRGFATSRIPYSILFSRFADSSIYMGGRSMLIILFGSVSHWQAPLLWFWASLSALIISPFLFNPHQFAWEDFFIDYRDFIRWMSRGNSKWHRNSWIGYVKLSRSRITGFKRKLTGDISEKSAGDTSRAHRSNVLFSDFFPCVFYTAALFVAYTYINAQTGVTKWEVAGRDSTEPIQVNSVARIVICALGPVVINMGCLAVCVGLACCAGPMLGLCCKKTGAVIAGVAHGVAVVVHLVFFIVLWVLEGFDFARMLLGLITAIYIERSLFKLMTLLFLTREFKNDKSNTAFWTGKWYGSGMGWMAFTQPSREFCAKTIEMSEFAGDFILAHIILFIQLPILLIPMIDRWHSTMLFWLKPSRLIRPPIYSLKQAKLRKRMVRKYCTLYFGILILFVIVIAAPAIASRFIKKNLGTTLTGTFAGIFQPRGTKHNDTGKVSSWWSTDGAKITFWSFTPSDSHPYTTKPF

SEQ ID NO: 839 - protein, 630 aa, Clavispora fructus
MAYRNLTLNQNRLDYNLDEPSDPFDDGSYGSSTEISTENLLRPNHPQSEYDTPNAPTPPPHQSSIVASTEFDRYPLIGASRDVLSASLSSQFPNSGNGLLSSSLNQNDPFAGGMDMSPFGGYPASQFPLHIDEKEDDDHLHNPDPLADAEYDKNRFLYDLKHMDLRSLYGLAGFVVLFIIAAVVFVVLPVLTYSGVTSHGPTTIDSYEVLTQYHYPLSGAIRTSLIDPDTPEEDYFRQTVSGENWTLTFSDEFNAEGRTFYEGDDQFFQAMDLNYAATKDLEWYDPDAVTTVNGTLQLTMDAYKNHNLYYRSGMVQSWNRLCFTQGMIVASANLPNYGNVSGLWPGLWTMGNLGRPGFLATTEGVWPYTYDSCDAGITANQSSPDGISYLPGQRLNACTCKGEDHPNRGTGRGAPEIDILEGATDTDLKVGVASQSYQVAPMDVWYMPDYNFIEVHNLQVTTMNTYAGGPFQQAVSGVTTLNTLWNEHGTNAGQYQEFGFEYLNDDSTGYITWYVGQDPTFTVHAYALGPNGNVGFRRISKEPMSIILNLGISNSWAYIDWAAIHFPSHMRINYVRVYQPPDAISMTCDPADYPTYDYINGHAEAYQNINKTSWELAGYSFPRNKIVNNC

SEQ ID NO: 840 - protein, 323 aa, Clavispora fructus
MHSPANSIRVISGNSHRKLAELIATRLAIPVSKVGAFQYSNKETAVAVGESVRDDDVYITQTGFGENDINDYLMELLLLINACRVGGARRITAVIPNFFYARQDKKDKSRAPITAKLIANLLQTSGCDHVITLDLHASQIQGFFRVPVDNLYAEPSALRFITENYATDLLTIVSPDAGGAKRVAYIADKLDVPFALIHKERQKANEVSKMVLVGDVSNKLCLLIDDIADTCGTLCKAADVLLSNGAQKVVAIVTHGIFSSNAIEKLNKSNLDKIVCTNSLPLDEKLAACPKLELLDISPTLAEAIRRLHNGESVSYLFDNVPE

SEQ ID NO: 841 - protein, 320 aa, Clavispora fructus
MSTNSIKLLASDVHKGLAELVAQRLGLKLTPSELKRDSSGEVTFSIGESVRDEDIFIICQIGSGIVNDRVIELLIMINACRTASARRITVILPNFPYARQDRKDKSRAPITAKLMADMLTTAGCNHVITMDLHASQIQGFFDVPVDNLYAEPSVVRYIREKVSYKDAIIISPDAGGAKRAAGLADRLDLNFALIHKERARANEVSRMVLVGDVTDKICIIVDDMADTCGTLAKAAEVLLENRAKEVIAIVTHGILSGNAIKNINNSKLKAIVCTNTVPFEEKLSLCPKLDTIDISAVLAEAVRRLHNGESISYLFKNAPL

SEQ ID NO: 842 - protein, 687 aa, Clavispora fructus
MCGIFGYVNFLVDRTRGEIVDNLLEGLLRLEYRGYDSAGIAIDGKEKGENYILKSPGKVKSLETMIATQNIDRKQVFDNHVGIAHTRWATHGQPEYLNCHPHRSDPTGEFLIVHNGIITNYRELKTLLLSKGFVFESETDTEVIAKLFKHMYDTNIKSGNYVDFNELTKQVLYELEGSYGLLVKSSHFPGEVCGTRKGSPLLVGVKTERKLKVDFVDIEFPENQDLYPENPLAVGGPESNLRTSQLRAFFAEDGIPSPVEFFFSSDPASVIKHTRKVLFLEDDDIAHIYDGELHIHRAKKSIAGESTVRPIQTLEMELNEIMKGPYTHFMQKEIFEQPDSTFNTMRGRLDFENNTVMLGGLKQWLPTIRRCRRIIMIACGTSYHSCLATRSTFEELTDIPVSVELASDFLDRRSPVFRDDTCIFVSQSGETADSMMALQYCLDRGALTVGVVNSVGSSMSRQTHCGVHINAGPEIGVASTKAYTSQYIALVMVALSLSNDSISKKQRHAEIIQGLKKVPEQITRVLKLEDKIKQLCNDFLDKQKSLLLLGRGFQFATALEGALKIKEISYMHSEGVLAGELKHGVLALVDGELPIIAFATKDSLFPKVMSAIQQVIARGGRPIVICNEGDNVCGEEAYTTLHVPLTVDCLQGLLNVIPLQLMSYWLAVNRGIDVDFPRNLAKSVTVE

SEQ ID NO: 843 - protein, 257 aa, Clavispora fructus
MPASREDSVYLAKLAEQAERYEEMVENMKAVASSGQELSVEERNLLSVAYKNVIGARRASWRIVSSIEQKEEVKGNEQQVSLIREYRSKIEAELTKICEDILSVLTDHLITSAQTGESKVFYYKMKGDYHRYLAEFAIAERRKEAADLSLEAYKSASDVAVTELPPTHPIRLGLALNFSVFYYEILNSPDRACHLAKQAFDDAVADLETLSEDSYKDSTLIMQLLRDNLTLWTDLSETPAQQEEQDAQPAEAKPEEE

SEQ ID NO: 844 - protein, 617 aa, Hanseniaspora uvarum
MEEELIPLDYGLDVISNLTSGTSQVDLSKQHLKSTVDDVPLYCIGFKDSSFEYTLRTRIWASLRTQTLYRTVSGFSNYQKAIKLLQYSESQLCDAFQDDPIWDEAELDAMLQRKFRLLVSMQRYQEFSPEERNDASILFAKYPDILVPYLEKIQEEDGSISYYSTLLDVSEPDESNNYKEIYRIKLSGNPILGDGKADNQNISIIFYRGEYIQVIDSNQDNYFEECLKIKAVLAEFEEYELEDYSATQYLPGVAYNTNSQPVGIVGAREYIFSENMGVLGDIAASKEQTFGTLFARTLAEIGGKLHYGHPDFLNGIFMTTRGGLSKGQKGLHLNEDIYAGMTCISRGGRIKHCDYYQCGKGRDLGFSTILNFTTKIGAGMGEQILSREHYNLGTQLPVDRFLTFFYAHPGFHLNNLFIMLSVELFMLILVNFGALVQESILCRRLVKFTDLEEPLGCYNLRPVLDWINRELSNDIVNRVWWSGKLFYCGLGFFSTITQLAREFPVKIIEMQIFSFDFILGHLILFAMSPILFVPFIDKLHTLVLFWCFSLPLPKKILSRRKSSKINSRLQMYLPSMRNSILDSLIQPNFQNNNDTGANAPDYILRSSPEAVSMKTIM

SEQ ID NO: 845 - protein, 1867 aa, Hanseniaspora uvarum
MSYQNGEEYPEMYGQDGQQYDPNSQQYQQEFDEFGNPIGYYDEHGQFYYYQQDPSGNNNYYEPPMNPNSTENFSDFSYGQNGNMPPPNGDFYQQEQPSDSFATGPNGWDASMALAAALPNDPYPAWTADPQSPISIEEIEDIFIDLTNRFGFQRDSMRNQFDYFMTLLDSRASRMSPDQALLSLHADYIGGDSANFKKWYFAAQLDLDDEVGFRNMNLGKMSRKARKLKKKQRKQMEKDMKEQGEAYNHEEALNQLEGDNSLDAADFRWKAKMNILSPADKVRHIALYLLCWGEANQVRFTPECLCFIFKCCLDYLDSPLCQQSTKPMPEGDFLNRIITPIYKFIRSQVYEVIDGKFIKREVDHNKVIGYDDVNQLFWYPEGLAKIVLDDGTRITDLPSEERYLRLGDVTWEFVFFKTYKETRTWLHLITNFNRIWIIHACVYWMYIAYVSPTFYTKNYQQLVNNKPLASSSWAAAALGGTLGCVIQILATICEWQFVPRKWAGAQHLSRRLWFLFGVLAINLAPVVFVFAYAGRTVESKLAHAISIIFFFVSVVTVIFFAVMPLGGLFTSYMKKSSRKYVASQTFTASFASLKGIDMWMSYLVWVAVFGAKFSESYFFLILSLKDPIRILSTTTMRCTGDYWWKAKLCVLQPKIVLGLMIATDFILFFLDTFMWYVLANTIFSIGKSFYMGISILTPWRNIFSRLPKRIYSKILATNDMEIKYKPKVLISQIWNAIVISMYREHLLAIDHVQKLLYHQVPSEIEGRRTLRAPTFFVSQDDNNFDTEFFPQGSEAERRITFFAQSLATPIPEPLPVDNMPTFTVLTPHYSEKILLSLREIIREDDQFSRVTLLEYLKQLHPVEWDCFVKDTKILAEETAAFDENEENSSAAGPDGSVVSGANGDALKSQIDDLPFYCIGFKSAAPEYTLRTRIWASLRSQTLYRTISGFMNYARAIKLLYRVENPEIVQMFGGNAEGLERELEKMARRKFKFVVSMQRLAKFKPQEMENAEFLLRAYPDLQIAYLDEEPPLNEGDEPRIYSSLIDGHCELLPNGRRRPKFRVQLSGNPILGDGKSDNQNHAIIFTRGEYLQLIDANQDNYLEECLKIRSVLAEFEELNAEQVNPYAPELRYEDQTTNHPVAIVGAREYIFSENSGVLGDVAAGKEQTFGTLFARTLSQIGGKLHYGHPDFINSIYMNTRGGISKAQKGLHLNEDIYAGMNALLRGGRIKHCEYYQCGKGRDLGFGTILNFTTKIGAGMGEQMLSREYYYLGTQLPLDRFLSFYYAHPGFHLNNLFIQLSLQMFALTLVNLNSLAHESILCEYNKNKPITDILYPLGCYNLAPAIDWVRRYTLSIFIVFFIAFIPIVIQELIERGVWKASQRFIKHLCSLSPMFEVFSGQIFSNALLSDMTYGGARYISTGRGFATSRIPFSILYSRFAGSAIYMGSRTLLMILFGSVSHWQPALLWFWASLSSLMFSPFIFNPHQFSKQDYFIDYRDFIRWLSRGNGKFHRNSWIGYVRMSRARVTGFKKKLLGDESEKSVGDVPRAHKSNVLMAEFIPCAIYAAGCFVAFTFINAQTGVRDAVTVNSAVRVIICTVGPIVINMGVLFFTLGLSCCAGPLLHMCCKKTGPVMAGFAHGIAVIIALVFFIVMWVLEGFSFARMLIGQITCIFCQRLIFIAMSSWLLTREFKNDHANSAFWTGRWYGSGMGGSAWTQPAREFTAKVIEMSEFSADFILGHLLLFCQLPFVLMPFIDKFHSMMLFWLKPSRQIRAPIYSLKQSRLRKRMVRKYSVLYAFVLILFVIVIAAPAVASSHVSDTIGSSLTGTFKNLVQPRHQDNNDTGKRLSTWKGHYLSHTPSLKTWSTKKP

SEQ ID NO: 846 - protein, 713 aa, Hanseniaspora uvarum; identical to SEQ ID NO: 622

SEQ ID NO: 847 - protein, 254 aa, Hanseniaspora uvarum
MPASREDSVYLAKLAEQAERYEEMVENMKAVASSGQELSVEERNLLSVAYKNVIGARRASWRIVSSIEQKEESKGNESQVTLIREYRSKIEQELSKICEDILSVLTDHLISSAQTGESKVFYYKMKGDYHRYLAEFAISEKRKEAADLSLEAYKSASDVAVTELPPTHPIRLGLALNFSVFYYEILNSPDRACHLAKQAFDDAVADLETLSEDSYKDSTLIMQLLRDNLTLWTDLSEAPNQVEEPASEARAEEE

SEQ ID NO: 848 - protein, 310 aa, Hanseniaspora uvarum
MSTNSIKLLASDMHRGLAELVAKRLGLRLTPSELKRDSTGEVQFSIGESVRDEDIFIICQIGSGVVNDRVIELLIMINACKTASARRITVILPNFPYARQDRKDKSRAPITAKLMADMLTTAGCNHVITMDLHASQIQGFFDVPVDNLYAEPSVVRYIKESINYKEAIIISPDAGGAKRAAGLADRLDLNFALIHEERARANEVSRMVLVGDVTDKICVIVDDMADTCGTLAKAAEVLLDNGAKEVIAIVTHGILSGNAIKNINNSKVKQEKLKLCPKLDAIDVSAVLAEAVRRLHNGESISYLFKNAPL

SEQ ID NO: 849 - protein, 303 aa, Hanseniaspora uvarum
MTHSQNSIRLVAGNSHPELCKQILTRLGIELAKVGAFNYTNQETAVAVGESVRDEDVYIIQTGCGETSINQFLMELLIIVNACKIASARRITAVIPNFPYARQDKKDKSRAPITAKLVANLLQTAGCNHVITMDLHASQIQGFFRVPVDNLYAEPSVLRYIQENHITKDLIIVSPDAGGAKRVSSIADKLDVNFALIHKERKRPMKSDTCGTLCKAAEVLLEEGGAKEVIAIVTHGIFLSNAVERLNNSKLSKIICTNSMPLEDKLEKCDILETIDISPTLAEAIRRLHFGESVSYLFNNAPA

SEQ ID NO: 850 - protein, 259 aa, Hanseniaspora uvarum
MRLARVDFYSSLIDGSSATLENGNRKPKYRIKLSGNPILGDGKSDNQNHAIVFARGEYIQLVDANQDNYLEECLKIRNVLAEFEDTPHAYTEDTYSATNFEGTIYEHPVVIIGTREYIFSENIGILGDVAAGKEQTFGTLFARTLAHIGGKLHYGHPDFLNTIFMTTRGGISKAQKGLHLNEDIYAGMNVVMRGGRIKHCEYVQCGKGRDLGFGSILNFTTKIGAGMGEQMLSREYFHLGTRLPLDRFLSFNTLIQVFT

SEQ ID NO: 851 - protein, 1845 aa, Hanseniaspora uvarum
MSYDNSNQYYDPNQQQGGHGQEGYYQQQPYDEGSHAAQQGREFYDPNVQYQQQPYDMDGYQDGQYGTQGHQYGAQHLQQPNYNADPEAFSDFSYGNWWWSNSRNSWLRSPQDCRWELPHNLRWERQLRPYTVPNELQLAISAWSADPQAPVKIEHIEDIFIDLTNKFGFQRESMRNMFDYFMTLLDSRSSRMSPAQALLSLHADYIGGENANYKKWYFASQQDLDESIGFANMNLGKIGRKARKASKKSKKARQAVEEHGQDLDALNSELDGDYSLEAAEIRWKTKMNLLSPEERVRDISLCLLLWGRINQVRFTPECLCYIYKTAFDYLISPACQQRTEPVGEGDFLNRVITPLYRYLRSQVYEIYDGRFVKREKDHNKVIGYDDVNQLFWYPEGISRIIFEDGTRLVDLPQEERYLRLGEVEWKHVFFKTYKETRTWLHFLTNFNRIWVIHATIYWMYTAYSAPTLYTKHYFQTVNNQPTASSRWAAAGLGGVLASVIQLAATICEWLFVPREWAGAQHLTRRFMFLVIIFILNLAPPVFTFYWAGLEKTSLVFFAIMPLGGLFTSYMNKRSRRYLSSQTFAASFAKLRGLDMWMSYLDPIRILSTTTMRCTGEVWFGVKLCAQQAKIVLGLMILVDFLLFFLDTYMWYIVCNCVFSVGRSFYLGISILTPWRNIFTRLPKRIYSKILATTEMEIKYKPKVLISQIWNAIVISMYREHLLAIDHVQKLLYHQVPSEIEGKRTLRPPTFFVSQDDNNFETEFFPRDSEAERRISFFAQSLATPILEPLPVDNMPTFTVFTPHYTEKILFSLREIIREEDQFSRVTLLEYLKQLHPVEWECFVKDTKILAEETAAYENGDDPEKLNEEGGDGLKGKIDDLPFYCIGFKSAAPEYTLRTRIWASLRSQTLYRTVSGFMNYARAIKLLYRVENPELVQYFGGDPEGLELALERMARRKFRFIVSMQRLAKFKDEEMENAEFLLRAYPDLQIAYLDEEPALNEDEEPRVYSALIDGHCEMLENGRRRPKFRVQLSGNPILGDGKSDNQNQALIFTRGEYLQLIDANQDNYLEECLKIRSVLAEFEELNVEHVNPYAPTLKKEDTTSSFPVAILGAREYIFSENSGVLGDVAAGKEQTFGTLFARTLAQIGGKLHYGHPDFLNSIFMTTRGGVSKAQKGLHLNEDIYAGMNAVLRGGRIKHCEYYQCGKGRDMGFGSILNFTTKIGAGMGEQMLSREYYYLSTQLPLDRFLSFYYAHPGFHVNNVFIQLSLQTFMLVLANLNSLAHESILCSYNKNVPIKDILYPYGCYNFSPAIDWIRRYTLSIFIVFFISFIPLFVQELIERGVWKAVQRFMRHFLSLSPMFEVFVAQIYSSSLITDLTVGGARYIATGRGFATSRIPFSILYSRFADSSIYMGARCMLILLFGSVAHWQAPLLWFWASLSALIFSPFIFNPHQFAWEDHFIDYRDFIRWLSRGNTKWHRNSWAGYVRLSRSRVTGFKRKLTGDASEKAAGDASRAHRSNVLFADFIPCCIYTAGLFCAYTFINAQTGVTDSPSEVNSVLRLVICALAPVVIDLAVLAFFLGLACCAGPMLGLCCKKTGAVVAGIAHGIAVVVHIVFFIVMWVLEGFNFARMLLGFITMIYIQRTLFKFLTLCFLTREFKNDKANTAFWTGKWYGSGLGWMALTQPAREFCAKIIEMSEFAGDFILAHFILFCQLPILFIPLIDRWHSTMLFWLKPSRLIRPPIYSLKQARLRKRMVRKYCTLYFAVLVMFVVIIAAPAVASSHINASSIADKLSNAASIAKGLMQPRNESNNDTGTNRPKLYTWVYASYTPSTPVYSTIAKRDYDF

SEQ ID NO: 852 - protein, 938 aa, Hanseniaspora uvarum
MKNPFIDQRFDNEFDNSENNFASKERSVYQTPTKTNKYPSFGQHATPNLNSPSKAALKYSPRRKANNNHIIPIQGNETIDLSPGKHISRSEAVKLESPTRDAPVLYNLDDDSDDEYESHFHNSYDSPSKIPPPVNEVDLSDVGSYSAAGSYKERMSSYSSYTSSNFSGDTFKQTRFNTNHHDLQYIRRANSTVRPKVSKNKAGKILTLDNPIPSGILDVLPNKSSPEFTEMRYTACTSDPDSFVADGYSLRFSDMNRECEIAVCITMYNEDKYSLARTLHSILKNVTELCTREKSRTWGRKSWKKVQIIIVSDGRSKINRGSLDYLISLGVYQEDMAKSTVNGIPVQAHLFELTTQISIDDDLNYVSDVVPCQILFCLKEENKKKINSHRWLFNAFCPILDPNTITLVDVGTKLGSNSLYHMWKQFDMDSNVAGVAGQIIAMKGKYGRKLINPLVASQNFEYKMSNILDKPLESTFGYISVLPGALSSYRYRALKNNEDGTGPLHSYFLGETQDNGATDVFTANMYLAEDRILCWELIAKKDCKWVLKYVKEATGETDVPEEIPEFISQRRRWLNGAMFADLYSKLHFYQIFRTRHSKARKTGLLVLFFYQFVQFWFSWFSIANFYLTFYFLAGSMVQLIHNGIYLFIFFKYLLISTICGLFIISMGNRPQGAIHLFIISMVILSVCTLFALITGLYFAFNTLKDNKESHGMFVKIVVSLFSTYGLYAYSSIIYLDPWHLFHSFIQYLVMVPTFICTLQIFALCNTHDVSWGTKGSTKEEKPKSEAVITAGPDGKTVITGTEWPQDIDRKYIEVRNRLKETETFDIKVDQNQKNTDYYRDVRTRIVTFWMLSNLILCMIITQIYGPEDMYKNKYLVFILISVASLALFRAFFSTLFLVMKYIRSIISFINKYQRNGGVNIELPKWMGKFKKSSKTTEA

SEQ ID NO: 853 - protein, 243 aa, Hanseniaspora uvarum
MLHSWNKLCFTQGLLEISAKLPNYGAPEIDAIEGEVDTTVKVGVASQSLQLAPFDIWYMPDYSWVEIHNSSVTTMNTYAGGPFQQALSATTTLNTTWYEFGDGEKNFQRYGFEYLNDDDNGHLTWYVGLDPTMTIHANALQANGNVGPRRLSKEPMSLIVNLGISNSWAYIDWAALHFPVEMQVDHIRIYQPEDQINLTCDPDDYPTYDYIQQHLNAYENNNLTSWEAAGYSFPKNKLTGGCS

SEQ ID NO: 854 - protein, 328 aa, Brevibacterium frigoritolerans
MSDLFEILESKIMGHNLKIVFPEGLDERILGAAGRLAQAKLVTPVLIGDIGLIQEKAKDLKISLDAIEIYDPKNYIMMDEMVEAFVKVRDGKDTDVQAREILMDENYFGTMLVHMKLAHGMVSGATHSTADTVRPALKIIKTKPGVQKTSGVFIMVREEEKYVFADCAININPSSQDLAEIAIESAKTALMFDIEPRVAMLSFSTKGSATSPETLKVVDAVDLAKEMDPEVILDGEFQFDAAFVPSVARKKAPDSLIQGDANVFIFPSLEAGNISYKMVQRLGGFEAVGPILQGLNRPVNDLSRGCSEEDVYKLAVITAAQGFVAQYQ

SEQ ID NO: 855 - protein, 361 aa, Brevibacterium frigoritolerans
MAQLDETLKMLADLTDAKGIAGNESEVRKVMTEYITPFADEISTDGLGSLIAKKTGDENGPKIVVTGHMDEVGFMITQIDDKGFLRFQPVGGWWSQVMLAQRVTIVTGKGDITGIIGSKPPHILSVEARKKPIDIKDMFIDIGASSKEEVKEWGVKPGDMVVPYFEFTVMNNEKMLLAKAWDNRIGCAIAIDVLKQLKDSDHPNVVYGIGAVQEEVGLRGSKTSTFKIQPDIGFAVDVGIAGDTPGVSEKEAMSKMGEGPQIVIYDSSMVAHKGLRDFVTDTADEMNIPYQYESIPGGGTDAGSIHLTANGVPALAITIATRYIHSHAAMLHRDDYENAVKLIVEVIKRLDREAVDRIIYE

SEQ ID NO: 856 - protein, 394 aa, Brevibacterium frigoritolerans
MKLANRVQSLTPSTTLAITAKAKELKAQGLDIIGLGAGEPDYNTPKHIIDAALLSMNEGQTKYTPSAGLPKLKEAIAAKLKRDQGLDYKPSEIAVGSGAKHSLYTLFQAILDEEDEVIVPIPYWVSYPEQIKLADGKPVYIVGTEENQYKITKEQLEQAITDKTKAVIINSPSNPTGMLYSREELAAIGEVCLAHDILIVSDEIYEKLVYGNAKHTSIAEISPELKKQTIIINGVSKSHSMTGWRIGYAAGDESIIKAMANLASHSTSNPTTTAQYGAIAAYEGTQEPVEEMRQAFESRLNKIYDKLVEIPGVSCIKPQGAFYLFPNVKRAVELTGYSNVEDFTTALLEEAQVAVIPGSGFGAPDNIRLSYATSLELLEAAVERIHSFVNSKMA

SEQ ID NO: 857 - protein, 409 aa, Brevibacterium frigoritolerans
MSINVESKNTQANQSATQDYIKKVLQLIEQKEISKEDAQWVTRETVENFRNHVNPGFLEYRKTVTKDTQFASVEWSDQDSCFTDVNGKKYIDCLGGFGIYNVGHRNPKVVKAVTDQLQRQALHSQDLLDPLRAMLAKILAEITPGDLKYSFFTNSGTESVEAALKLAKMYSDKYTIISTTKSFHGKSLGSLSATAKGMFRKPFIPLVPGVRHVPFGDVDMMRKTFESCALVGEDVAAVLLEPIQGEGGVILPPQDYLKQVRALCDEYDALLILDEVQTGMGRTGKMFASELYDVVPDIICLAKAFGGGVMPAGAVVANEKVFKSWFDNPFMHTTTFGGNPLACAAAIATIDVLLEENLPQRAAEVGEYFLNGLREVAAEHKDKVLEIRGQGLMIGIEFHKDEVGYGFRL

SEQ ID NO: 858 - protein, 401 aa, Brevibacterium frigoritolerans
MNTYTQPDKTGHFGAYGGRFVPETLMAAITELEEVYEQSKNDPEFQRQLSYYLKQYIGRETPLYFAENLTRLAGGADIYLKREDLNHTGAHKINNTIGQALLTQKMGKKKVIAETGAGQHGVATATVCALLKLECIIFMGEEDIRRQKLNVFRMELLGAKVISVSQGSGTLKDAVNEALRYWVANVDDTHYIMGSVLGPHPFPVIVRDFQSVIGNETKRQYSEAVHSLPDAIVACIGGGSNAMGMFYPFIEDETVKLYGVEAAGHGLNTPLHASSLTKGKPGVLHGAFMYVLQNEDGQIQEAHSISAGLDYPGVGPEHSYLKDTNRVEYTSVTDDEALEALAMLSREEGIIPALESSHAISYGLKLAKEMEKGTGLVICLSGRGDKDVETVQSLMGGSEHE

SEQ ID NO: 859 - protein, 1146 aa, Galactomyces geotrichum
MNVQPSATGNDPNLQDFNSNVPPIQLSDMSHHVNTPVVRIDEEGETESVYDDRVERSGSSHSARPQNDYRYSEESDTSRSTPSPYTSQNYGKHETHVNTVDADTLLNTKRNSTASAKNKKKDEKAAGPPPSLWRTYCFIVTFWAPSFLMKYFGMPTRDRQIAWREKIGLITIILYVAAFVAYLTFGFTTTVCNNNVVRLRNNEVNSGMLIIHGHVYDLTQSKHPAAHGVPPNSNILYPPVNAGGRDASFLFQNVNGHCLNVLTPRENSSIPSSGNDLAYYMPCKTFAQDGSTQANFTSEYYDGWACHTSTTARKALWSLKSAGEVYFTWDDVRNTSRNLIVFNGNVIDLDLINWIDTDSINVPQIFYDVRDDANIKGVDVSQIYAQGEARKMVRCLSDIAMVGYVDADQIGCLASKVVLYVSLVFIIGIVAIKFLFAIYFKWFVTGKQGANYMDLKTMAKHEQEVEDWSNNMYAQGPVKNAPKAFPQSTQGRVSMFRPRSALPSGNVTMGSQLPSSSTSKLLPSGTYLQENLSSRASVFNTLDDPYRSSKSITGDTSYVGATDAYSGDQDLEPGAPGYLVPQPPVDYQPFGFPLAHTICLVTAYSESVEGLRTTLDSVATTDYPNSHKLILVICDGLIKGSGNDMTTPEIALSMMKDFVEPPDQVQAYSYVSVVSGMKRHNMAKVYAGFYDYDNDTMDPSKQQRVPMITIVKCGTPAEQGAAKPGNRGKRDGQVILMSFLQRVMFDERMTELEYEMFNGIWKVAGVAPDFYEIVLMVDADTKVFPDSITHMVGQMVKDPEIMGLCGETKISNKSDSWVTMIQVFEYFISHHQSKAFESMFGGVTCLPGCFCMYRIKAPKGEEGYWVPILANPDIVEHYSENVVDTLHKKNLLLLGEDRYLSTLMLRTFPKRKQIFIPKAACKTIVPDEFKVLLSQRRRWINSTVHNLMELVLVRDLCGVFCISMQFVVFIELIGTLVLPAAIAFTIYVIIIAIVKKPTPVLSLILLALILGLPGVLIVVTASRPSYILWMFIYLLSLPVWNFVLPCYAYWKFDDFSWGDTRTIAGGDKGGHDDDEGEFDSSQIVMKRWRDFERDNHRFQQQQMQQPWESSSPPSAGFRSQTFNSGTPVSEYGGLNDYNNPNQQHMV

SEQ ID NO: 860 - protein, 681 aa, Galactomyces geotrichum
MTNAAKLKGQDISALISANSQSQQTGNCLIELAKIGVIESESVGCITAHIVLYLSMIFIVLIVLVKFVFALYFEWRMSWRLGDGFQNLPFMTTASTLKRACSSVSTTVRKVHCPASKDCNNNKRGLVIDDPIMQKYEPKWTFGLENDPFYTLLLVTCYSESQDGIRNTLDSLATCRYSNDHKLIIVICDGLITGSGNQKSTPDIVLSMMERFIVPEDETLLQSYVAVATGGRRYNTAKAYAGFYKYDDSTMPRAQQVDIPILCIVKHGDTWERENEGIKSGNRGKRDSQVLLMTFLQKLMFNERMCDLENYMYLLIWQLVGRDVMEYETILMVDADTKIQPDSLGHLIKCMMKDSDIMGLCGETQIINKWESWVTMIQVFEYFISHHLTKSFESVFGGVTCLPGCFSLYRIKSRKGPRGYWVPVLVNPDIVERYGENEVTSLHRKNLLLLGEDRYLSTLMLKTFPTRKQIFIPQAKCETVVPSEFRVLLDQRRRWINSTIHNLLELVVVRDLCGVFCLSMQCVVLIELLGTLTLPAAFAFTVYILVRAIIVRPVPLFPLLMLVLILGLPGVLILVTAHEWKYVLWMFIYLLSLPVWNFVLPLNAFWKFDDFRWGTTRLITTEGGNLRQDQVCSAERDEEHADFDRSRIRNMTFKAWIETQMPEFGPPTPLAPGSSLRKNYT

SEQ ID NO: 861 - protein, 758 aa, Galactomyces geotrichum
MAINTRNLTSPDSPPNPQQPVHTTAAPSEDNVPEAPGFYFQPPRNEEVYPPPRNPFLTDSTSDEASLGSDQHLFVSENNNNNNNNIYSTSGSESTHGGGYPERSAYLPQETAPAAIDYPSGNYTSSYTPAGGLPTPMGMSTAAAVAGSAAAVAGASAQLLPNPSSRRSSASLNMLSAEFDRYPNRISSAAPSIMSMGAGHSLLRSGNSDLYLNKHNRDSSISNDSGVSSVSANGGGRPAGKFAFQSDFSPFGGYPTSSFPLHIDEKEADDYLHNPDPILDAKYDRKCQRLDKRGWLSLLAMLALLLGAIVLFIVYPVLTYTGHTSEHSRPTTAVEQYEVLTTYEYNILSAIRTTLVDPDTPQDAKSFTALDGSKWTLAFSEEFNKEGRTFYEGDDQFWTAPDIHYAATTDLEWYDPDASTTANGTLVLTMDAFKNHNLFYRSGMLQSWNKLCFTQGYLKVGAQLAGYGHVLGLWPGIWTLGNIGRPGYLGTTEGVWPYCYSECDAGITPNQSSTDGISYLKGQKLNACTCDGEDHPNPGVGRGAPEIDALEGTVSSDLKVGVVSQSLQLAPYDIWYMPDMNFIEIYNRTTTVTNTWFGGPLQQAISMASTLNTSWYEYSDTPGYQSYGFEYLNNDNTGYIRWFIGDTPTHALYAPSLGPNGNVGQRQISKEPMSIILNLGLSNSWVYIDWPSLVWPSHMRIDYVRIYQPPKAISITCDPSGYPTYDYIESHRDVYDNPNITSWEDTEYDWPKNKLTGC

SEQ ID NO: 862 - protein, 742 aa, Galactomyces geotrichum
MNNQDNSRYQQQSQPLTGDRTYNSSSDDDLYGNNSQQHYQNTDVYPPPRNPFLSDHSDNNSIASDQYLQNDSQYNRNQQHVYNDDGYGSGSASDLLHPNNANQHGYPDQNVYIPRESTPLASQNDLYSGAVSSPMGMSTAAAVAGSAAAVAGASTLLAAAPKSRPSSTSLNVMSEFDRYPNRISSAQSVVSTPGANGSDNYHNGMRNSTFSNESGASSLSDSSVANPFVVNADFSPFGGYPATSFPLHIDEKEADDYLHNPDPILDAKNDRMCVKPDRRGMATIAALLFLVLGAIVLFIVYPVLTFTGLTEEHSNIVQSYEELTKYEYGILSGIRTSLVDPDTPDDALEHTALDGSKWPLVFSDEFNKEGRTFYDGDDQYWTAPDIHYAATTDLEWYDPDASITVNGTLMLTLDAFKNHNLYYRSGMVQSWNKLCFTNGYIEAKAQLAGYGHILGLWPGIWTLGNLGRPGYLGTTEGVWPYCYNQCDAGITPNQSSSDGISYLKGQKLNACTCPGSDHPNPGTGRGAPEIDVLEGTVSSDLKTGVVSQSLQLAPYDIWYMPDMNFIEIYNRSTTVTNTWFGGPLQQAISMASTLNTTWYEYGDSPSYQSYGFEYMNTDNTGYIRWFIGDTATHTLYAPALGPNGNIGQRDIAKEPLSIILNLGISTSWVYIDWPSLVWPSHLRFDHVRIYQPSDAISITCDPKDYPTYDYIQNHLDVYTNPNITTWDDTDYEWPKNKLTGCD

SEQ ID NO: 863 - protein, 252 aa, Galactomyces geotrichum
MPSREESVYLAKLAEQAERYEEMVQNMKDVATSGDELSVEERNLLSVAYKNVIGARRASWRIVSSIEQKEESKNNGEQVSLIREYRQKLEKELGNICKDILEILANNLIPSAKADESKVFYYKMKGDYHRYLAEFASGEEREKIANESLESYEAASVIANDTLTSTHPIRLGLALNFSVFYYEILNSPEKACQLAKQAFDDAIAELDNLTEESYKDSTLIMQLLRDNLTLWTSDMTELATENNEAAAPQAAE

SEQ ID NO: 864 - protein, 1971 aa, Galactomyces geotrichum
MSANYNRPYADDQYNNADGHANTNANSHPNANQNQHDSYYADDYSQQQQQQQHGGYAQDGYDYNQQGHQGYYDDSQQGYYRDDESYYAQGGNQQGHQHNQYMDDDGYPEGSYAAGPVDPYASSSQQQQQLQQQYGGYQQPNKGQLLNSDDGSETFSDFTMRSDMNRAAEMDYYGNNNNQYMPPGEGQDGYVPSAESRQAYRTTASSQMSYNGNRSSGASTPIYGLDYQNIPAGTRSREPYPAWTSENQIPLSKEEIEDIFIDLANKFGFQRDSMRNMYDYFMCLLDSRASRMTPNQALLSLHADYIGGENANYRKWYFAAQLDLDDQVGFRNMKLGKTNKRTRKARKKVKQDDPNADPQKTLEELEGDNSLEAAEFRWKNHMNQMSQHERARQIALYLCCWGEANQVRFTPECLCFLFKCADDYFLSPECQARTEPVEEGDYLNRIITPIYMFIRDQGYEVRDGKFVKRERDHGKVIGYDDVNQLFWYPEGIERIIFEDGTRLVDIPSSQRFSKLGEVVWDKVFFKTYIETRSWFHMAVNFNRIWIIHITMYWFYVAFNSPTIYTPNYSQLANNPPLAQCRWAACAIGGVIATFFQIVATLSEWAFVPRQWSGAQHLSKRLMFLILIFILNLITPVYVFGYIGISTYSKSAHVVSVVGFFIAVFTFLFFSVMPLGALFGSYLGRNTRRYVASQTFTASFHKLKGNDMWLSYGLWVVVFALKLVESYFFLILSLRDPIRDLSTMTMTRCVGEVYFGDVLCRHQAHITLGLMYFLDIVLFFLDTYLWYVIINSIFSVARSFYLGISIWTPWRNIFSRLPKRIYSKILATTDMEIKYKPKVLISQIWNAIVISMYREHLLAIDHVQKLLYHQVPSEVEGKRTLRAPTFFVSQDDNSIESEFFPDNSEAERRISFFAQSLSTPIPEPLPVDNMPTFTVFVPHYSEKILLSLREIIREDDQFSRVTMLEYLKQLYPVEWDCFVKDTKILAEETSSFNESSENLDKESSDEKDSIKSKIDDLPFYCIGFKSAAPEYTLRTRIWASLRSQTLYRTVSGFMNYSRAIKLLYRVENPEVVQMFGGNTEKLERELERMARRKFKFLVSMQRLTKFKPDEMENTEFLLRAYPDLQIAYLDEEPPLNEGEEPRLYSALIDGHCEIMENGRRRPKFRVQLSGNPILGDGKSDNQNHAIIFCRGEYLQLIDANQDNYLEECLKIRSVLAEFEELNVEHVNPYTPTLPSSTSGESHEVSNPVAILGAREYIFSENIGILGDVAAGKEQTFGTLFARTLAQIGGKLHYGHPDFLNATFMLTRGGVSKAQKGLHLNEDIYAGMTALLRGGRIKHCEYYQCGKGRDLGFGSILNFTTKIGTGMGEQILSREYYYLGTQLPLDRFLSFFYAHPGFHVNNLMIITSVQLLMLVLLNIGALNNQTITCLYDRNKPITDPHIPLGCYNIQPVLDWVRRCILSIFIVFFIAFIPLVVQELTERGLWRATVRFARHFGSLSPFFEVFVCQIYANSMLMDLAFGGARYIATGRGLATARIPFSVLFSRFAGDSIYLGARAFTMLLFATVSMWQAALLWFYITLFAMCISPFIYNPHQFAWTDFFIDYRDYIRWLSRGNNKWHRNSWIGYVRLTRTRITGFKRAVTGDVSEKGSGDVPRAPFTNLFMTEILVPVVVAAAAFVPYTFINSQNGVANVEPVNSVLRVIICTLAPIVINAGALMVLVFISCCAGPLLGVCCKKTSSVMAGIAHGISVIVHIVFFEVMWLLQGWNWTSALLGMITCMSIQRLLLKLLTIFLLTREFKHDSSNRAWWSGKWYSAGLGWMTMTQPLREFVCKIVEGSHFAADFVLGHCLLFVQLPLLCIPMIDRWHSMLLFWLRPSRQIRPPIFSLKQNKLRKRMVRKYATLYFGLLLLFLILIIAPAVAGKSMDTSSITKNLPEFAKGLVQPTGQDNNDTGDNAPSTVETVTPVISNWSTKP

SEQ ID NO: 865 - protein, 322 aa, Galactomyces geotrichum
MVNSSSNSIKLLAGNSHPELAKAVASRLGLELSRIAVSQYANQETSVTIGESVRDEDVFIIQTGCGEVNDYLMELLIMIHACKTASARRITAVIPNFPYARQDKKDKSRAPITAKLMANMLQTAGCNHVITMDLHASQIQGFFDVPVDNLYAEPSTLNYIRQNIDYKNAIIVSPDAGGAKRAASLADKLDLNFALIHKERQKANEVSRMVLVGDVQDKICILVDDMADTCGTLVKAADTLISHGAKSVIALVTHGIFSGAAVERINNSPLERVVCSNTVPHDAMQQVCPKLDHIDISPTLAESIRRLHNGESVSYLFTHAPI

SEQ ID NO: 866 - protein, 978 aa, Galactomyces geotrichum
MNTDSTLKNLLWNGSISVRLVLSQDEARNFVDYDYYINVPRLSYLHLQLPSALQFFRPLLRHPEDADMLDWWLEFEGVPIKWNWPIGLSFDLLTNHDPNKGPDAYAEIVPWTLILHKKNYPKDRILSLDDGIETVRSYWLNQIKEASYIRYGNSKAVLNLSKDDSDSLWSHLMQNNFVKLFAIVERQFAASPRNLPLRIYLPISNSVLQYPLPHDPNQTLGAALNACMPRLFPSKRTCVIARPVMHGVELPLRTPVGALFESGAVFCDGGIFGYINYLVPQTRGNIINTLLEGLQRQEYRGYDSAGLAVDGDELLSNVGEPYQPRSVLIFQQVGKVKLLKEHIAAQNINTETVFESHSGIAHTRWATHGQPKTVNCHPQRSDVNNEFTVVHNGIITNYREIKAFLESKGFKFESETDTEAIAKLTKYIYDSNIKEHGYDRKPDFSELAKLVIKELEGAYGLLIKSVHYPDELVATRKGSPLLIGVKTEKKLKVDFVDVEFVDAETEQNTGSLLAPQGVSAVPSLTVPGNTLQDHLRHSQSRAFLSEDNTPRPIEFFLASDPAAVVEHTRKVLFLEDDDIAHIYDGELHIHRVRRDVNEPGTRAIETLELELQQIMKGKFTHFMQKEIFEQPDSVINTMRGRVDFENNTVQLGGLRSWLTTIRRCRRIIMIACGTSYHSCLATRSIFEELTEIPVSVELASDFLDRRSPVFRDDTCVFVSQSGETADTIMALQYCLERGALTVGIVNSVGSSISRQTHCGVHINAGPEIGVASTKAYTSQYIALVMVALSLSDDRVSQLERRKEIIQGLSNISEQIAEVLKLDDHIRDLCEKDLLRHKSLLLLGRGYQFATALEGALKIKEISYMHSEGVLAGELKHGVLALVDENLPIIIMATRDSLFPKVSSAIEQVTARSGNPIIICNKGDSFGNGLKRLEVPQSVDCLQGLLNVIPLQLMSYWLAIKHGHDVDFPRNLAKSVTVE

SEQ ID NO: 867 - protein, 1970 aa, Galactomyces geotrichum
MSQNYNNRTYEDERYGDSQQDSYSNSEYQNQQQQPPPPQQQPFEYQPHTISGQHGYYDDHGNYYDQDAYYGQAAQGPNDPPFHGHQQYDNDNFYPDDPYGASDIDPYASSAQQNRQQQQQHMNQQQTNYTQPKGISDENSETFSDFTMKSGMARTAGIDFYGTAGDPRHNSLPQNNAMEIMGEDGYISHGGSQQAFRNTPSSRFSYGGNRSSGSSTPIYGLDYSGNLPAGQRSREPYPAWTAENQVSITKEEIEDIFIDLTSRFGFQRDSMRNMYDHFMVLLDSRASRMTPNQALLSLHADYIGGDNANYKKWYFAAQLDLDDQIGFRNMKLGKTNRRTRKARKKSKLDDPNADTQKTLEELEGDNSLEAAEYRWKAQMNQMSQHERARQIAMYLCCWGEANQVRFTPECLCFIYKCADDYFLSDECQSRTEPVPEGDFLNRVITPLYTFIRDQNYEVIEGKFVKREKDHSKVIGYDDVNQLFWYPEGIERIVLEDGTRLVDIPSSQRYGKLGEVTWTNVFFKTYKESRSWFHLAVNFNRIWVIHLSMFWFYAAFNSPTLYTPNYYQLLNNPPLAQTRWAACGLAGVVATVIQIVATLSEWAFVPRKWAGAQHLTRRLLFLILILLVNLISPIYVFGYITISRYSKSAHIVSIVGFFVAVATVLFFSVMPLGGLFGSYMNKKTRRYVASQTFTASFHKLSGNDMWVSYGLWVCVFVAKLVESYFFLILSLRDPIRDLSTMTMTRCTGEVYFGDTLCRQQAHITLGLMYLTDIVLFFLDTYLWYIICNSIFSVARSFYLGISIWTPWRNIFSRLPKRIYSKILATTDMEIKYKPKVLISQIWNAIIISMYREHLLAIDHVQQLLYHQVPSEVEGKRTLRAPTFFVSQDDNSIESEFFPRNSEAERRISFFAQSLSTPIPEPLPVDNMPTFTVFVPHYSEKILLSLREIIREDDQLSRVTLLEYLKQLHPVEWECFVRDTKILAEETSGFSLENSADNLEKEVSDEKSSIKSKIDDLPFYCIGFKSAAPEYTLRTRIWASLRSQTLYRTVSGFMNYSRAIKLLYRVENPEVVQMFGGNTEKLERELERMARRKFKFLVSMQRLTKFKSEEMENTEFLLRAYPDLQIAYLDEEPPLNEGEEPRLYSALIDGHCEIMENGRRRPKFRVQLSGNPILGDGKSDNQNHAIIFYRGEYIQLVDANQDNYLEECLKIRSVLAEFEELNVEHVNPYTPTLPSSTSGESQETKCPVAILGAREYIFSENIGILGDVAAGKEQTFGTLFARTLAQIGGKLHYGHPDFLNAIFMTTRGGVSKAQKGLHLNEDIYAGMNALLRGGRIKHCEYYQCGKGRDLGFGSILNFTTKIGTGMGEQILSREYYYLGTQLPLDRFLSFFYAHPGFHINNLFIIASVQLFMIVMLNIGALANQSIICLYDKNKPLTDPQIPTGCYNLRPTLDWVQRCILSIFIVFFIAFIPLVIQELTERGLWRAFVRFTRHFASLSPFFEVFVCQIYANSLLMDLTFGGARYIATGRGVATARIPFSVLYSRFAGDSIYLGARSMMMLLFATVSMWQAALLWFYITLFAMCISPFLYNPHQFSWTDFFIDYRDFIRWMSRGNNKWHRNSWIGYVRLTRTRITGYKRRISGDISERAISDVPRAKFTSLFFTEILIPIIVAAAAFVPYTFINSQNGVSDAEPVNSVLRVVICTLAPIAINAGALLVLASISCCAGPLLGVCCKKTSAVMAGIAHGISVIVHIVFFEVMWLLQGWRWTPALLGMITCMAIQRLLLKIFTIAFLTREFKQDNSNCAWWSGKWYSAGLGWMTMTQPLREFVCKLAEASYFAADFVLGHCLLFVQLPLLCVPMIDRWHSMLLFWLRPSRQIRPPIFSLKQNKLRKRMVKKYASLYFAILLLFLILIIAPAAAGKSMDTSSISKNLPDFADGLFQPVDQNNNDTGENAPSTVITVTPTLSNFSTMP

SEQ ID NO: 868 - protein, 772 aa, Galactomyces geotrichum
MLSSSTVCLKIRSVLAEFEELNVEHVNPYTPTLPSSTSGESQETKCPVAILGAREYIFSENIGILGDVAAGKEQTFGTLFARTLAQIGGKLHYGHPDFLNAIFMTTRGGVSKAQKGLHLNEDIYAGMNALLRGGRIKHCEYYQCGKGRDLGFGSILNFTTKIGTGMGEQILSREYYYLGTQLPLDRFLSFFYAHPGFHINNLFIIASVQLFMIVMLNIGALANQSIICLYDKNKPLTDPQIPTGCYNLRPTLDWVQRCILSIFIVFFIAFIPLVIQELTERGLWRAFVRFTRHFASLSPFFEVFVCQIYANSLLMDLTFGGARYIATGRGVATARIPFSVLYSRFAGDSIYLGARSMMMLLFATVSMWQAALLWFYITLFAMCISPFLYNPHQFSWTDFFIDYRDFIRWMSRGNNKWHRNSWIGYVRLTRTRITGYKRRISGDISERAISDVPRAKFTSLFFTEILIPIIVAAAAFVPYTFINSQNGVSDAEPVNSVLRVVICTLAPIAINAGALLVLASISCCAGPLLGVCCKKTSAVMAGIAHGISVIVHIVFFEVMWLLQGWRWTPALLGMITCMAIQRLLLKIFTIAFLTREFKQDNSNCAWWSGKWYSAGLGWMTMTQPLREFVCKLAEASYFAADFVLGHCLLFVQLPLLCVPMIDRWHSMLLFWLRPSRQIRPPIFSLKQNKLRKRMVKKYASLYFAILLLFLILIIAPAAAGKSMDTSSISKNLPDFADGLFQPVDQNNNDTGENAPSTVITVTPTLSNFSTMP

SEQ ID NO: 869 - protein, 708 aa, Galactomyces geotrichum
MCGIFGYVNYLVPQTRGHIVSTLIEGLQRQEYRGYDSAGLGVDGDERLTDVGEFNPPRNVQIFHQVGKVHLLKEHIDAQNINKDEVFECHAGIAHTRWATHGQPKTINCHPQRSDLNNQFIVVHNGIITNYREIKSLLESKGYRFESETDTEAIAKLTKFIYDQYIKEHGIDNKPDFSDLAKQVVKELEGAYGLIIKSVHYPDELVATRKGSPLLVGVKTEQKLKVDFVDVEFVEADAEANTGSLLSGGAGNLLAVPGSAVSEPLRHSQSRAFLSDDNTPRPIEFFMASDPAAVVEHTRKVLFLEDDDIAHISDGQLHIHRVRRDVNESPTRAIETLEMELQQIMKGQFSHFMQKEIFEQPESVINTMRGRVDFDNNTVQLGGLRSWLTTIRRCRRIIMIACGTSYHSCLATRSIFEELTEIPVSVELASDFLDRRSPVFRDDTCVFVSQSGETADTILALQYCLERGALTVGIVNSVGSSISRQTHCGVHINAGPEIGVASTKAYTSQYIALVMVALSLSDDRVSKVDRRREIIQGLKNISSQIKEVLGLDSHIKKLCDTDLASHKSLLLLGRGYQFATALEGALKIKEISYMHSEGVLAGELKHGVLALVDENLPIIVMATRDSLFPKVMSAIEQVTARSGNPIIICNPGTSLADGLQRLEVPQSVDCLQGLLNVIPLQLMSYWLAIKYGYDVDFPRNLAKSVTVE

SEQ ID NO: 870 - protein, 370 aa, Galactomyces geotrichum
MSTNSIKILAGDVHRNLAELVANRLGQKLCKVNVFRDSNRETSITIGESVRDEDVYIVTQIGSGDVNDRILELLIMVNACKTASARRITAVLPNFPYARQDRKDKSRAPITAKLMANMLETAGCNHVITMDLHASQIQGFFDVPVDNLYAEPSVVNYIKQNIDYQNAIIVSPDAGGAKRAAALADRLDLNFALIHKERARANEVSRMVLVGDVTDKICILVDDMADTCGTLAKAAETLLGHNARSVIAIVTHGILSGRATEIINKSKLQSVVCTNTVPLEGKDLQCSRLATIDISGVLAESIRRLHNGESVSYLFRNAPHVNWPCFRRTSSCDCPDGRVSTCNILFFFLFSFRYSFFLSSFSPFCKPTYI

SEQ ID NO: 871 - protein, 264 aa, Galactomyces geotrichum
MTSERETKTFLARLCEQAERYDEMVEYMKEVAKSGEELSVDERNLLSVAYKNVIGTRRASWRIISTIEQKEELKGANSTHLQEVKNYRLKIEKELEEVCNDVLSVLTDYLLPKAESGESKVFYYKMKGDYHRYLAEFASGEKRTKAADAAHEAYKKATEIAQTELTSTHPIRLGLALNFSVFYYEILNAPDLACQLAKQAFDDAISELDTLSEDSYRDSTLIMQLLRDNLTLWQSDLDALHNKGEESASGETKKEDADEESKDN

SEQ ID NO: 872 - protein, 506 aa, Microbacterium sp.
MRYAAPGEQGSLITLQKNYGNFINGEFVAPVNGNYFTNTSPVNGSAAGEFPRSDSADVDNAVAAATAAADAWGKTSAQQRSLLLLKIADRLEQNLETLAVYETWDNGKPVRETLAADMPLAVDHFRYFAGCLRAQEGSAAEIDEFTAAYHFHEPLGVVAQIIPWNFPLLMAAWKLAPALGAGNCVVLKPAEQTPLSITVFVDLIKDLLPPGVLNVVHGFGKEAGEALASHSGIAKVAFTGSTATGGHILELAAKSLIPSTVELGGKSPNIFFEDIMQAEESFIEKAAEGVVLGFLNQGEICTCPSRALVQESIYEPFMAAVMKRVKTIKRGDPLDTETMVGAQASQQQFDKILSYLDVARQEGAEVLVGGGVEKLDDSLNSGYYIQPTLLKGNNSMRVFQEEIFGPVIGITTFKDEAEAVSIANDSIYGLGAGVWTRDINRAYRVGRAIKAGRVWTNCYHLYPAHAAFGGYKKSGIGRETHKMMLDHYQQTKNLLVSYSIEPLGFF

SEQ ID NO: 873 - protein, 551 aa, Microbacterium sp.
MSTFTVGDYLLARLHEIGVNHLFGVPGDYNLQFLDRVIAHPVIGWVGCANELNAAYAADGYARCNGAGALLTTFGVGELSAINGIAGSYAEYLPVIHIVGAPATQAQQQGDCVHHSLGDGDFHHFIRMAEEVCAATAQLTADNACAEIDRVITSALQARRPGYLSLAVDVAAAAAEPPAQPLSIAQRSSTAVRQAFSAAAERLLAPAQRVSLLADFLALRWQQQSALAALRAHGAIPCASLLMGKGVLDEQQPGYVGTYAAEASAGQVREQIEQAEVAICVGVRFTDTITAGFTQQFVTERLIDLQPHSASVGGETFAPLTMAEAISELQPLFERYGPQWKPAISAPPAAQPAEPAAIISQHAFWQAMQDFLQPGDIILAEQGTAAFGAAALRLPSQAQLVVQPLWGSIGYTLPAAFGAQTAAPDRRVILIIGDGSAQLTIQELGSMLRDQQQLIIFLLNNEGYTVERAIHGATQRYNDIAQWNWTALPQALSLQGQAQSWRISETVQLQEVMARLARPQWLSLVEVVMQKEDLPPLLRKVTACLNQRNGG

SEQ ID NO: 874 - protein, 293 aa, Microbacterium sp.
MKGIILAGGSGTRLHPITRAVSKQLLPVYDKPMIYYPLSVLMLAGIRDILLITTPEDRMQFERLLGDGSEFGLRLSYAVQPSPDGLAQAFIIGESFIGDDNCCLVLGDNLYFGQGFSPKLRKVVEQNRGATVFGYQVMDPERFGVVEFDENFKALSIEEKPPQPKSRWAVTGLYFYDNQVVEFAKQVKPSARGELEITAINQMYLDRGELTVELLGRGFAWLDTGTHDSLVEASMFVQTVEKRQGFKIACLEEIAWRNGWLSDDQLRAAGEALTKTGYGQYLLDLLHARPRQY

SEQ ID NO: 875 - protein, 425 aa, Microbacterium sp.
MNHVASYYAATANPHAPWPTLQESIQCDVCIIGGGFTGLSAALHLTEAGYEVVVLEAARVGFGASGRNGGQVVNSYSRDVDVIEQRYGKESARMLGSMMFEGAEIIRDRIDRYAIACDYRPGGIFAALNARQMAHLRKQQTLWQQYGNHSLELLDERGIRREVGTERYVGGLLDRRGGHLHPLNLALGEAEAIRRHGGRIYEQSAALKVAYGSPNRVKTAQGEVSAKFVIFAGNAYLAPQLEPRLSRKSMPCGSQIVATEPLSPDQALSLLPNNYCVEDCNYLLDYFRLTADNRLLYGGGVVYGAREPADIEALIRPKLRRTFPQLQNVKLDFSWSGNFLLTLSRMPQFGRLENNVYFMQGDSGHGVTSTHLSGKLISEVLRGDAERFDAFARLPHLPFPGGRRFRVPLTAMGAVWYALRDRLGV

SEQ ID NO: 876 - protein, 471 aa, Microbacterium sp.
MTNLVEVEDFTLHCEEKRTSAFQLEVKAWLERHPETQYVDILLNDLNGVFRGKRIPVSALPKLEKGCYFPASVFAMDILGNTVEEAGLGQSLGEPDNLCLPVANTLVPSASDPQHIAQLLLTMCNQDGTPFDVEPRNVLNRLWQQLRNRGLFPVVAVELEFYLVDKKRDAEGFIQPPCAPGSDERNMQSQVYSVDNLDHFADVLRDIDDLARQQGIPADGALAEASPGQFEINLHHTRDVLRACDHAVQLKRLIRQVAENHGMTATFMAKPYEEYAGSGMHVHISMLDAADHNAFACDDGSDSPLMKRALAGMIDLMPASMALLAPNVNAFRRFVPDAYVPLQASWGHNNRTVALRVPCGDIDNHRIEYRVAGADANPYLVVSAILAGMLHGLDTQLPLPQPVTGNGHHAEGLALPIRQSDALYEFDNSYPLQKLLGERFAHVWHSCKNYELMQFERLITATEIDWMLKNA

SEQ ID NO: 877 - protein, 573 aa, Microbacterium sp.
MKQTVAALVAKTLESAGVKRIWGVTGDSLNGLSDSLNRMGTIEWMPTRHEEVAAFAAGAEAHISGELAVCAGSCGPGNLHLINGLFDCHRNRVPVLAIAAHIPSSEIGSNYFQETHPQELFRECSHYCELVSNPEQMPQVLGIAMRKAILNRGVSVVVLPGDVALQLAPETATAAWYPPQLPQVLPQPAELTQLAQTLNEASNITLLCGSGCAGAHAEVVALAEALKAPIVHALRGKEHIEYDNPYDVGMTGLIGFSSGFHAMMNAETLVLLGTQFPYRAFYPEKARIIQIDINPGSLGSHCHVDQAYVGDVKTTLQALLPQLTSKSDRRHLDSAVKHYGEARKSLDELAQPNDKQPIHPQYLAQQISHYASDDAIFTCDVGTPTVWAARYLKMNGKRRLLGSFNHGSMANAMPQALGAQAIDRNRQVVALCGDGGFSMLMGDFITLAQLKMPVKLVIFNNSVLGFVAMEMKAGGYLTDGTELDNPDFAAIAQACGIKGIRVEKASELNGALEQAFAHDGPVLVDVITAKEELAMPPQIKMEQAKGFSLYMLRAIMNGRGDEVVELAKTNWLR

SEQ ID NO: 878 - protein, 431 aa, Galactomyces geotrichum
MIRNNAFRAVRSAIAHQKRSLSLHEYRSANLLKSYGVGIPAGEAAVTPSEAEAVAKKLNLEDMVIKAQVLTGGRGKGVFDSGLKGGVKLISSPLEAKMYAEQMLHHKLVTKQTGPAGKEVTAVYIVEREFVRREAYVAILMDRASQGPIIVASAQGGMDIEGVAAETPEAIKTFKINIHEGVTDEIATAVAKTLNFSSKAIPEAAETIKNLYRVFDERDATQIEINPLSETTDNKVLAMDAKLGFDDNAAFRQEEVWSWRDLTQEDPQEIEAAKFGLNFIKLDGSIGCLVNGAGLAMATMDIIKLNGGDPANFLDCGGGATEKAIEKAFELITSDNKVTAIFVNIFGGIVRCDNIAKGLIAVTRHMDINIPIVARLQGTNLAEAQELLNNSGLKIFSFVDLDEAAQKVCQLSKVVKMAREIDVNVSFELPL

SEQ ID NO: 879 - protein, 328 aa, Galactomyces geotrichum
MSRTIRSSAKLARQFSTSSQRLNYADTAKNLKINSDTKVLFQGFTGKQGTFHAQQALEYGTKIVGGTNPKKAGQTHLGLPIFGNLADGIRETGASASAIFVPPPVAASAILEGIEAEIPLIVCITEGIPQHDMVRVVDALKTQSKTRLVGPNCPGIIAPEQCKIGIMPSAIHKRGRIGVVSRSGTLTYEAVNQTTNVGLGQSLVIGIGGDPFSGTNFIDALKVFLEDEETDGIIMIGEIGGTAEEEAAEFLKSYNLTRAVPKPVTSFIAGVSAPPGRRMGHAGAIISGGKGDAKSKISALEAAGVVVEPSPARLGKALYQEFVRRDLL

SEQ ID NO: 880 - protein, 244 aa, Galactomyces geotrichum
MFPARLAFRAASSSLKVAAASARGLATEAAQPAVKAPPTTGPMVLDAILRIKNEQDSTLTFRRSCREGICGSCAMNINGRNTLACLCRVDQDLKEDVKIYPLPHMFVVRDLVPDLTQFYKQYKSIEPYLQRDSVPEDGRENLQSIEDRKKLDGLYECILCACCSTSCPSYWWNSAEYLGPAVLMQAFRWMIDSRDQAGAARRARLENSMSLYRCHTIMNCSRTCPKGLNPGLAIAKIKKSMALA

SEQ ID NO: 881 - protein, 270 aa, Galactomyces geotrichum
MISSSLLRSSRLLASSLRPAARTLATAAAAEAKPVAMKKFQIYRWNPDTPEKKPELKTYEVDLNSTGPMILDAILRIKNEQDSTLTFRRSCREGICGSCAMNIDGRNTLACLCRIDKDTSKDTKIYPLPHMFVVRDLVPDLTQFYKQYKSIEPYLQRDNVPADGKENLQSIEDRKKLDGLYECILCACCSTSCPSYWWNSAEYLGPAVLMQAYRWMIDSRDQAGAARRARLENSMSLYRCHTIMNCSRTCPKGLNPGLAIAKIKKSMALA

SEQ ID NO: 882 - protein, 641 aa, Galactomyces geotrichum
MLSALKRSCLRNQANNLRSFHSSRAVGKVFAQDHVKGTEASSHLTKKYAVIDHEYDAVVVGAGGAGLRAAFGLAEAGFNTACISKLFPTRSHTVAAQGGINAALGNMHKDDWHWHMYDTVKGSDWLGDQDAIHYMTREAPKSIIELEHYGVPFSRTEEGRIYQRAFGGQSKEYGKGGQAYRTCAVADRTGHALLHSLYGQSLRHNTNFFIEYFAMDLLMQDGKCVGVIAYNQEDGTIHRFRAHKTVIATGGYGRAYFSCTSAHTCTGDGNAMVTRAGLPQQDLEFVQFHPTGIYGSGCLITEGSRGEGGYLLNKNGERFMERYAPTAKDLASRDVVSRSMTLEIREGRGVGPENDHIYLQLSHLPASVLQERLPGISETAAIFAGVDVTKEPIPVLPTVHYNMGGIPTKWTGEAITVDENGNDVVVPGLYACGEAASVSVHGANRLGANSLLDLVVFGRAVAHTISEQLTPGTPHGPAPADLGKESIENLDKMRTADGPLSTAEIRLAMQKVMQTDVSVFRTQSSLEDGVRRITEVDRLLPQIGTKDRSMIWNSDLVETLELQNLLTCAMQTAYSAVARKESRGAHAREDFPDRNDKEWMKHTLSWQHKPGQEIELKYRDVIYNTLDANECASVPPAKRVY

SEQ ID NO: 883 - protein, 662 aa, Galactomyces geotrichum
MTQPVVHEAHNIVARHTPKAFFDKHPSQPHISGLEHYKELYQQSIENPNKFFGDLAHELLSWDRDFETVSSGGFEHGDIAWFLEGKLNASYNLVDRHAAKNPDKVAIIYEADDAADSRKITYGELLREVCKVAGVLKSFGVQKGDSVAVYLPMIPEALIALLAISRIGAVHSVIFAGFSSGSLKDRVNDAKSKVIITTDEGKRGGKTVYTKKIVDEGLKDTPSVEKVLVYKRTGNDVPWTTGRDFWWHEEVSKHRPYVAPTPVSAEDPLFLLYTSGSTGSPKGVVHVTGGFLLGAAATCKYVFDIHPEDTLFTAGDVGWITGHTYAFYGPLLLGATTVIFEGTPAYPSYSRYWEIVEKYKVTQFYVAPTALRLLKRAGEDYIKKHDLSSLRTLGSVGEPIASEIWEWYNEHIGNNDCHISDTYWQTETGSHIIAPLAGVIPMKPGSATLPFFGIDLVIIDPVSGQEIKGNDVEGVLAIRKPWPSIARTVFNSHQRYLETYMKPYPGFYFTGDGAGRDHEGYYWIRGRVDDVVNVSGHRLSTAEIEAALVAHPAVAEAAVVGVADELTGQAVIAFASLKDVEATPELRKELVLQVRREIGPFAAPKSVIVVDDLPKTRSGKIMRRILRKIVSGEADSIGDTSTLSEPQVVGEIIDAVSKQYKI

SEQ ID NO: 884 - protein, 661 aa, Galactomyces geotrichum
MAPVVVESHNIVKIAPPKEFRDNHPTEPHLKDEQHYEELYKESITNPEKFFGNLARELLSWDKDFQTVKNGGFEYGDAAWFLEGELNASYNAVDRHALKNPDKVAIIYEADEPGKGYNVTYGELLREVSRVAATLASFGVKKGDTVAVYLPMIPEAIITLLAIVRLGAIHSVVFAGFSSGSLRDRIIDADSRVVITTDESVRGGRIIETKKIVDEALKGCPNVKHTLVFKRTGNESIPWNQDRDYWWHEEVARHRPYYPPVSVNSEDPIFLLYTSGSTGTPKGVVHSTAGYLLGAASTTKYVFDLHPDDILFTAGDVGWITGHTYCCYGPLLLGATTVVFEGTPAFPNFSRLWDIIDEHKVTQFYVAPTALRLLKRAGLDWIHHDLSSIRTLGSVGEPIAPDVWQWYNDNIGKGKAHICDTYWQTETGSHIISPLAGVTHTKPGSASFPVFGIDPVIIDPVSGEELTGNDIEGVLAIRSPWPSMARTVWNSHNRYMDTYLKPYPGYYFTGDGAGKDHEGYYWIRGRVDDVVNVSGHRLSTAEIEAALIEHPAVAESAVVGINDDLTGQAVNAFVALKSKPADVDAIKKELILQVRKSIGPFAAPKNVIIIEDLPKTRSGKIMRRILRKVLSGEEDQLGDISTLSNPDAVSNIIDVVKAGRK

SEQ ID NO: 885 - protein, 444 aa, Galactomyces geotrichum
MSNTNISASNRLKKLMEHLSPADAQRISPNMAASSTFQKIKVQDPIVELDGDEQTRIIWQFIKDKLIFPFLDVDLKYYDLGIEYRDQTDDQVTIDAANAILKYKVGVKCATITPDEARVEEFKLKKMWLSPNGTIRNILGGTVFREPIVIPRIPRLIPGWEKPIIIGRHAHGDQYKAQDFVVPGAGSVELVYKPANGGAEERIKVFDYKDSGVALAMYNTDDSITGFAHSSFKLALEKKLNLYMSTKNTILKKYDGRFKDIFQELYDNVYKKEFDAAGIWYEHRLIDDMVAQMIKSSGGYIIAMKNYDGDVQSDIVAQGFGSLGLMTSVLVTPDGETFESEAAHGTVTRHYRQHQQGKETSTNSIASIFAWTRGISQRGKLDKTPEVVAFADALEKATLDTVDVDGIMTKDLALACGKTDRSSYVLTEEFIDAVANRLKKDLKY

SEQ ID NO: 886 - protein, 439 aa, Galactomyces geotrichum
MAPQIRLASLASQLSGARRAAFPVSMRFSSSFQKIKVQNPIVELDGDEMTRIIWKSIKDKLIHPYLDVDLKYYDLGIQERDRTNDKITVDAAEAILKHQVGVKCATITPDEQRVKEFNLKKMWLSPNGTIRNILGGTVFREPIVIPRIPRLIPGWEKPIIIGRHAHGDQYKAQDYVVPEAGSLELVYKPANGGEAKTIKVYDYKGPGVALAMYNTDESITGFAHSSFKLALEKGLNLFMSTKNTILKKYDGRFKDIFQELYDTQYKAQFEAQGIWYEHRLIDDMVAQMIKSKGGYIIALKNYDGDVQSDIVAQGFGSLGLMTSVLVTPDGKTFESEAAHGTVTRHYRQHQQGKETSTNSIASIFAWTRGISQRGKIDNTPAVTEFATALEKATLDTVQVDGIMTKDLALACGKTDRSSYVLTEEFIDAVAKRLKADLKA

SEQ ID NO: 887 - protein, 332 aa, Galactomyces geotrichum
MSFVARRAFSSSSFNPSKVAVLGAAGGIGQPLSLLLKLNKDVTGLSLYDLRGTPGVAADLSHIPTNSKVTGYTPEKGGLKEALSGVEVVVIPAGVPRKPGMTRDDLFNTNASIVRDLAKGIAEFAPKAKVLIISNPVNSTVPIVAEVLKSKGVYDPKKVFGVTTLDVIRASRFISEVKGTNPAEETVTVVGGHSGHTIVPLISQSGHPDISGETLDALVNRIQFGGDEVVKAKDGAGSATLSMAQAGARFAGSLLKAAKGETVVEPTYVESPLFKDQGVDYFSSKVTLGPEGVKEIHPLGKLNAYEEKLIATALEDLKKNIKKGVDFVAQNP

SEQ ID NO: 888 - protein, 568 aa, Galactomyces geotrichum
MSSSTQTDNDTIPVGTYLFNRIRQLGINSIFGLPGDFNLALLDYISEVEGLRWVGNTNELNAGYAADGYSRLKSLAVLITTFGVGELSTINAIAGAFAEHVGLLHIVGVPAQSSENKKLLLHHTLGNGDYKVYARISKELSKKVIILEDSETAPHRIDDALRTAFISQRPVYLAIPTNIGELPVRKELLETPIDLVPPSNDPESEKEVVDRVLRLIEHANNPVILVDACANRHDVREETARLAEVTQFPVFTTPMGKSAFDEDNDRFGGVYIGSLSSPEVAKVVESSDLILSVGALLSDFNTGSFSYGYNTNNLVEFHSDHIKIKRATYEGVSMKPVLRELATRITPRDPALAVPVPKAQAVQTAPKNTKLTQDYLWANLSSFLRPGDVIVSETGTSSFGITKTTFPNHTVGISQVLYGSIGYSVGAALGAALAIEEIDPSRRVILLVGDGSLQLTAQAISTMIRWNLNPYLFVLNNDGYTIERLIHGPTSSYNDINPWRYTQLLEVFNAQNYQNYTIKTTGELDDVFESEEFAKPNKIRLIELVLPRLDAPLALVKQAEITSKTNAS

SEQ ID NO: 889 - protein, 562 aa, Galactomyces geotrichum
MSLEGVQVLATLDNSSPYPSGTTPRDILTKKALQFLVILQRSFNNRRKALLTARVERQKSIEAGNLPTFLEETKHIREDPSWLGPTPGQGLIDRRVEITGPPDRKMIINALNSDVSTYMSDFEDSLAPTWENVIWGQVNLYDAVRNNANFTAADSGKEYKIKGPDERSNSVPTIIVRPRGWHMVEKHILVDGEPISASIFDFGLYFFHNAQALIDSGKGPYYYLPKMESYHEARLWNDIFNVAQDYFSISRGTIRATVLIETLTGAFEMEEIIFELRQHSAGLNCGRWDYIFSTIKKLRTYKDKVLPDRGDVTMTVHFMASYVKRLIQVCHKRGVHAMGGMAAQIPIKNDSATNDAAMGRVRADKLREATAGHDGTWVAHPALAYIANDVFNTYMIAPNQIFYRPEKDVKGYTFAEGDDLLNTNIEGGKITEAGIRKNIYIGLSYMEAWLRGLGCVPIDSLMEDAATAEVSRAQLNQWVLHGVTTVDTKVQVTPELNAKILKEETDKLAAKAGAGNKFELAAKYFLPEITGKTFSDFLTTLLYDEIASTENSKPLDLATLAP

SEQ ID NO: 890 - protein, 542 aa, Galactomyces geotrichum
MVVPTNILFNGIEVRAPIPDNARHILTKDAVAFLATLHRTFNGRRKELLARRVERQKEIDNGALPDFLPETKHIREDPIWQGAPPAPGLEDRRVEITGPTDRKMVINALNADVYTYMSDFEDSSTPTWNNMIGGQVNLYDAVRRTISLQQGSKSYKLRTDRPVPTLIVRPRGWHLDESHFLVDGEPISGGIFDFGLYFFHNAKEAIAQGFGPYFYLPKMESHLEARLWNDIFKVSQDWIGIPRGTIRGTVLIETILGVFEMDEIIYELREHSSGLNCGRWDYIFSFIKKLRNHPEFVLPERNDVTMTVPFMSSYVKLLIQTCHKRGVHAMGGMAAQIPIKDDAQANKVAMEGVYKDKLREALAGHDGTWVAHPQLAHIALEVFNKHMPTPNQIFLRREEVHVTARDLINPYIPGGKISEAGIRKNLFIGLGYMEAWLRGVGCVPINYLMEDAATAEVSRSQLNQWVKHGVTTSEGKKVTKDYILALLADETKKAEQSGPKGNKFAEAARYLKPEITDEKYSDFLTTLLYDKVTTVDSVAAKL

SEQ ID NO: 891 - protein, 525 aa, Galactomyces geotrichum; identical to SEQ ID NO: 810

SEQ ID NO: 892 - protein, 372 aa, Galactomyces geotrichum
MLRTISRLASSPARRNFIRLNSTFVVPRTQKAIVFEKNNGPLLYKTDWPVPTPVADEILVNVKYSGVCHTDLHAWHGDWPLPTKLPLVGGHEGAGVVVARGSAVTNFELGDYAGIKWLNGSCLSCEFCLKGAESSCSDAILTGYTHDGTFQEYATAKAIHAAKIPKQTDLAQIAPILCAGITVYKALKTSTATPGQWVAITGAGGGLGSLAIQYAKAMGLRPIAIDTGAAKAELCKSLGAEVFIDFKATSDLSAEIKQATHGGPHAVIHVAVSEAAIEVSTDYVRPTGTIVLVGMPAGAVARSSVFNHVVKAIDIKGSYVGNREDTVEALDFFSRGLVSSPINIVGLSELASVYEKMEKGEIVGRFVLDTTC

SEQ ID NO: 893 - protein, 350 aa, Galactomyces geotrichum
MAPIPKTQKALVFETNGGPLLYKTDYPVPTPASDEILVNVKYSGVCHTDLHAWKGDWPLGTKLPLVGGHEGAGVVVAKGENVTNFEIGDYAGIKWLNGSCLGCEFCLKGAESNCAAAILSGYTHDGSFQEYATAKAVHAAQIPQGTDLAKISPILCAGITVYKALKVSDARPGEWVAITGAGGGLGSLAVQYAKAMGLRVIGIDTGDAKAQLVKELGGEAFIDFATTKDIVKDVVAATNGGPHAVIHVAVSEKAIGVSTEYVRPTGTIVLVGLPAGAVAKSEVFSHVIKTISIKGSYVGNRADSAEAIDFFTRGLVHSPIKIVGLSELEHVYELMEKGQIVGRYVLDTSK

SEQ ID NO: 894 - protein, 523 aa, Galactomyces geotrichum
MSSRAFSAASRAVRLTKSAATKSASRFYSSGFPLSTQVTLPNGIKYDQPTGLFINNEFVPSISGKTLKVENPATEEVLTEVYEADASDVDVAVDAAEAAFKTWSVMQPSERGRALYRLADLIERDLEVLASIECADNGKAIALARGDVGLVAKVIRYYAGYADKITGTVIETNDGHFTYTRREPIGVCGQIIPWNFPLLMWSWKIGPALATGNTVVLKTAESTPLSALYASKLAVEAGIPPGVINIISGYGSTGAAISNHMKIKKVAFTGSTNTGRAILKSAAESNLKKATLELGGKSPNIVFSDADIPNAIEMTNLGIFFNSGEVCCAGSRIYVQDTIYEKFLQQLKERTEANKVGNPFDPETFQGPQTSKTQLDKILHYVDVGKQDGATLVTGGYRIDRPGWFVAPTVFADVKEDMKVVKEEIFGPVVTVSKFSSVDEVIELANNSEYGLAAGIHTTDVNKAIDVSNRLNAGTIWINTYNNFHEAVPFGGYGQSGIGREMGEQALENYTQHKAVRIKIEKK

SEQ ID NO: 895 - protein, 130 aa, Brevibacterium frigoritolerans
MLALSGFSSDLRDIQVEADKGNERAELALKVFADRIHKYIGSYSAKMGGVDGIIFTAGIGENSQTIRGRILEGLEFMGVYWDKDLNHTKGKEAFINTPYSPVKVMVIPTNEEIMIVRDTVKIALKETWKA

SEQ ID NO: 896 - protein, 844 aa, Clavispora fructus
MGYTIKQKIEICLKSEANPLMTQTELANWAMKQYGSNKPPSQTTISRILSSKNEIIGSKESDFALVRRRKQSNPVLRKILTEWITQTHWEQIPITTPIIQLTANAIWTRLPKLLIDGNGVFNHKWCNHFVKRLNINLVGSREAVENNLGHPLNKVWRIDEKLELKRYLAGLISRHNYEPKDVFTIDEISLFYALPLDQIFDISSIDKGLKQSQSSTKNMLTVMLGCNIDGSEKLMPLIVSKDESLDASESSHPAFKSHGAAQLSPQALINKICEVYQILLKTNNNKWITSSMFQDYLLTLDHKIENASPNRKIMILLDNSSSHRMINLEFKHIKLVYLENASKHKNSYNGSFNGGKFDFLPMSFGIVEEFKILYRLQQYLEMINKQRNHGDSDSGLPISSSSNLNNLKRSSESDVLSQNEYDVLFMKVIEWIKRSWDSISSQKIFLSWKHTYLISFKHPWPATDARIVQQAQDLFIPLIEAEVSYDAEKSYHKLLEIMKYLNVMIPWNIDELLGLVNERSKVSLDYVSIEEIIGSCVLDKTDEEQKEQEPQTNTITPMSDTWFSGLNTLLPPTGEQRFPLPAVSQLSQKVTSQNPNQLAPISPALQYSNMNRPPQQQQPMALRQPQMPSKYREMPYSDYQIGSPGTTNMNALLLATSVSKNQEAGNSSLNGTNAFSLLLPVKQETLPPVLTRVDMNNPLAAERKRRLSFDTNGFPERKLQSFTSSLGAPYFTGSPLPGGLGTQDSLNTDPINFAGLSFSPVTNNPSMNGLRPQLPDRLREGNSETPLEAQAAADGDPDLISLLNRVIDASGSEGLKLSNFALEELRSNLTKMQGKYDHDKPLPM

SEQ ID NO: 897 - protein, 305 aa, Clavispora fructus
MAKYTVAALQIGASKEGSLKTVEKVLSYEKELLEKEVKLVVLPEATIGGYPKGSQFGTYLGYRLPEGRKEFVEYFKQSIEVPGPEILQLEGLSKRTGAMIVTGVIERGGSTLYCTMVYIDPKQGYVGKHRKLMPTATERLVWGQGDGSTLYVAESKELGRIGGGICWENYMPLYRAAYYAKGLNIYVAPTVDDREVWASLIKTIAVEGRQFAISSVPFLSWEEHTRDVPGYTREQPINGGSLIVDPYGEVLAGPLIGEEGLLTAEIDLDIILESRYDLDAAGHYTRPDIFKLTVDERARGTVFEK

SEQ ID NO: 898 - protein, 1881 aa, Debaryomyces hansenii
MSYNDNNHNYYDPNQHGAAGDEGYYQQQPYDDLNQPQQDYYDPNVQYQQQPYDMDGYQDQFTGGQQLPGQPVGGYNADPEAFSDFSYGGQTPGTPGYDQYGTQYTPSQMSYGGPRSSGASTPIYGGGMGSYDPTQFQMSSSLPYPAWSADPQAPIKIEHVEDIFIDLANKFGFQRDSMRNMFDYFMTLLDSRSSRMSPAQALLSLHADYIGGDNANYKKWFFASQQDLDDAIGFSNMTLGKVGKKARKASKKSKKARKAVEEHGQDMDALANELEGDYSLDAAEIRWRAKMNGLSPEERVRDIALYLLLWGEANQVRFTPETICYIYKTAFDYLMSPQCQQRQEPVPEGDYLNRVITPLYRFIRSQVYEIYEGRFVKREKDHNKVIGYDDVNQLFWYPEGISRIICEDGSRLVDIPQEERYLKLGEIEWSNVFFKTYKEIRTWLHLLTNYNRIWVIHGTVYWMYTAYNSPTLYTKNYAQPLNNQPTASSRWASAAIGGVLASFIQIMATVCEWLFVPREWAGAQHLTRRLLFLIIIFIVNLVPVVFTFYYAGLQTVSKAAHAVSIVGFFIAIATLIFFAIMPLGGLFTSYMNKRSRKYLASQTFTANFNKLRGLDMWMSYLVWVAVFAAKFAESYFFLTLSIRDPIRILSTTTMRCTGEVWFKNELCKHQAKIVLGLIYAVDLLLFFLDTYMWWIIVNCIFSVGRSFYLGISILTPWRNIFTRLPKRIYSKILATTEMEIKYKPKVLISQIWNAIVISMYREHLLAIDHVQKLLYHQVPSEVEGKRTLRAPTFFVSQDDNNFDTEFFPRNSEAERRISFFAQSLATPILEPLPVDNMPTFTVFTPHYSEKILLSLREIIREDDQFSRVTLLEYLKQLHPVEWECFVKDTKILAEETAAYENGDDPEKLSEDGLKSKIDDLPFYCIGFKSAAPEYTLRTRIWASLRSQTLYRTVSGFMNYARAIKLLYRVENPELVQYFGGDPEGLELALEKMARRKFRFIVSMQRLAKFKDDEMENAEFLLRAYPDLQIAYLDEEPALNEDEEPRVYSALIDGHCEMLENGRRRPKFRVQLSGNPILGDGKADNQNHALIFHRGEYIQLIDANQDNYLEECLKIRSVLSEFEELNVEHVNPYAPNLKNDENGSPTTPVAILGAREYIFSENSGVLGDVAAGKEQTFGTLFARTLAQIGGKLHYGHPDFLNATFMFTRGGVAKAQKGLHLNEDIYAGMTAIMRGGRIKHCEYYQCGKGRDMGFGSILNFTTKIGAGMGEQMLSREYYYLSTQLPLDRFLSFYYGHPGFHINNMFIQLSLQVFMLVLANLNSLAHESTFCIYDKNKPVTDLLLPYGCYNFDPAVDWIRRYTLSIFIVFFISFIPLIVQELIERGVWKATQRFVRHILSLSPMFEVFVAQIYSSSLFTDLTVGGARYISTGRGFATSRIPFSILYSRFADSSIYLGARSMLIIVFGSVSHWQAPLLWFWASLSSLMFSPFIFNPHQFAWEDFFIDYRDFIRWLSRGNTKWHRNSWIGYVRLSRSRITGFKRKLIGDDSEKSAGDATRAHRSNVFFADFLPCLIYTAGLFVAYTFINAQTGVYEDPQEVNSVLRLVICALAPVVIDLGCLAVCLGMACCAGPLLGMCCKKTGAVIAGVAHGVAVIVNLIFFVVMWVLEGFVFAKMLLGVITMIYIQRLLFKFLTLCFLTREFKNDKANTAFWTGKWYGSGLGYMAWTQPAREFCAKTIEMSEFAGDFILAHIILFCQLPILCIPLIDRWHSTMLFWLKPSRLIRPPIYSLKQARLRKRMVRKYCTLYFAVLILFVIVIVGPAVASGAIDNIEPSGLQDGSFKGLFQPRHKDNNDTGKRGSSYASTTYTYYSYTPKTQKTAFSTKA

SEQ ID NO: 899 - protein, 188 aa, Debaryomyces hansenii
MSEFNIESTLAQLTLQEKIGLLAGIDFWHTFAVERLNIPSLRFSDGPNGLRGTKFFDSVPSACFPCGTALAATFDKELLFEAGRLMGDEAKHKGAQVVLGPTMNIQRGPLGGRGFESFSEDAHLTGQSAASIINGIQDKGIAATIKHFVCNDLEDQRNSSDSILTERALREIYLEPFRLAIKHSNPKD

SEQ ID NO: 900 - protein, 697 aa, Debaryomyces hansenii
MCGIFGYVNFLVDKSRGEIMDNLIEGLQRLEYRGYDSSGIAIDGNKQDDVIIVKQTGKVVALKEEIVRQNVDRSTVFENHVGIAHTRWATHGQPMTTNCHPHRSDPKSEFVIVHNGIITNYRALKTLLLSKGMKFESETDSECIAKLFKHVYDSNMKAGYALDLNELTKQVLYELEGSYGLLVKSTHYPGEVCGTRKGSPLLVGVKTDKKLKVDFVDVEFPESNPDQAPISSNSTVQDMGLLPVAQGESNLRTSQSRAFLADDNLPMPVEFFLSSDPASVVQHTKKVLFLEDDDIAHIYDGELHIHRAKKLAGDSTIRQIQTLEMELNEIMKGPYKHFMQKEIFEQPESTFNTMRGRIDFENPNVLLGGLKSWLPTIRRCRRIIMIACGTSYHSCLATRSIFEELTEIPVAVELASDFLDRRSPVFRDDTCVFVSQSGETADSILALQYCLERGALTVGIVNSVGSSMSRQTHCGVHINAGPEIGVASTKAYTSQYIALVMFALSLSNDSISKAARHKEIIQGLRKIPEQIKTVLQLEDKIKQLCDTSLNDQKSMLLLGRGYQHATALEGALKIKEISYMHSEGVLAGELKHGVLALVDSKLPIIAFATRDSLFPKVLSAIEQVTARDGRPIVICNEGDDVIGGSRALATLHVPLTVDCLQGLLNVIPLQLMSYWLAVNRGIDVDFPRNLAKSVTVE

SEQ ID NO: 901 - protein, 320 aa, Debaryomyces hansenii
MSTNSIKLLASDVHRGLAELVAKRLGMKLTPSELKRDSTGEVQFSIGESVRDEDIFIICQIGSGEVNDRVIELLIMINACKTASARRISVILPNFPYARQDRKDKSRAPITAKLMADMLTTSGCNHVITMDLHASQIQGFFDVPVDNLYAEPSVVRYIKETINYKDAIMISPDAGGAKRAAGLADRLDLNFALIHKERARANEVSKMVLVGDVTDKISIIVDDMADTCGTLAKAAEVLLDNGAKEVIAIVTHGILSGNAIKNINNSKLTKVICTNTVPFEEKLLLCPKLDTIDVSAVLAEAIRRLHNGESISYLFKNAPL

SEQ ID NO: 902 - protein, 255 aa, Debaryomyces hansenii
MPTLREDSVYLAKLAEQAERYEEMVENMKTVASSGQELSVEERNLLSVAYKNVIGARRASWRIVSSIEQKEEAKGNESQVSLIRDYRSKIEAELSKICEDILSVLTDHLISSAQTGESKVFYYKMKGDYHRYLAEFAISEKRKDAADLSLEAYKSASDVAVTELPPTHPIRLGLALNFSVFYYEILNSPDRACHLAKQAFDDAVADLETLSEDSYKDSTLIMQLLRDNLTLWTDLSEAPAPTEEQQPSEPKADEE

SEQ ID NO: 903 - protein, 323 aa, Debaryomyces hansenii
MTASQNAIKLLHGNSHPELAKLISKKLGIGLAKVGAFQYTNKETAVAVGESVRDEDVYIIQTGCGEGEINDFLMELLIIINACKTASARRITAVIPNFPYARQDKKDKSRAPITAKLIANLLQTAGCNHVITLDLHASQIQGFFRVPVDNLYAEPSVLRHIKDNYGKEDLIIVSPDAGGAKRVASIADKLDVNFALIHKERQKANEVSKMVLVGDVTNKSCLLIDDMADTCGTLVKAADVLLKNGAKKVVAIITHGIFSSNAIEKLNNSNLDKIICTNSMPLENKLSQCPKLEIIDISATLAEAIRRLHNGESVSYLFNNAPA

SEQ ID NO: 904 - protein, 4 aa, Bacillus subtilis
ELLV

SEQ ID NO: 905 - protein, 5 aa, Bacillus subtilis
ELLVD

SEQ ID NO: 906 - protein, 6 aa, Bacillus subtilis
ELLVDL

SEQ ID NO: 907 - protein, 7 aa, Bacillus subtilis
ELLVDLL

SEQ ID NO: 908 - protein, 7 aa, Bacillus subtilis
  REGION 1..7: note = cyclic peptide via alkyl moeity between positions 1 and 7
  SITE 2: note = D-tyrosine
  SITE 3: note = D-asparagine
  SITE 6: note = D-asparagine
NYNQPNS

SEQ ID NO: 909 - protein, 10 aa, Bacillus subtilis
  SITE 2: note = D-ornithine
  SITE 3..10: note = cyclic peptide via side chain crosslink between positions 3 and 10
  SITE 4: note = D-allo-threonine
  SITE 6: note = D-alanine
  SITE 9: note = D-tyrosine
EXYTEAPQYI

SEQ ID NO: 910 - protein, 7 aa, Bacillus subtilis
  REGION 1..7: note = cyclic peptide via beta-hydroxy fatty acid chain between positions 1 and 7
ELLVDLL

The invention claimed is:

1. A medical food comprising a combination of four heterologous microbes comprising *Lactobacillus harbinensis*, *Lactobacillus brevis*, *Lactococcus lactis*, and *Bacillus velezensis*, wherein the heterologous microbes are formulated as a synthetic microbial consortium comprising about $1.0 \times 10^8$ to about $1.0 \times 10^{12}$ CFU of each of the heterologous microbes, wherein at least one of the heterologous microbes comprises a 16S rRNA sequence having at least 97%, at least 98%, at least 98.5%, at least 99%, or at least 100% identity to any one of SEQ ID NOs: 43, 198, 221, and 224, formulated in an amount effective to produce an anti-inflammatory effect in a human subject.

2. The medical food of claim 1, wherein the at least one of the heterologous microbes comprises a 16S rRNA sequence having at least 98%, at least 98.5%, at least 99%, or at least 100% identity to any one of SEQ ID NOs: 43, 198, 221, and 224.

3. The medical food of claim 1, further comprising a prebiotic selected from the group consisting of oligofructose, a dried fruit or vegetable powder, and combinations thereof.

4. The medical food of claim 1, further comprising one or more vitamins, wherein the one or more vitamins are selected from the group consisting of vitamins A, B6, B12, C, D, E, K1, K2, riboflavin, niacin, folic acid, pyridoxine, thiamine, pantothenic acid, biotin, and combinations thereof.

5. The medical food of claim 1, wherein producing an anti-inflammatory effect in a mammalian subject comprises reducing the level and/or activity of at least one inflammatory cytokine selected from Table 8 relative to a level and/or activity of the inflammatory cytokine in the serum of the subject; or a tissue of the subject, prior to administering the medical food to the subject.

6. The medical food of claim 5, wherein the anti-inflammatory effect in a mammalian subject is caused by the production of at least one anti-inflammatory metabolite selected from the group consisting of indole, indole acetic acid (IAA), indole propionic acid (IPA), bacteriocins, antibacterial peptides, serotonin, gamma-aminobutyric acid (GABA), dopamine, melatonin, secondary bile acids, and combinations thereof.

7. The medical food of claim 1, wherein administering an effective amount of the medical food to a human subject enables the dietary management of at least one symptom in the subject of a rheumatic disease selected from rheumatoid arthritis, spondyloarthritis, and psoriasis.

8. The medical food of claim 7, further comprising administering one or more additional agents for the treatment or management of one or more symptoms of rheumatic disease.

9. The medical food of claim 8, wherein the one or more additional agents comprises methotrexate.

10. The medical food of claim 1, wherein administering an effective amount of the medical food to a human subject enables the dietary management of at least one symptom of aging-associated inflammation in a human subject.

11. A unit dose comprising a combination of four heterologous microbes comprising *Lactobacillus harbinensis*, *Lactobacillus brevis*, *Lactococcus lactis*, and *Bacillus velezensis*, formulated as a synthetic microbial consortium comprising about $1.0 \times 10^9$ to about $1.0 \times 10^{11}$ CFU of each of the heterologous microbes, formulated as a powder, a tablet, a capsule, a caplet, granules, pellets, an emulsion, a syrup, or a lozenge for oral delivery.

12. The unit dose of claim 11, comprising about $2.5 \times 10^9$ to $3.0 \times 10^{10}$ CFU of each of the heterologous microbes.

13. A dietary supplement comprising a combination of four heterologous microbes comprising *Lactobacillus harbinensis*, *Lactobacillus brevis*, *Lactococcus lactis*, and *Bacillus velezensis*, wherein the heterologous microbes are formulated as a synthetic microbial consortium comprising about $1.0 \times 10^8$ to about $1.0 \times 10^{12}$ CFU of each of the heterologous microbes, wherein at least one of the heterologous microbes comprises a 16S rRNA sequence having at least 97%, at least 98%, at least 98.5%, at least 99%, or at least 100% identity to any one of SEQ ID NOs: 43, 198, 221, and 224, formulated in an amount to produce an anti-inflammatory effect in a mammalian subject.

14. The dietary supplement of claim 13, further comprising a prebiotic selected from the group consisting of oligofructose, a dried fruit or vegetable powder, and combinations thereof.

15. The dietary supplement of claim 13, further comprising one or more vitamins, wherein the one or more vitamins are selected from the group consisting of vitamins A, B6, B12, C, D, E, K1, K2, riboflavin, niacin, folic acid, pyridoxine, thiamine, pantothenic acid, biotin, and combinations thereof.

16. The dietary supplement of claim 13, wherein producing an anti-inflammatory effect in a human subject comprises reducing the level and/or activity of at least one inflammatory cytokine from Table 8 relative to a level and/or activity of the inflammatory cytokine in the serum of the subject; or a tissue of the subject, prior to administering the dietary supplement to the subject.

* * * * *